US007345217B2

(12) United States Patent
Zhang et al.

(10) Patent No.: US 7,345,217 B2
(45) Date of Patent: Mar. 18, 2008

(54) POLYNUCLEOTIDES AND POLYPEPTIDES IN PLANTS

(75) Inventors: James Zhang, Palo Alto, CA (US); Michael E. Fromm, Lincoln, NE (US); Jacqueline E. Heard, Stonington, CT (US); Jose Luis Riechmann, Pasadena, CA (US); Luc Adam, Hayward, CA (US); Pierre E. Broun, Heslington (GB); Omaira Pineda, Vero Beach, FL (US); T. Lynne Reuber, San Mateo, CA (US); James Keddie, San Mateo, CA (US); Guo-Liang Yu, Berkeley, CA (US); Cai-Zhong Jiang, Fremont, CA (US); Raymond Samaha, Soquel, CA (US); Marsha L. Pilgrim, Phoenixville, PA (US); Robert A. Creelman, Castro Valley, CA (US); Arnold N. DuBell, San Lorenzo, CA (US); Oliver Ratcliffe, Oakland, CA (US); Roderick Kumimoto, San Bruno, CA (US); Bradley K. Sherman, Berkeley, CA (US)

(73) Assignee: Mendel Biotechnology, Inc., Hayward, CA (US)

( * ) Notice: Subject to any disclaimer, the term of this patent is extended or adjusted under 35 U.S.C. 154(b) by 697 days.

(21) Appl. No.: 10/412,699

(22) Filed: Apr. 10, 2003

(65) Prior Publication Data

US 2004/0045049 A1    Mar. 4, 2004
US 2007/0061911 A9    Mar. 15, 2007

Related U.S. Application Data

(60) Continuation-in-part of application No. 10/374,780, filed on Feb. 25, 2003, and a continuation-in-part of
(Continued)

(60) Provisional application No. 60/434,166, filed on Dec. 17, 2002, provisional application No. 60/338,692, filed on Dec. 11, 2001, provisional application No. 60/336,049, filed on Nov. 19, 2001, provisional application No. 60/310,847, filed on Aug. 9, 2001, provisional application No. 60/338,692, filed on Dec. 11, 2001, provisional application No. 60/336,049, filed on Nov. 19, 2001, provisional application No. 60/310,847, filed on Aug. 9, 2001, provisional application No. 60/227,439, filed on Aug. 22, 2000, provisional application No. 60/227,439, filed on Aug. 22, 2000, provisional application No. 60/197,899, filed on Apr. 17, 2000, provisional application No. 60/166,228, filed on Nov. 17, 1999, provisional application No. 60/128,153, filed on Apr. 7, 1999, provisional application No. 60/125,814, filed on Mar. 23, 1999, provisional application No. 60/162,656, filed on Nov. 1, 1999, provisional application No. 60/161,143, filed on Oct. 22, 1999, provisional application No. 60/144,153, filed on Jul. 15, 1999, provisional application No. 60/135,134, filed on May 20, 1999, provisional application No. 60/129,450, filed on Apr. 15, 1999, provisional application No. 60/124,278, filed on Mar. 11, 1999, provisional application No. 60/121,037, filed on Feb. 22, 1999, provisional application No. 60/120,880, filed on Feb. 18, 1999, provisional application No. 60/116,841, filed on Jan. 22, 1999, provisional application No. 60/113,409, filed on Dec. 22, 1998, provisional application No. 60/108,734, filed on Nov. 17, 1998, provisional application No. 60/103,312, filed on Oct. 6, 1998, provisional application No. 60/101,349, filed on Sep. 22, 1998.

(51) Int. Cl.
C12N 15/29 (2006.01)
C12N 15/82 (2006.01)
A01H 5/00 (2006.01)
A01H 5/10 (2006.01)

(52) U.S. Cl. ............... 800/289; 800/298; 800/278; 800/287; 800/320; 435/320.1

(58) Field of Classification Search ............... 800/298, 800/278, 290, 287, 289; 435/320.1, 419; 536/23.1, 23.6
See application file for complete search history.

(56) References Cited

U.S. PATENT DOCUMENTS 6,828,476 B1    12/2004    Wilkins (Continued)

FOREIGN PATENT DOCUMENTS

EP    1033405    9/2000

(Continued)

OTHER PUBLICATIONS

Yang et al (2001, PNAS 98(20):11438-11443).*
Riechmann et al (2000, Current Opinion in Plant Biology 3:423-434).*

(Continued)

Primary Examiner—Stuart F. Baum
(74) Attorney, Agent, or Firm—Jeffrey M. Libby

(57) ABSTRACT

The invention relates to plant transcription factor polypeptides, polynucleotides that encode them, homologs from a variety of plant species, and methods of using the polynucleotides and polypeptides to produce transgenic plants having advantageous properties compared to a reference plant. Sequence information related to these polynucleotides and polypeptides can also be used in bioinformatic search methods and is also disclosed.

29 Claims, 25 Drawing Sheets

Related U.S. Application Data application No. 10/302,267, filed on Nov. 22, 2002, and a continuation-in-part of application No. 10/295,403, filed on Nov. 15, 2002, now abandoned, and a continuation-in-part of application No. 10/290,627, filed on Nov. 7, 2002, now abandoned, and a continuation-in-part of application No. 10/286,264, filed on Nov. 1, 2002, and a continuation-in-part of application No. 10/278,536, filed on Oct. 22, 2002, and a continuation-in-part of application No. 10/278,173, filed on Oct. 21, 2002, and a continuation-in-part of application No. 10/225,066, filed on Aug. 9, 2002, and a continuation-in-part of application No. 10/225,068, filed on Aug. 9, 2002, and a continuation-in-part of application No. 10/225,067, filed on Aug. 9, 2002, and a continuation-in-part of application No. 10/171,468, filed on Jun. 14, 2002, now abandoned, and a continuation-in-part of application No. 09/958,131, filed on Jan. 30, 2002, now Pat. No. 6,946,586, and a continuation-in-part of application No. 09/934,455, filed on Aug. 22, 2001, now abandoned, and a continuation-in-part of application No. 09/837,944, filed on Apr. 18, 2001, now abandoned, and a continuation-in-part of application No. 09/819,142, filed on Mar. 27, 2001, now abandoned, and a continuation-in-part of application No. 09/713,994, filed as application No. PCT/US00/09448 on Apr. 6, 2000, which is a division of application No. 09/533,030, filed on Mar. 22, 2000, now abandoned, which is a division of application No. 09/533,392, filed on Mar. 22, 2000, now abandoned, and a continuation-in-part of application No. 09/533,029, filed on Mar. 22, 2000, now Pat. No. 6,664,446, which is a division of application No. 09/532,591, filed on Mar. 22, 2000, now abandoned, which is a division of application No. 09/533,648, filed on Mar. 22, 2000, now abandoned, which is a division of application No. 09/506,720, filed on Feb. 17, 2000, now abandoned, and a continuation-in-part of application No. 09/489,376, filed on Jan. 21, 2000, now abandoned, which is a division of application No. 09/394,519, filed on Sep. 13, 1999, now abandoned.

U.S. PATENT DOCUMENTS

| | | | |
|---|---|---|---|
| 6,833,446 | B1 | 12/2004 | Wood et al. |
| 7,193,129 | B2 | 3/2007 | Reuber et al. |
| 2002/0066120 | A1 | 5/2002 | Cahoon et al. |
| 2004/0019927 | A1 | 1/2004 | Sherman et al. |
| 2004/0031072 | A1 | 2/2004 | La Rosa et al. |
| 2004/0034888 | A1 | 2/2004 | Liu et al. |
| 2004/0214272 | A1 | 10/2004 | La Rosa et al. |
| 2005/0091708 | A1 | 4/2005 | Weglartz et al. |
| 2005/0108791 | A1 | 5/2005 | Edgerton |
| 2006/0041961 | A1 | 2/2006 | Abad et al. |
| 2006/0075522 | A1 | 4/2006 | Cleveland et al. |
| 2006/0123505 | A1 | 6/2006 | Kikuchi et al. |
| 2006/0242738 | A1 | 10/2006 | Sherman et al. |
| 2006/0272060 | A1 | 11/2006 | Heard et al. |
| 2007/0016976 | A1 | 1/2007 | Katagiri et al. |
| 2007/0022495 | A1 | 1/2007 | Reuber et al. |
| 2007/0039070 | A1 | 2/2007 | Bloksberg et al. |
| 2007/0044171 | A1 | 2/2007 | Kovalic et al. |
| 2007/0061916 | A1 | 3/2007 | Kovalic et al. |
| 2007/0067865 | A1 | 3/2007 | Kovalic et al. |

FOREIGN PATENT DOCUMENTS

| | | |
|---|---|---|
| WO | WO0216655 | 2/2002 |
| WO | WO0300898 | 2/2002 |
| WO | WO03000906 | 1/2003 |
| WO | WO03008540 | 1/2003 |
| WO | WO03020741 | 3/2003 |
| WO | WO03020936 | 3/2003 |
| WO | WO2005001050 | 1/2005 |
| WO | WO2005122751 | 12/2005 |

OTHER PUBLICATIONS

Cedroni et al (2003, Plant Molecular Biology 51:313-325).*
U.S. Appl. No. 09/474,435, Unpublished, Monsanto Co.
Anderson, O. D., et al.; BF473064 (2000) WHE0925_C03_E05ZS Wheat 5-15 DAP spike cDNA library Triticum aestivum cDNA clone WHE0925_C03_E05, mRNA sequence.
Blewitt, M., et al.; AI731905 (1999) BNLGHi11247 Six-day Cotton fiber Gossypium hirsutum cDNA 5' similar to myb protein 308—garden snapdragon, mRNA sequence.
Fedorova, M., et al.; AW775893 (2000) EST334958 DSIL Medicago truncatula cDNA clone pDSIL-3M20, mRNA sequence.
Franken, P., et al.; X78846 (1994) Z.Mays Zm38 gene, intron 1.
Jackson, D., et al.; 82308 (JQ0960 (1993) myb protein 308—Garden snapdragon.
Lin, Q.; CAA64614 (GI:1167484) (1996) transcription factor.
Lin, Q., Hamilton, W. D. O. and Merryweather, A.; X95296 (1996) L.esculentum mRNA for THM27 protein.
Marocco, A., et al.; 1613412A (1993) myb-related gene Hv1.; GI:227030.
Marocco, A., et al.; 82730 (S04899) (1993) Transforming protein (myb) homolog (clone Zm38)—Maize. GI:82730.
Matz, E. C. and Burr, B.; AAK19619 (2001) GHMYB9 [Gossypium hirsutum].
Newman, T., et al.; N38154 (1998) 19381 Lambda-PRL2 Arabidopsis thaliana cDNA clone 220A8T7, mRNA sequence.
Rohde, W., et al; CAA50222 (1993) GI:19051.
Rohde, W., et al.; X70877 (1993) H.vulgare myb1 mRNA.
Rohde, W., et al.; X70879 (1993) HVMYB1G H.vulgare Myb1 gene.
Sasaki, Takuji; AU082325 (2002) Rice panicle (longer than 10cm).
Shoemaker, R.; BF716393 (2004) saa19f01.y1 Gm-c1058 Glycine soja cDNA clone Genome Systems Clone ID: Gm-c1058-1801 5' similar to SW:MYB3_MAIZE P20025 MYB-Related Protein ZM38. ;, mRNA sequence.
Suzuki, A., et al.; BAA23337 (1998) 2605617 OSMYB1 [Oryza sativa].
Van Der Hoeven, R., et al.; BG889982 (2003) EST515833 cSTD Solanum tuberosum cDNA clone cSTD16015 5' sequence, mRNA sequence.
Wing, R.A., et al.; BG442984 (2001) GA_Ea0019B05f Gossypium arboreum 7-10 dpa fiber library Gossypium arboreum cDNA clone GA_Ea0019B05f, mRNA sequence.
Agarwal et al. (2006). A R2R3 type MYB transcription factor is involved in the cold regulation of CBF genes and in acquired freezing tolerance. J Biol Chem 281, 37636-37645.
Borevitz et al. (2000). Activation tagging identifies a conserved MYB regulator of phenylpropanoid biosynthesis. Plant Cell 12, 2383-2394.
Brown, D.E., Rashotte, A.M., et al. (2001). Flavonoids act as negative regulators of auxin transport in vivo in *Arabidopsis*. Plant Physiol 126, 524-535.

Deluc, L., Barrieu, F., et al. (2006). Characterization of a grapevine R2R3-MYB transcription factor that regulates the phenylpropanoid pathway. Plant Physiol 140, 499-511.

Edwards et al. (2006). Flowering Locus C mediates natural variation in the high-temperature response of the *Arabidopsis* circadian clock. Plant Cell 18, 639-650.

Galis et al. (2006). A novel R2R3 MYB transcription factor NtMYBJS1 is a methyl jasmonate-dependent regulator of phenylpropanoid-conjugate biosynthesis in tobacco. Plant J 46, 573-592.

Goff et al. (1992). Functional analysis of the transcriptional activator encoded by the maize B gene: evidence for a direct functional interaction between two classes of regulatory proteins. Genes Dev 6, 864-875.

Hartmann et al. (2005). Differential combinatorial interactions of cis-acting elements recognized by R2R3-MYB, BZIP, and BHLH factors control I . . . Plant Mol Biol 57, 155-171.

Heine, G.F., Hernandez, J.M., and Grotewold, E. (2004). Two cysteines in plant R2R3 MYB domains participate in REDOX-dependent DNA binding. J Biol Chem 279, 37878-37885.

Hemm, M.R., Herrmann, K.M., and Chapple, C. (2001). AtMYB4: a transcription factor general in the battle against UV. Trends Plant Sci 6, 135-136.

Hu, W.J., Harding, S.A., et al. (1999). Repression of lignin biosynthesis promotes cellulose accumulation and growth in transgenic trees. Nat Biotechnol 17, 808-812.

Jin, H., Cominelli, E., et al. (2000). Transcriptional repression by AtMYB4 controls production of UV-protecting sunscreens in *Arabidopsis*. EMBO J 19, 6150-6161.

Kranz, H.D., Denekamp, M., et al. (1998). Towards functional characterisation of the members of the R2R3-MYB gene family from *Arabidopsis thaliana*. Plant J 16, 263-276.

Martin, C., and Paz-Ares, J. (1997). MYB transcription factors in plants. Trends Genet 13, 67-73.

Mehrtens, F., Kranz, H., et al. (2005). The *Arabidopsis* transcription factor MYB12 is a flavonol-specific regulator of phenylpropanoid biosynthesis. Plant Physiol 138, 1083-1096.

Multani, D.S., Briggs, S.P., et al. (2003). Loss of an MDR transporter in compact stalks of maize br2 and sorghum dw3 mutants. Science 302, 81-84.

Peer, W.A. et al. (2004). Variation in expression and protein localization of the PIN family of auxin efflux facilitator proteins in flavonoid mutants . . . Plant Cell 16, 1898-1911.

Pourtau, N., Jennings, R., et al. (2006). Effect of sugar-induced senescence on gene expression and implications for the regulation of senescence in . . . Planta 224, 556-568.

Quattrocchio, F., Wing, J.F., et al. (1998). Analysis of bHLH and MYB domain proteins: species-specific regulatory differences are caused by divergent . . . Plant J 13, 475-488.

Sablowski, R.W., Moyano, E., et al. (1994). A flower-specific Myb protein activates transcription of phenylpropanoid biosynthetic genes. EMBO J 13, 128-137.

Stracke, R., Werber, M., and Weisshaar, B. (2001). The R2R3-MYB gene family in *Arabidopsis thaliana*. Curr Opin Plant Biol 4, 447-456.

Tamagnone, L., Merida, A., et al. (1998). The AmMYB308 and AmMYB330 transcription factors from antirrhinum regulate phenylpropanoid . . . Plant Cell 10, 135-154.

Tohge, T., Nishiyama, Y., et al. (2005). Functional genomics by integrated analysis of metabolome and transcriptome of *Arabidopsis* plants . . . Plant J 42, 218-235Plant J 42, 218-235.

Vannini, C., Locatelli, F., et al. (2004). Overexpression of the rice Osmyb4 gene increases chilling and freezing tolerance of *Arabidopsis thaliana* plants. Plant J 37, 115-127.

Winkel-Shirley, B. (2002). Biosynthesis of flavonoids and effects of stress. Curr Opin Plant Biol 5, 218-223.

Zhu, J., Verslues, P.E., et al. (2005). HOS10 encodes an R2R3-type MYB transcription factor essential for cold acclimation in plants. Proc Natl Acad Sci U S A 102, 9966-9971.

* cited by examiner

FIGURE 3A

```
                                    100                      110                   120
SEQ ID NO 148
SEQ ID NO 1972    R R D F F R K
SEQ ID NO 38      R R R L N N S P F F S T S P L N L Q E N L K L
SEQ ID NO 2142    R R Q L H S S S H K H T K P H R P R F S I Y P S
SEQ ID NO 1084    R - - N - G S K T Q D S
SEQ ID NO 1085
SEQ ID NO 1086
SEQ ID NO 1083
SEQ ID NO 1087
SEQ ID NO 1088
SEQ ID NO 559
SEQ ID NO 1082
SEQ ID NO 1081    M
SEQ ID NO 1089
SEQ ID NO 1090
```

FIGURE 3B

```
                                    10                  20                  30
SEQ ID NO 170              M E S S S V D E S T T S T G S I C E T P A I T P A K K
SEQ ID NO 1950             M D S S C I D E I S S S T S E S F S A T A K K L S P
SEQ ID NO 370              M D A M S S V D E S T T T D S I P A R K S S S P A S -
SEQ ID NO 1184             M D G G - S V T D E T T T T S N S L S V P A N - - - - -
SEQ ID NO 1183             M D G G - C V T D E T T T S S D S L S V P - - - - - - -
SEQ ID NO 1182             M D A I S C M D E S T T T E S L S I S L S P T S S S E K
SEQ ID NO 1176                 M G V V S F S S T S - S G A S T A T T E S G G A V R
SEQ ID NO 1177         M E Q E A A M V V F S C N S G S G G S S S T T D S K Q E E E
SEQ ID NO 1179             M D S T S C L L D D A S S G A S T G - - - - - - - - K K
SEQ ID NO 1178             M D S S S C L V D D T N S G G S S - - - T D K L R A L A
SEQ ID NO 1186             M D S A S S L V D D T S S G G G G A C T D K L R A L A
SEQ ID NO 1185             M D S A S S L V D D T S G S G G - A C T D K L R A L A
                           M D   . S   .   . T   .   . . .     S 40                  50                  60
SEQ ID NO 170              - - - - - - - - - - - - - - - - - S S V G N L Y R M G S G S
SEQ ID NO 1950             P - - - - - - - - - - - - - - - - P A A A L R L Y R M G S G G
SEQ ID NO 370              - - - - - - - - - - - - - - - - - - - L L Y R M G S G T
SEQ ID NO 1184             - - - - - - - - - - - - - - L S P P P - - - L S L D G S G A
SEQ ID NO 1183             - - - - - - - - - - - - - - - - P P - - - - - S R V G S V A
SEQ ID NO 1182             A K P S S M I T S S E K V S L S P P P S N R L C R V G S G A
SEQ ID NO 1176             M S P E P - - - - - - - - - - - V V A V A A A A Q Q L P V
SEQ ID NO 1177             E E E E - - - - - - - - - - - - - - - - L A A M E E D E L
SEQ ID NO 1179             A A A A A - - - - - - - - - - - A S - K A L Q R V G S G A
SEQ ID NO 1178             A A A A E - - - - - - - - - - - T - - A P L E R M G S G A
SEQ ID NO 1186             V F A A A - - - - - - - - - - - S G - T P L E R M G S G A
SEQ ID NO 1185             A A A A S - - - - - - - - - - - A S G P P P E R M G S G A
                                                               L       R   G S G A 70                  80                  90
SEQ ID NO 170              S - V V L D S E N - - - - G V E A E S R - - - - - - - - - -
SEQ ID NO 1950             S S V V L D P E N - - - - G L E T E S R - - - - - - - - - -
SEQ ID NO 370              S - V V L D S E N G V E V E V E A E S R - - - - - - - - - -
SEQ ID NO 1184             T A V V Y P D G C C V - - S G E A E S R - - - - - - - - - -
SEQ ID NO 1183             S A V V D P D G C C V - - S G E A E S R - - - - - - - - - -
SEQ ID NO 1182             S A V V D P D G G G S - - G A E V E S R - - - - - - - - - -
SEQ ID NO 1176             V K G V D S A D E V V T S R P A A A A Q - - - - - - - - - -
SEQ ID NO 1177             I H V V Q A A E L R L P S S T T A T R - - - - - - - - - - -
SEQ ID NO 1179             S A V M D A A E P G A E A D S G G E - - - - - - - - - R R G
SEQ ID NO 1178             S A V V D A A E P G A E A D S G S G G R V C G G G G G G A G
SEQ ID NO 1186             S A V V D A A E P G A E A D S G S G - - - - - - - - - A A A V
SEQ ID NO 1185             S A V V D A A E P G A E A D S G S A P - - - A S V A A V A A
                           S A V V D     E         . .           . E   R 100                 110                 120
SEQ ID NO 170              - - - - K L P S S K Y K G V V P Q P N G R W G A Q I Y E K H
SEQ ID NO 1950             - - - - K L P S S K Y K G V V P Q P N G R W G A Q I Y E K H
SEQ ID NO 370              - - - - K L P S S R F K G V V P Q P N G R W G A Q I Y E K H
SEQ ID NO 1184             - - - - K L P S S K Y K G V V P Q P N G R W G A Q I Y E K H
SEQ ID NO 1183             - - - - K L P S S K Y K G V V P Q P N G R W G A Q I Y E K H
SEQ ID NO 1182             - - - - K L P S S K Y K G V V P Q P N G R W G A Q I Y E K H
SEQ ID NO 1176             - - - - - Q S S R Y K G V V P Q P N G R W G A Q I Y E R H
SEQ ID NO 1177             - - - - - - P S S R Y K G V V P Q P N G R W G A Q I Y E R H
SEQ ID NO 1179             G G G G K L P S S K Y K G V V P Q P N G R W G A Q I Y E R H
SEQ ID NO 1178             G A G G K L P S S K F K G V V P Q P N G R W G A Q I Y E R H
SEQ ID NO 1186             S V G G K L P S S R Y K G V V P Q P N G R W G A Q I Y E R H
SEQ ID NO 1185             G V G G K L P S S R Y K G V V P Q P N G R W G A Q I Y E R H
                                  K L P S S K Y K G V V P Q P N G R W G A Q I Y E   H
```

FIGURE 4A

|              | 130                                   | 140                                   | 150                         |
|--------------|---------------------------------------|---------------------------------------|-----------------------------|
| SEQ ID NO 170  | Q R V W L G T F | N E E D E A A R A Y D V A V | H R F R R R D A |
| SEQ ID NO 1950 | Q R V W L G T F | N E Q E E A A R S Y D I A A | C R F R G R D A |
| SEQ ID NO 370  | Q R V W L G T F | N E E D E A A R A Y D V A A | H R F R G R D A |
| SEQ ID NO 1184 | Q R V W L G T F | N E E D E A V R A Y D I V A | H R F R G R D A |
| SEQ ID NO 1183 | Q R V W L G T F | N E E D E A A R A Y D I A A | L R F R G P D A |
| SEQ ID NO 1182 | Q R V W L G T F | N E E D E A A R A Y D I A A | Q R F R G K D A |
| SEQ ID NO 1176 | A R V W L G T F | P D E E A A A R A Y D V A A | L R Y R G R D A |
| SEQ ID NO 1177 | A R V W L G T F | P D E E A A A R A Y D V A A | L R F R G R D A |
| SEQ ID NO 1179 | Q R V W L G T F | T G E A E A A R A Y D V A A | Q R F R G R D A |
| SEQ ID NO 1178 | Q R V W L G T F | A G E D D A A R A Y D V A A | Q R F R G R D A |
| SEQ ID NO 1186 | Q R V W L G T F | A G E A D A A R A Y D V A A | Q R F R G R D A |
| SEQ ID NO 1185 | L R V W L G T F | T G E A E A A R A Y D V A A | Q R F R G R D A |
|                | Q R V W L G T F |     E . E A A R A Y D V A A |   R F R G R D A |

|              | 160                                   | 170                                   | 180                         |
|--------------|---------------------------------------|---------------------------------------|-----------------------------|
| SEQ ID NO 170  | V T N F K D V K M D - - - - - - E D E V | D F L N S H S K S E |
| SEQ ID NO 1950 | V V N F K N V L E - - - - - - - D G D L | A F L E A H S K A E |
| SEQ ID NO 370  | V T N F K D T T F - - - - - - - E E E V | E F L N A H S K S E |
| SEQ ID NO 1184 | V T N F K P L A G A - - - - - D D A E A | E F L S T H S K S E |
| SEQ ID NO 1183 | V T N F K P P A A S - - - - - D D A E S | E F L N S H S K F E |
| SEQ ID NO 1182 | V T N F K P L A G A D - - - D D D G E S | E F L N S H S K P E |
| SEQ ID NO 1176 | A T N - F P G A A - - - - - A S A A E L | A F L A A H S K A E |
| SEQ ID NO 1177 | V T N R A P A A E G - - - - A S A G E L | A F L A A H S K A E |
| SEQ ID NO 1179 | V T N F R P L A E S - - D P E A A V E L | R F L A S R S K A E |
| SEQ ID NO 1178 | V T N F R P L A E A - - D P D A A A E L | R F L A T R S K A E |
| SEQ ID NO 1186 | V T N F R P L A D A - - D P D A A A E L | R F L A S R S K A E |
| SEQ ID NO 1185 | V T N F R P L A E S D L D P D A A A E L | R F L A S R S K A E |
|                | V T N F . P . A                         |       E L           F L     . H S K A E |

|              | 190                                   | 200                                   | 210                         |
|--------------|---------------------------------------|---------------------------------------|-----------------------------|
| SEQ ID NO 170  | I V D M L R K H T Y | N E E L E Q S K R R - - - - - R N G N G |
| SEQ ID NO 1950 | I V D M L R K H T Y | A D E L E Q N N K R Q L F L S V D A N G |
| SEQ ID NO 370  | I V D M L R K H T Y | K E E L D Q R K R N - - - - - R D G N G |
| SEQ ID NO 1184 | I V D M L R R H T Y | D N E L Q Q S T R G G - - - - - R R R - - |
| SEQ ID NO 1183 | I V D M L R K H T Y | D D E L Q Q S T R G G - - - - - R R R - - |
| SEQ ID NO 1182 | I V D M L R K H T Y | N D E L E Q S K R S R G V V - R R R G S |
| SEQ ID NO 1176 | I V D M L R K H T Y | A D E L R Q G L R R G R - - - - G M G A |
| SEQ ID NO 1177 | V V D M L R K H T Y | D D E L Q Q G L R R G - - - - - - - S - - |
| SEQ ID NO 1179 | V V D M L R K H T Y | L E E L T Q N K R A F A - - - - A I S P |
| SEQ ID NO 1178 | V V D M L R K H T Y | F D E L A Q S K R T F A - - - - A S T P |
| SEQ ID NO 1186 | V V D M L R K H T Y | F D E L A Q N K R A F A - - - - A A S A |
| SEQ ID NO 1185 | V V D M L R K H T Y | G E E L A Q N R R A F A - - - - A A A A |
|                | I V D M L R K H T Y |       D E L   Q     R                     |

|              | 220                                   | 230                                   | 240                         |
|--------------|---------------------------------------|---------------------------------------|-----------------------------|
| SEQ ID NO 170  | N M T R T L L T S G L S N D G V S T T G F - - - - - - R S A |
| SEQ ID NO 1950 | K R N G S S T T Q N D - - - - K V L - - - - - - - - K T C |
| SEQ ID NO 370  | K E T T A F A L A S M - - - - V V M T G F - - - - - - K T A |
| SEQ ID NO 1184 | - - R D A E T A S S G - - - - - A F D A - - - - - - - K A R |
| SEQ ID NO 1183 | - - L D A D T A S S G - - - - - V F D A - - - - - - - K A R |
| SEQ ID NO 1182 | A A A G T A N S I S G - - - - - A C F T - - - - - - - K A R |
| SEQ ID NO 1176 | - - R A Q P T P S - - - - - - - - - - - - - - - - - - W A R |
| SEQ ID NO 1177 | - - R A Q P T P R - - - - - - - - - - - - - - - - - - W A R |
| SEQ ID NO 1179 | P - P P K H P A S - - - - - - S P T S S - - - - - - S A A R |
| SEQ ID NO 1178 | S - A A T T T A S - - L S N G H L S S P R S P F A P A A A R |
| SEQ ID NO 1186 | A - T A S S L A N N P P S Y A S L S P A T A T A A A A A A R |
| SEQ ID NO 1185 | S - L A S P Q L P - - - - P A K N T S P - - - - - - A A A R |
|                |                                                   A R |

FIGURE 4B

|  | | | | | | | | | | | 250 | | | | | | | | | | | | 260 | | | | | | | | | | | 270 | | |
|---|---|---|---|---|---|---|---|---|---|---|---|---|---|---|---|---|---|---|---|---|---|---|---|---|---|---|---|---|---|---|---|---|---|---|---|---|
| SEQ ID NO 170  | E | A | L | F | E | K | A | V | T | P | S | D | V | G | K | L | N | R | L | V | I | P | K | H | H | A | E | K | H | F |
| SEQ ID NO 1950 | E | V | L | F | E | K | A | V | T | P | S | D | V | G | K | L | N | R | L | V | I | P | K | Q | H | A | E | K | H | F |
| SEQ ID NO 370  | E | L | L | F | E | K | T | V | T | P | S | D | V | G | K | L | N | R | L | V | I | P | K | H | Q | A | E | K | H | F |
| SEQ ID NO 1184 | E | Q | L | V | E | K | T | V | T | P | S | D | V | G | K | L | N | R | L | V | I | P | K | Q | H | A | E | K | H | F |
| SEQ ID NO 1183 | E | Q | L | F | E | K | T | V | T | P | S | D | V | G | K | L | N | R | L | V | I | P | K | Q | H | A | E | K | H | F |
| SEQ ID NO 1182 | E | Q | L | F | E | K | A | V | T | P | S | D | V | G | K | L | N | R | L | V | I | P | K | Q | H | A | E | K | H | F |
| SEQ ID NO 1176 | E | P | L | F | E | K | A | V | T | P | S | D | V | G | K | L | N | R | L | V | I | P | K | Q | H | A | E | K | H | F |
| SEQ ID NO 1177 | E | P | L | F | E | K | A | V | T | P | S | D | V | G | K | L | N | R | L | V | V | P | K | Q | H | A | E | K | H | F |
| SEQ ID NO 1179 | E | H | L | F | D | K | T | V | T | P | S | D | V | G | K | L | N | R | L | V | V | P | K | Q | Q | A | E | R | H | F |
| SEQ ID NO 1178 | D | H | L | F | D | K | T | V | T | P | S | D | V | G | K | L | N | R | L | V | I | P | K | Q | H | A | E | K | H | F |
| SEQ ID NO 1186 | E | H | L | F | D | K | T | V | T | P | S | D | V | G | K | L | N | R | L | V | I | P | K | Q | H | A | E | K | H | F |
| SEQ ID NO 1185 | E | H | M | F | D | K | V | L | T | P | S | D | V | G | K | L | N | R | L | V | V | P | K | Q | H | A | E | R | F | F |
|            | E |   | L | F | E | K |   | V | T | P | S | D | V | G | K | L | N | R | L | V | I | P | K | Q | H | A | E | K | H | F |

|  | | | | | | | | | | 280 | | | | | | | | | | | | 290 | | | | | | | | | | | 300 | | |
|---|---|---|---|---|---|---|---|---|---|---|---|---|---|---|---|---|---|---|---|---|---|---|---|---|---|---|---|---|---|---|---|---|---|---|---|
| SEQ ID NO 170  | P | L | P | S | - | - | - | - | - | - | - | - | - | - | - | - | - | - | - | - | - | - | - | S | N | V | S | V | K | G | V | L |
| SEQ ID NO 1950 | P | L | P | S | P | - | - | - | - | - | - | - | - | - | - | - | - | - | - | - | - | - | - | S | P | A | V | T | K | G | V | L |
| SEQ ID NO 370  | P | L | P | L | G | N | - | - | - | - | - | - | - | - | - | - | - | - | - | - | - | - | - | N | N | V | S | V | K | G | M | L |
| SEQ ID NO 1184 | P | L | S | G | S | G | G | G | A | L | P | - | - | - | - | - | - | - | - | - | - | C | M | A | A | A | A | G | A | K | G | M | L |
| SEQ ID NO 1183 | P | L | S | G | S | G | D | E | S | S | P | - | - | - | - | - | - | - | - | - | - | C | V | A | G | A | S | A | A | K | G | M | L |
| SEQ ID NO 1182 | P | L | Q | S | S | N | G | V | S | A | T | T | I | A | A | - | - | - | V | T | A | T | P | T | A | A | K | G | V | L |
| SEQ ID NO 1176 | P | L | R | R | A | A | S | S | D | S | - | - | - | - | - | - | - | - | - | - | - | - | - | A | S | A | A | A | T | G | K | G | V | L |
| SEQ ID NO 1177 | P | F | P | L | R | R | H | S | - | - | - | - | - | - | - | - | - | - | - | - | - | - | - | S | D | A | A | G | K | G | V | L |
| SEQ ID NO 1179 | P | L | Q | L | P | P | P | T | T | T | S | S | V | A | A | A | A | D | A | A | A | G | G | G | D | C | K | G | V | L |
| SEQ ID NO 1178 | P | L | Q | L | P | - | - | - | - | - | - | - | - | - | - | - | - | - | - | - | - | - | - | S | A | G | - | G | E | S | K | G | V | L |
| SEQ ID NO 1186 | P | L | Q | L | P | - | - | - | - | - | - | - | - | - | - | - | - | - | - | - | - | - | - | S | A | G | - | G | E | S | K | G | V | L |
| SEQ ID NO 1185 | P | A | A | G | A | G | - | - | - | - | - | - | - | - | - | - | - | - | - | - | - | - | - | S | T | - | - | - | - | - | - | - | Q |
|            | P | L |   |   |   |   |   |   |   |   |   |   |   |   |   |   |   |   |   |   |   |   |   |   |   |   |   |   | K | G | V | L |

|  | | | | | | | | | | 310 | | | | | | | | | | | 320 | | | | | | | | | | 330 | |
|---|---|---|---|---|---|---|---|---|---|---|---|---|---|---|---|---|---|---|---|---|---|---|---|---|---|---|---|---|---|---|---|---|
| SEQ ID NO 170  | L | N | F | E | D | V | N | G | K | V | W | R | F | R | Y | S | Y | W | N | S | S | Q | S | Y | V | L | T | K | G | W |
| SEQ ID NO 1950 | I | N | F | E | D | V | N | G | K | V | W | R | F | R | Y | S | Y | W | N | S | S | Q | S | Y | V | L | T | K | G | W |
| SEQ ID NO 370  | L | N | F | E | D | V | N | G | K | V | W | R | F | R | Y | S | Y | W | N | S | S | Q | S | Y | V | L | T | K | G | W |
| SEQ ID NO 1184 | L | N | F | E | D | V | G | G | K | V | W | R | F | R | Y | S | Y | W | N | S | S | Q | S | Y | V | L | T | K | G | W |
| SEQ ID NO 1183 | L | N | F | E | D | V | G | G | K | V | W | R | F | R | Y | S | Y | W | N | S | S | Q | S | Y | V | L | T | K | G | W |
| SEQ ID NO 1182 | L | N | F | E | D | V | G | G | K | V | W | R | F | R | Y | S | Y | W | N | S | S | Q | S | Y | V | L | T | K | G | W |
| SEQ ID NO 1176 | L | N | F | E | D | G | E | G | K | V | W | R | F | R | Y | S | Y | W | N | S | S | Q | S | Y | V | L | T | K | G | W |
| SEQ ID NO 1177 | L | N | F | E | D | G | D | G | K | V | W | R | F | R | Y | S | Y | W | N | S | S | Q | S | Y | V | L | T | K | G | W |
| SEQ ID NO 1179 | L | N | F | E | D | A | A | G | K | V | W | K | F | R | Y | S | Y | W | N | S | S | Q | S | Y | V | L | T | K | G | W |
| SEQ ID NO 1178 | L | N | F | E | D | A | A | G | K | V | W | R | F | R | Y | S | Y | W | N | S | S | Q | S | Y | V | L | T | K | G | W |
| SEQ ID NO 1186 | L | N | L | E | D | A | A | G | K | V | W | R | F | R | Y | S | Y | W | N | S | S | Q | S | Y | V | L | T | K | G | W |
| SEQ ID NO 1185 | L | C | F | Q | D | R | G | G | A | L | W | Q | F | R | Y | S | Y | W | G | S | S | Q | S | Y | V | M | T | K | G | W |
|            | L | N | F | E | D |   |   | G | K | V | W | R | F | R | Y | S | Y | W | N | S | S | Q | S | Y | V | L | T | K | G | W |

|  | | | | | | | | | | 340 | | | | | | | | | | 350 | | | | | | | | | | 360 |
|---|---|---|---|---|---|---|---|---|---|---|---|---|---|---|---|---|---|---|---|---|---|---|---|---|---|---|---|---|---|---|---|
| SEQ ID NO 170  | S | R | F | V | K | E | K | N | L | R | A | G | D | V | V | S | F | S | R | S | N | - | - | - | G | Q | D | Q | Q | L |
| SEQ ID NO 1950 | S | R | F | V | K | E | K | N | L | R | A | G | D | V | V | T | F | E | R | S | T | - | - | - | G | L | E | R | Q | L |
| SEQ ID NO 370  | S | R | F | V | K | E | K | R | L | C | A | G | D | L | I | S | F | K | R | S | N | - | - | - | D | Q | D | Q | K | F |
| SEQ ID NO 1184 | S | R | F | V | K | E | K | N | L | R | A | G | D | A | V | Q | F | F | K | S | T | - | - | - | G | L | D | R | Q | L |
| SEQ ID NO 1183 | S | R | F | V | K | E | K | N | L | R | A | G | D | A | V | Q | F | F | K | S | T | - | - | - | G | P | D | R | Q | L |
| SEQ ID NO 1182 | S | R | F | V | K | E | K | N | L | K | A | G | D | T | V | C | F | H | R | S | T | - | - | - | G | P | D | K | Q | L |
| SEQ ID NO 1176 | S | R | F | V | R | E | K | G | L | R | A | G | D | T | I | V | F | S | R | S | - | - | A | Y | G | P | D | K | L | L |
| SEQ ID NO 1177 | S | R | F | V | R | E | K | G | L | R | P | G | D | T | V | A | F | S | R | S | A | A | A | W | G | T | E | K | H | L |
| SEQ ID NO 1179 | S | R | F | V | K | E | K | G | L | H | A | G | D | A | V | G | F | Y | R | A | A | G | K | N | - | - | - | A | Q | L |
| SEQ ID NO 1178 | S | R | F | V | K | E | K | G | L | H | A | G | D | V | V | G | F | Y | R | S | A | A | S | A | G | D | D | G | K | L |
| SEQ ID NO 1186 | S | R | F | V | K | E | K | G | L | Q | A | G | D | V | V | G | F | Y | R | S | A | A | G | A | - | - | - | D | T | K | L |
| SEQ ID NO 1185 | S | R | F | V | R | A | A | R | L | A | A | G | D | T | V | T | F | S | R | S | G | G | G | R | - | - | - | Y | F | I | E |
|            | S | R | F | V | K | E | K |   | L |   | A | G | D |   | V |   | F |   | R | S |   |   |   |   |   | G |   | D |   | L |

FIGURE 4C

```
                              370              380                  390
SEQ ID NO 170    Y I G W K S R S G - - - - - - - - - - - - - - - - - - S D L
SEQ ID NO 1950   Y I D W K V R S G - - - - - - - - - - - - - P - - - R E N
SEQ ID NO 370    F I G W K S K S.G - - - - - - - - - - - - - - - - - L D L
SEQ ID NO 1184   Y I D C K A R S G K V N N N A A G L F I P V G - - - - P V V
SEQ ID NO 1183   Y I D C K A R S G E V N N N A G G L F V P I G - - - - P V V
SEQ ID NO 1182   Y I D W K T R N - - V V N N E V A L F G P V G - - - - P V V
SEQ ID NO 1176   F I D C K K N N A A A A T T T C A G D E R P - - - - T T S G
SEQ ID NO 1177   L I D C K K - M E R N N L A T V D D D A R - - - - - - - - -
SEQ ID NO 1179   F I D C K V R A K P T T A A A A A F L S A V A A A A A P P
SEQ ID NO 1178   F I D C K L V R S T G A A L A S P A D Q - - - - - - - P A P
SEQ ID NO 1186   F I D C K L R P N S V A A A S T A G P S - - - - - - - P P A
SEQ ID NO 1185   Y R H C Q R R R D V D I S F G D A T V P - A W P R P I V
                 I D C K     R 400              410                  420
SEQ ID NO 170    D A G R V L R L F G V N I S P E S - - - - - S R N D V V G N
SEQ ID NO 1950   P V Q V V V R L F G V D I F N V T T V - - - K P N D V V A V
SEQ ID NO 370    E T G R V M R L F G V D I S - - - - - - - - L N A V V V V
SEQ ID NO 1184   E P V Q M V R L F G V D L L K L P V P - - - - G S D G I G V
SEQ ID NO 1183   E P V Q M V R L F G V N L L K L P V P - - - - G S D - - G V
SEQ ID NO 1182   E P I Q M V R L F G V N I L K L P G S D T I V G N N N A S
SEQ ID NO 1176   A E P R V V R L F G V D I A G G D C R - - - K R E R A V E M
SEQ ID NO 1177   - - - V V V K L F G V D I A G D K T R
SEQ ID NO 1179   P A V K A I R L F G V D L L T A A P - - - E L Q D A G G A
SEQ ID NO 1178   S P V K A V R L F G V D L L T A - - - - - - - - - P A P V E
SEQ ID NO 1186   P V A K A V R L F G V D L L T A P V T - - - A A A P A E A V
SEQ ID NO 1185   I G T A A M N N G G A T V A S A T I A - - - G H D I E V A V
                       V R L F G V D . .                         . . . .

430              440                  450
SEQ ID NO 170    K R - - - - V N D T E M L S L V C S K Q R I F H A S
SEQ ID NO 1950   C G G K R S R D V D D M F A L R C S K K Q A I I N A L
SEQ ID NO 370    K E - - - - T T E V L M S S L R C K K - Q R V L
SEQ ID NO 1184   G C D - G K R K E M E L F A F E C S K K L K V I G A L
SEQ ID NO 1183   G K - - - - R K E M E L F A F E C C K K L K V I G A L
SEQ ID NO 1182   G C C N G K R R E M E L F S L E C S K P K I I G A L
SEQ ID NO 1176   G Q E V F L L K R Q C V H Q R T P A L G A L L L
SEQ ID NO 1177
SEQ ID NO 1179   A M T K S K R A M D A M A E S - Q A H V V F K K Q C I E L A
SEQ ID NO 1178   Q M A G C K R A R D L A A T T P P Q A A A F K K Q C I E L A
SEQ ID NO 1186   A V A G C K R A R D L G S - - - P P Q A A F K K Q L V E L A
SEQ ID NO 1185   A P S G A R S F R L F G F N V E C S G D D A P A P A P A P A
                                 R             C    .     . . . . .

460              470                  480
SEQ ID NO 170
SEQ ID NO 1950
SEQ ID NO 370
SEQ ID NO 1184
SEQ ID NO 1183
SEQ ID NO 1182
SEQ ID NO 1176
SEQ ID NO 1177
SEQ ID NO 1179   L T
SEQ ID NO 1178   L V
SEQ ID NO 1186   L V
SEQ ID NO 1185   E V E Y V D G D T
```

FIGURE 4D

```
                              10                    20                    30
SEQ ID NO 186                 M N P F Y S T F P D S F L S I S D H R S
SEQ ID NO 1958                      M N S F S A F S E M F G S D Y E P
SEQ ID NO 1960                                    M F G S D Y E S
SEQ ID NO 1962                      M N S F S A F S E M F G S D Y E S
SEQ ID NO 1238    M N I F K S P L D H D L N C G G I F H D S A E A S Y S S E T
SEQ ID NO 1242          M F T L N H S S D L Y H V S P E L S S S L D T S S P A S
SEQ ID NO 1240    M N I L G Q S L H Q - S N N G S Y S C S S P E T A N S S N L
SEQ ID NO 1241    M N I L G Q S F N E - S N N G S Y S C S S P E T G S S S N I
SEQ ID NO 1243    M N M Y T L N H S S Y L Y H V S P E L S S S L D S S S P A S
SEQ ID NO 1222                      M D T E D T S S A S S S S V S P
SEQ ID NO 1223                      M E W A Y Y G S G - - - - Y S S S G T P S
SEQ ID NO 1232                      M D V S A A L S S - - - - D Y S S G T P S
SEQ ID NO 1221                        M E K N T T A M G Q L M S S S A T T
SEQ ID NO 1231                        M E K N T A A S G Q L M T S S A E A
SEQ ID NO 1227                          M E V E E A - - - A Y R T V W S E -
SEQ ID NO 1235                M C T S K L E E I T G E W P - - - P P A L Q A A S T
SEQ ID NO 1230                M C G I K - Q E M S G E S S G - - S P C S S A S A E
SEQ ID NO 1229                        M E Y - - - - - - - - Y E - - Q E - -
SEQ ID NO 1228                M D M A G - H E V N S S S S - - - S S G A E S S S S
SEQ ID NO 1246                M C P T K - K G M T G E P S - - - S P C S S A S A S
SEQ ID NO 1247                M D M G R - L Q L Q L Q H A - - - A S S S S T S A S
SEQ ID NO 1244                M D M G R - H Q L Q L Q H A - - - A S S S S T S A S
SEQ ID NO 1245                      M E Y A A V G Y G Y G Y G Y D E R Q E P A
                                                                        S 40                    50                    60
SEQ ID NO 186     P V S - - - - D S S E C S P K L A S S C P K K R A G R K K F
SEQ ID NO 1958    - - - - - - - Q G G D Y C P T L A T S C P K K P A G R K K F
SEQ ID NO 1960    P V S - - - - S G G D Y S P K L A T S C P K K P A G R K K F
SEQ ID NO 1962    S V S - - - - S G G D Y I P T L A S S C P K K P A G R K K F
SEQ ID NO 1238    R S T P - - - - S D - E E V I L A S A R P K K R A G R R V F
SEQ ID NO 1242    E G S R G V A F S D - E E V R L A V R H P K K R A G R K K F
SEQ ID NO 1240    P T T P K A V H S D E E V N T L A S A H P K K R A G R R I F
SEQ ID NO 1241    P N T - - - F H S D E E V H T L A S A R P K K R A G R R I F
SEQ ID NO 1243    E G S R G V A F S D - E E V R L A V R H P K K R A G R K K F
SEQ ID NO 1222    P S S P - - - - - - - G G G H H H R L P P K R R A G R K K F
SEQ ID NO 1223    P V G G D G D E D S - - Y M T V S S A P P K R R A G R T K F
SEQ ID NO 1232    P V A A D A D D G S S A Y M T V S S A P P K R R A G R T K F
SEQ ID NO 1221    A A T - - - - - - - - A T G P A - - - - S P K R P A G R T K F
SEQ ID NO 1231    T P - - - - - - - - - - - S - - - - - - S P K R P A G R T K F
SEQ ID NO 1227    - - - - - - - - - - - - - - - - - - - - P P K R P A G R T K F
SEQ ID NO 1235    T S S - S E P C R R L S - - - - - P P S S K R P A G R T K F
SEQ ID NO 1230    R - - - Q H Q T V W T A - - - - - - - - P P K R P A G R T K F
SEQ ID NO 1229    - - - - - - - - - - - - E Y A T V T S A P P K R P A G R T K F
SEQ ID NO 1228    S S G - - - - - - - - - R - - - - - Q Q Y K K R P A G R T K F
SEQ ID NO 1246    T L P E H H Q T V W T S - - - - - - - P P K R P A G R T K F
SEQ ID NO 1247    S S S S S E Q N K L A W S P S S P Q P P K K R P A G R T K F
SEQ ID NO 1244    S S S - - E Q D - - - K - P L C C S G P K K R P A G R T K F
SEQ ID NO 1245    E S A D G G G G G D D E Y A T V L S A P P K R P A G R T K F
                                                          P K R P A G R T K F
```

FIGURE 5A

| | | | | | | | | | | | | | | 70 | | | | | | 80 | | | | | | | 90 | |
|---|---|---|---|---|---|---|---|---|---|---|---|---|---|---|---|---|---|---|---|---|---|---|---|---|---|---|---|---|
| SEQ ID NO 186 | R | E | T | R | H | P | I | Y | R | G | V | R | Q | R | N | S | - | - | - | - | G | - | K | W | V | C | E | V | R | E |
| SEQ ID NO 1958 | R | E | T | R | H | P | I | Y | R | G | V | R | Q | R | N | S | - | - | - | - | G | - | K | W | V | S | E | V | R | E |
| SEQ ID NO 1960 | R | E | T | R | H | P | I | Y | R | G | V | R | Q | R | N | S | - | - | - | - | G | - | K | W | V | C | E | L | R | E |
| SEQ ID NO 1962 | R | E | T | R | H | P | I | Y | R | G | V | R | R | R | N | S | - | - | - | - | G | - | K | W | V | C | E | V | R | E |
| SEQ ID NO 1238 | K | E | T | R | H | P | V | Y | R | G | V | R | R | R | N | K | - | - | - | - | N | - | K | W | V | C | E | M | R | V |
| SEQ ID NO 1242 | R | E | T | R | H | P | V | Y | R | G | V | R | R | R | N | S | - | - | - | - | D | - | K | W | V | C | E | V | R | E |
| SEQ ID NO 1240 | K | E | T | R | H | P | V | Y | R | G | V | R | R | R | N | N | - | - | - | - | N | - | K | W | V | C | E | V | R | V |
| SEQ ID NO 1241 | K | E | T | R | H | P | V | Y | R | G | V | R | R | R | N | N | - | - | - | - | N | - | K | W | V | C | E | V | R | V |
| SEQ ID NO 1243 | R | E | T | R | H | P | V | Y | R | G | V | R | R | R | N | T | - | - | - | - | D | - | K | W | V | S | E | V | R | E |
| SEQ ID NO 1222 | R | E | T | R | H | P | V | Y | R | G | V | R | A | R | A | G | - | - | - | - | G | S | R | W | V | C | E | V | R | E |
| SEQ ID NO 1223 | K | E | T | R | H | P | V | Y | K | G | V | R | S | R | N | - | - | - | - | - | P | G | R | W | V | C | E | V | R | E |
| SEQ ID NO 1232 | K | E | T | R | H | P | V | F | K | G | V | R | R | R | N | - | - | - | - | - | P | G | R | W | V | C | E | V | R | E |
| SEQ ID NO 1221 | Q | E | T | R | H | P | V | F | R | G | V | R | R | R | G | R | - | - | - | - | A | G | R | W | V | C | E | V | R | V |
| SEQ ID NO 1231 | Q | E | T | R | H | L | V | F | R | G | V | R | W | R | G | C | - | - | - | - | A | G | R | W | V | C | K | V | R | V |
| SEQ ID NO 1227 | R | E | T | R | H | P | V | Y | R | G | V | R | R | R | G | G | R | P | G | A | A | G | R | W | V | C | E | V | R | V |
| SEQ ID NO 1235 | H | E | T | R | H | P | V | F | R | G | V | R | R | R | G | R | - | - | - | - | A | G | R | W | V | C | E | V | R | V |
| SEQ ID NO 1230 | R | E | T | R | H | P | V | F | R | G | V | R | R | R | G | N | - | - | - | - | A | G | R | W | V | C | E | V | R | V |
| SEQ ID NO 1229 | R | E | T | R | H | P | V | Y | R | G | V | R | R | R | G | P | - | - | - | - | A | G | R | W | V | C | E | V | R | V |
| SEQ ID NO 1228 | R | E | T | R | H | P | V | Y | R | G | V | R | R | R | G | G | - | - | - | - | A | G | R | W | V | C | E | V | R | E |
| SEQ ID NO 1246 | R | E | T | R | H | P | V | F | R | G | V | R | R | R | G | S | - | - | - | - | A | G | R | W | V | C | E | V | R | V |
| SEQ ID NO 1247 | R | E | T | R | H | P | V | F | R | G | V | R | R | R | G | A | - | - | - | - | A | G | R | W | V | C | E | V | R | V |
| SEQ ID NO 1244 | R | E | T | R | H | P | V | F | R | G | V | R | R | R | G | A | - | - | - | - | A | G | R | W | V | C | E | V | R | V |
| SEQ ID NO 1245 | R | E | T | R | H | P | V | Y | R | G | V | R | R | R | G | P | - | - | - | - | A | G | R | W | V | C | E | V | R | E |
| | R | E | T | R | H | P | V | Y | R | G | V | R | R | R | | | | | | | | | G | R | W | V | C | E | V | R | V |

| | | | | | | | | | 100 | | | | | | | | | 110 | | | | | | | | | 120 | |
|---|---|---|---|---|---|---|---|---|---|---|---|---|---|---|---|---|---|---|---|---|---|---|---|---|---|---|---|---|
| SEQ ID NO 186 | P | N | K | - | K | S | R | I | W | L | G | T | F | P | T | V | E | M | A | A | R | A | H | D | V | A | A | L | A | L |
| SEQ ID NO 1958 | P | N | K | - | K | T | R | I | W | L | G | T | F | Q | T | A | E | M | A | A | R | A | H | D | V | A | A | L | A | L |
| SEQ ID NO 1960 | P | N | K | - | K | T | R | I | W | L | G | T | F | Q | T | A | E | M | A | A | R | A | H | D | V | A | A | I | A | L |
| SEQ ID NO 1962 | P | N | K | - | K | T | R | I | W | L | G | T | F | Q | T | A | E | M | A | A | R | A | H | D | V | A | A | L | A | L |
| SEQ ID NO 1238 | P | N | N | - | N | S | R | I | W | L | G | T | Y | P | T | P | E | M | A | A | R | A | H | D | V | A | A | L | A | L |
| SEQ ID NO 1242 | P | N | K | - | K | T | R | I | W | L | G | T | F | P | T | P | E | M | A | A | R | A | H | D | V | A | A | M | A | L |
| SEQ ID NO 1240 | P | N | D | K | S | T | R | I | W | L | G | T | Y | P | T | P | E | M | A | A | R | A | H | D | V | A | A | M | A | L |
| SEQ ID NO 1241 | P | N | D | K | S | T | R | I | W | L | G | T | Y | P | V | P | E | M | A | A | R | A | H | D | V | A | A | L | S | L |
| SEQ ID NO 1243 | P | N | K | - | K | T | R | I | W | L | G | T | F | P | T | P | E | M | A | A | R | A | H | D | V | A | A | M | A | L |
| SEQ ID NO 1222 | P | Q | - | A | Q | A | R | I | W | L | G | T | Y | P | T | P | E | M | A | A | R | A | H | D | V | A | A | I | A | L |
| SEQ ID NO 1223 | P | H | G | - | K | Q | R | I | W | L | G | T | F | E | T | A | E | M | A | A | R | A | H | D | V | A | A | M | A | L |
| SEQ ID NO 1232 | P | H | G | - | K | Q | R | I | W | L | G | T | F | E | T | A | E | M | A | A | R | A | H | D | V | A | A | L | A | L |
| SEQ ID NO 1221 | P | G | S | R | G | D | R | L | W | V | G | T | F | D | T | A | E | E | A | A | R | A | H | D | A | A | M | L | A | L |
| SEQ ID NO 1231 | P | G | S | R | G | D | R | F | W | I | G | T | S | D | T | A | E | E | T | A | R | T | H | D | A | A | M | L | A | L |
| SEQ ID NO 1227 | P | G | A | R | G | S | R | L | W | L | G | T | F | A | T | A | E | A | A | A | R | A | H | D | A | A | A | L | A | L |
| SEQ ID NO 1235 | P | G | R | R | G | C | R | L | W | L | G | T | F | D | A | A | D | A | A | A | R | A | H | D | A | A | M | L | A | L |
| SEQ ID NO 1230 | P | G | R | R | G | C | R | L | W | L | G | T | F | D | T | A | E | G | A | A | R | A | H | D | A | A | M | L | A | I |
| SEQ ID NO 1229 | P | N | K | - | K | S | R | I | W | L | G | T | F | A | T | A | E | A | A | A | R | A | H | D | V | A | A | L | A | L |
| SEQ ID NO 1228 | P | G | K | R | G | A | R | L | W | L | G | T | Y | V | T | A | E | A | A | A | R | A | H | D | A | A | L | A | L |
| SEQ ID NO 1246 | P | G | R | R | G | C | R | L | W | L | G | T | Y | D | T | A | E | A | A | A | R | A | H | D | A | A | M | I | A | L |
| SEQ ID NO 1247 | P | G | R | R | G | C | R | L | W | L | G | T | F | D | T | A | E | A | A | A | R | A | H | D | A | A | M | L | A | L |
| SEQ ID NO 1244 | P | G | R | R | G | A | R | L | W | L | G | T | Y | L | G | A | E | A | A | A | R | A | H | D | A | A | M | L | A | L |
| SEQ ID NO 1245 | P | N | K | - | K | S | R | I | W | L | G | T | F | A | T | P | E | A | A | A | R | A | H | D | V | A | A | L | A | L |
| | P | . | . | | . | | R | I | W | L | G | T | F | | T | A | E | M | A | A | R | A | H | D | V | A | A | L | A | L |

FIGURE 5B

|  | 130 |  |  |  |  |  |  |  | | | | | | | 140 | | | | | | | | | | | 150 |
|---|---|---|---|---|---|---|---|---|---|---|---|---|---|---|---|---|---|---|---|---|---|---|---|---|---|---|
| SEQ ID NO 186 | R | G | R | - | - | - | - | - | - | S | A | C | L | N | F | A | D | S | A | W | R | L | R | I | P | - | - | - | - | - |
| SEQ ID NO 1958 | R | G | R | - | - | - | - | - | - | S | A | C | L | N | F | A | D | S | A | W | R | L | R | I | P | - | - | - | - | - |
| SEQ ID NO 1960 | R | G | R | - | - | - | - | - | - | S | A | C | L | N | F | A | D | S | A | W | R | L | R | I | P | - | - | - | - | - |
| SEQ ID NO 1962 | R | G | R | - | - | - | - | - | - | S | A | C | L | N | F | A | D | S | A | W | R | L | R | I | P | - | - | - | - | - |
| SEQ ID NO 1238 | R | G | K | - | - | - | - | - | - | S | A | C | L | N | F | A | D | S | R | W | R | L | T | V | P | - | - | - | - | - |
| SEQ ID NO 1242 | R | G | R | - | - | - | - | - | - | Y | A | C | L | N | F | A | D | S | A | W | R | L | P | V | P | - | - | - | - | - |
| SEQ ID NO 1240 | R | G | K | - | - | - | - | - | - | S | A | C | L | N | F | A | D | S | A | W | R | L | P | L | P | - | - | - | - | - |
| SEQ ID NO 1241 | R | G | K | - | - | - | - | - | - | S | A | C | L | N | F | A | D | S | A | W | R | L | P | L | P | - | - | - | - | - |
| SEQ ID NO 1243 | R | G | R | - | - | - | - | - | - | Y | A | C | L | N | F | A | D | S | T | W | R | L | P | I | P | - | - | - | - | - |
| SEQ ID NO 1222 | R | G | E | R | - | - | - | - | - | G | A | E | L | N | F | P | D | S | P | S | T | L | P | R | - | - | - | - | - | - |
| SEQ ID NO 1223 | R | G | R | - | - | - | - | - | - | A | A | C | L | N | F | A | D | S | P | R | R | L | R | V | P | P | - | - | - | - |
| SEQ ID NO 1232 | R | G | R | - | - | - | - | - | - | A | A | C | L | N | F | A | D | S | P | R | R | L | R | V | P | P | - | - | - | - |
| SEQ ID NO 1221 | C | G | A | S | - | - | - | - | - | - | A | S | L | N | F | A | D | S | A | W | L | L | H | V | P | R | A | P | V | A |
| SEQ ID NO 1231 | C | G | A | S | - | - | - | - | - | - | A | S | L | N | F | A | D | S | A | W | L | L | H | V | P | R | A | P | V | V |
| SEQ ID NO 1227 | R | G | R | - | - | - | - | - | - | A | A | C | L | N | F | A | D | S | A | W | R | M | P | P | V | P | A | S | A | A |
| SEQ ID NO 1235 | R | G | R | A | A | - | - | - | - | A | A | C | L | N | F | A | D | S | A | W | L | L | A | V | P | P | - | P | A | T |
| SEQ ID NO 1230 | N | A | G | G | G | G | G | G | G | A | C | C | L | N | F | A | D | S | A | W | L | L | A | V | P | - | - | - | R | S |
| SEQ ID NO 1229 | R | G | R | - | - | - | - | - | - | G | A | C | L | N | F | A | D | S | A | R | L | L | R | V | D | P | - | - | - | - |
| SEQ ID NO 1228 | R | G | G | A | G | G | - | G | G | A | A | C | L | N | F | Q | D | S | A | W | L | L | A | V | P | - | - | P | A | A |
| SEQ ID NO 1246 | A | G | A | G | A | - | - | - | - | - | C | C | L | N | F | A | D | S | A | W | L | L | A | V | P | - | - | - | A | S |
| SEQ ID NO 1247 | G | - | - | - | - | - | - | R | G | A | A | C | L | N | F | P | D | S | A | W | L | L | A | V | P | P | P | P | A | L |
| SEQ ID NO 1244 | G | - | - | - | - | - | - | R | G | A | A | C | L | N | F | P | D | S | A | W | L | L | A | V | P | P | P | P | A | L |
| SEQ ID NO 1245 | R | G | R | - | - | - | - | - | - | A | A | C | L | N | F | A | D | S | A | R | L | L | Q | V | D | P | - | - | - | - |
|  | R | G | R |  |  |  |  |  |  |  | A | C | L | N | F | A | D | S | A | W | R | L |  | V | P |  |  |  |  |  |

|  |  |  |  |  | 160 |  |  |  |  |  | | | | | 170 | | | | | | | | | 180 |
|---|---|---|---|---|---|---|---|---|---|---|---|---|---|---|---|---|---|---|---|---|---|---|---|---|
| SEQ ID NO 186 | - | E | T | T | C | P | K | E | I | Q | K | A | A | S | E | A | A | M | A | F | Q | N | E | T | T | T | E | - | - | - |
| SEQ ID NO 1958 | - | E | S | T | C | A | K | D | I | Q | K | A | A | A | E | A | A | L | A | F | Q | D | E | T | C | D | T | - | - | - |
| SEQ ID NO 1960 | - | E | S | T | C | A | K | E | I | Q | K | A | A | A | E | A | A | L | N | F | Q | D | E | M | C | H | M | - | - | - |
| SEQ ID NO 1962 | - | E | S | T | C | A | K | D | I | Q | K | A | A | A | E | A | A | L | A | F | Q | D | E | M | C | D | A | - | - | - |
| SEQ ID NO 1238 | - | A | T | T | N | A | E | E | I | R | R | A | A | G | E | A | A | E | A | F | A | V | A | D | G | - | - | - | - | - |
| SEQ ID NO 1242 | - | A | T | A | E | A | K | D | I | Q | K | A | A | A | E | A | A | Q | A | F | R | P | D | Q | T | L | K | - | - | - |
| SEQ ID NO 1240 | - | A | S | T | N | A | K | E | I | R | R | V | A | A | A | A | V | V | A | I | A | A | E | D | S | R | G | - | - | - |
| SEQ ID NO 1241 | - | A | S | T | N | A | K | E | I | R | R | V | A | A | A | A | V | V | A | I | A | A | E | D | S | C | G | - | - | - |
| SEQ ID NO 1243 | - | A | T | A | N | A | K | D | I | Q | K | A | A | A | E | A | A | E | A | F | R | P | S | Q | T | L | E | - | - | - |
| SEQ ID NO 1222 | A | R | T | A | S | P | E | D | I | R | L | A | A | A | Q | A | A | E | A | F | R | R | P | P | P | P | L | - | - | - |
| SEQ ID NO 1223 | L | G | - | A | G | H | E | E | I | R | R | A | A | V | E | A | A | E | L | Y | R | R | P | P | P | P | L | - | - | - |
| SEQ ID NO 1232 | I | G | - | A | S | H | D | D | I | R | R | A | A | A | E | A | A | E | L | F | R | P | A | P | G | Q | H | - | - | - |
| SEQ ID NO 1221 | S | G | H | D | Q | L | P | D | V | Q | R | A | A | S | E | A | V | A | E | F | Q | R | R | G | S | - | - | - | - | - |
| SEQ ID NO 1231 | S | G | - | - | L | R | P | P | A | R | C | A | T | R | C | L | Q | G | H | R | R | V | P | A | P | G | - | - | - | - |
| SEQ ID NO 1227 | L | A | G | - | - | A | R | G | V | R | D | A | V | A | V | A | V | E | A | F | Q | R | Q | S | - | - | - | - | - | - |
| SEQ ID NO 1235 | L | R | C | - | - | A | A | D | V | Q | R | A | V | A | R | A | L | E | D | F | E | Q | R | E | S | S | S | S | V | F |
| SEQ ID NO 1230 | Y | R | T | - | - | L | A | D | V | R | H | A | V | A | E | A | V | E | D | F | F | R | R | R | L | A | D | - | - | - |
| SEQ ID NO 1229 | A | T | L | A | T | P | D | D | I | R | R | A | A | I | E | L | A | E | S | C | P | - | H | D | A | A | A | - | - | - |
| SEQ ID NO 1228 | P | S | D | - | - | L | A | G | V | R | R | A | A | T | E | A | V | A | G | F | L | Q | R | N | K | T | T | N | - | - |
| SEQ ID NO 1246 | C | A | S | - | - | L | A | E | V | R | H | A | V | A | D | A | V | D | D | F | L | R | H | Q | L | V | P | - | - | - |
| SEQ ID NO 1247 | S | G | G | - | - | L | D | G | A | R | R | A | A | L | E | A | V | A | E | F | Q | R | R | R | - | - | - | - | - | - |
| SEQ ID NO 1244 | S | G | G | - | - | L | D | G | A | R | R | A | A | L | E | A | V | A | E | F | Q | R | R | R | - | - | - | - | - | - |
| SEQ ID NO 1245 | A | T | L | A | T | P | D | D | I | R | R | A | A | I | Q | L | A | D | A | A | S | Q | Q | D | E | T | A | - | - | - |
|  | . | . |  | . |  |  |  |  | . | I | R | R | A | A | A | E | A | A |  | . | F |  |  |  |  |  |  |  |  |  |

FIGURE 5C

|  | 190 | 200 | 210 |
|---|---|---|---|
| SEQ ID NO 186 | - - - - G S - K T A | A E A E E A A G E | G V R E G E R - - - - |
| SEQ ID NO 1958 | - - - - T T T N H G | L D M E E T M V E | A I Y T P E - - - - - |
| SEQ ID NO 1960 | - - - - T T D A H G | L D M E E T L V E | A I Y T P E - - - - - |
| SEQ ID NO 1962 | - - - - T T - D H G F | D M E E T L V E | A I Y T A E - - - - - |
| SEQ ID NO 1238 | - - - - - - - - - - - | D D V N I - - - | - - - - - - - - - - - |
| SEQ ID NO 1242 | - - - - N A - - - - - | N T R Q E C V E | A V A V A - - - - - - |
| SEQ ID NO 1240 | - - - - K Q - - - - - | L R T N A I - D | A V A D - C E V S S S |
| SEQ ID NO 1241 | - - - - E Q - - - - - | L Q N S I V N D | A V A D D C E V S R S |
| SEQ ID NO 1243 | - - - - N T - - - - - | N T K Q E C V K | V V T T - - - - - - - |
| SEQ ID NO 1222 | - - - - A L P E - - - | D P Q E G T S G | G - - - - - - - - - - |
| SEQ ID NO 1223 | - - - - N A A A E A | A A V A A Q A T | A A S A - - - - - - - |
| SEQ ID NO 1232 | - - - - N A A T E V | A A A A S G - A T N S N A - - - - - - |
| SEQ ID NO 1221 | - - - - T A A T A T | A T S G D A A S T | A P P S - - - - - - |
| SEQ ID NO 1231 | - - R G S T A T A T | A T S G D A A S T | A P P - - - - - - - |
| SEQ ID NO 1227 | - - - - A A P S S P | A E T F A N D G D E E D - - - - - - |
| SEQ ID NO 1235 | P L A I D V V A E D | A M S A T S E P S | A A S D - - - - - - - |
| SEQ ID NO 1230 | - - D A L S A T S S S S T T P S T P R T D D D - - - - - - |
| SEQ ID NO 1229 | - - - - A A A S S S | A A A V E A S A A | A P A - - - - - - - |
| SEQ ID NO 1228 | G A S V A E A M D E | A T S G V S A P P P | L A N N A G S - - S |
| SEQ ID NO 1246 | - - E D D A L A A T P S S P S S E D G N T S D - - - - - - - |
| SEQ ID NO 1247 | - - F G A V A A D E | A T S G T S P P S S S S S P S G T Y V S |
| SEQ ID NO 1244 | - - F G A A A A D E | A T S G T S P P S S S S - - - - - - A |
| SEQ ID NO 1245 | - - - - A V A A D V | V A P S Q A D D V | A A - - - - - - - - - |

|  | 220 | 230 | 240 |
|---|---|---|---|
| SEQ ID NO 186 | - - - - - - - - - - | - - - - - - - - - - | - - - - - - - - - - |
| SEQ ID NO 1958 | - - - - - - - - - - | - - - - - - - - - - | - - - - - - - - - - |
| SEQ ID NO 1960 | - - - - - - - - - - | - - - - - - - - - - | - - - - - - - - - - |
| SEQ ID NO 1962 | - - - - - - - - - - | - - - - - - - - - - | - - - - - - - - - - |
| SEQ ID NO 1238 | - - - - - - - - E Q | - - - - - - - - - - | - - - - - - Q Q S V |
| SEQ ID NO 1242 | - - - - - - - - - - | - - - - - - - - - - | - - - - - - - - - V |
| SEQ ID NO 1240 | D I G V D E N C N N | - - - - - - - - - - | - - - - - - N K A S |
| SEQ ID NO 1241 | D V S F D E D S N S | - - - - - - - - - - | - - - - - - N K G L |
| SEQ ID NO 1243 | - - - - - - - - - - | - - - - - - - - - - | - - - - - - - - - - |
| SEQ ID NO 1222 | - - - - - - - - - - | - - - - - - - - - - | - - - - - - - - G A |
| SEQ ID NO 1223 | - - - - - - - - - - | - - - - - - - - - - | - - - - - - - - - - |
| SEQ ID NO 1232 | - - - - - - - - - - | - - - - - - - - - - | - - - - - - - - - - |
| SEQ ID NO 1221 | S S P V L S P N D - | - - - - - - - - - - | - - - - D N A S S A |
| SEQ ID NO 1231 | S A P V L S A K Q C E F I F L S S L D C W M L M S K L I S S |
| SEQ ID NO 1227 | N K D V L P V A A A | - - - - - - - - - - | - - - - - E V F D A |
| SEQ ID NO 1235 | - - D D A V T S S S | - - - - - - - - - - | - - - - - S T T D A |
| SEQ ID NO 1230 | - - E E S A A T D G | - - - - - - - - - - | - - - - - D E S S S |
| SEQ ID NO 1229 | - - - - - - - - - - | - - - - - - - - - - | - - - - - - - - - - |
| SEQ ID NO 1228 | E T P G P S S I D G | - - - - - - - - - - | - - - - - T A D T A |
| SEQ ID NO 1246 | - - G G E S S S D - | - - - - - - - - - - | - - - - - - - S S P |
| SEQ ID NO 1247 | Q A P A P A I E R V | - - - - - - - - - - | - - - - - P V E A S |
| SEQ ID NO 1244 | T K P A P A I E R V | - - - - - - - - - - | - - - - - P V E A S |
| SEQ ID NO 1245 | - - - - - - - - - - | - - - - - - - - - - | - - - - - - - - - - |

FIGURE 5D

```
                                 250                    260                    270
SEQ ID NO 186    R A E E Q N G G V F Y M D D E A L L G M P N F F E N M A G
SEQ ID NO 1958   - - - - Q S E G A F Y M D E E T M F G M P T L L D N M A G
SEQ ID NO 1960   - - - - Q S Q D A F Y M D E E A M L G M S S L L D N M A G
SEQ ID NO 1962   - - - - Q S E N A F Y M H D E A M F E M P S L L A N M A G
SEQ ID NO 1238   M A T N D D E V Q E P L Q Q E E V Q D L H D L L L S I A N E
SEQ ID NO 1242   A E T T T A T A Q G V F Y M E E E E Q V L D M P E L L R N M
SEQ ID NO 1240   Q R F C D L D E I T M P D A P V F E D M H E W L Q T M A A E
SEQ ID NO 1241   R V F C D L D E I T M A D A P V F E D M R E W L Q S M A D E
SEQ ID NO 1243   - T T I T E Q K R G M F Y T E E E E Q V L D M P E L L R N M
SEQ ID NO 1222   T A T S G R P A A V F V D E D A I F D M P G L I D D M A R G
SEQ ID NO 1223   E L F A D F P C Y P - - M D G L E F E M Q G Y L D M A Q G M
SEQ ID NO 1232   E Q F A S H P Y Y E V M D D G L D L G M Q G Y L D M A Q G M
SEQ ID NO 1221   S T P A V A A A L D H G D M F G G M R T D L Y F A S L A Q G
SEQ ID NO 1231   S R A K G S L C L R K N P I S F C M V T N S Y T A L L L E Y
SEQ ID NO 1227   G A F E L D - - - - D G F R F G G M D A G S Y Y A S L A Q G
SEQ ID NO 1235   D E E A S P - - - F E L D V V S D M G W S L Y Y A S L A E G
SEQ ID NO 1230   P A S D L A - - - F E L D V L S D M G W D L Y Y A S L A Q G
SEQ ID NO 1229   M M M Q Y Q D D M A A T P S S Y D Y A Y Y G N M D F D Q P S
SEQ ID NO 1228   A G A A L D - - M F E L D F F G E M D Y D T Y Y A S L A E G
SEQ ID NO 1246   P T G A S P - - - F E F D V F N D M S W D L H Y A S L A Q G
SEQ ID NO 1247   E T A A L D G A V F E P D W F R D M D L D L Y Y A S L A E G
SEQ ID NO 1244   E T V A L D G A V F E P D W F G D M D L D L Y Y A S L A E G
SEQ ID NO 1245   - - - - - - - - - - A A A A A A A A A M Y G G M E F D H S Y
                                            D                      .         . A G 280                    290                    300
SEQ ID NO 186    M L L P P P E V G W N H N - - - - - - - - - - D F D G V G D
SEQ ID NO 1958   M L L P P P S V Q W N H N Y - - - - - - - - - D G E G D G D
SEQ ID NO 1960   M L L P S P S V Q W N Y N F - - - - - - - - - D V E G D D D
SEQ ID NO 1962   M L L P L P S V Q W N H N H - - - - - - - - - E V D G D D D
SEQ ID NO 1238   P L M S P P P C A R D G R D - - - - - - - - - W N D V D I F
SEQ ID NO 1242   V L M S P T H C L G Y E Y E - - - - - - - - - D A D L D A Q
SEQ ID NO 1240   P L R S P T F V T Y V N V R - - - - - - - - - D V W N F V E
SEQ ID NO 1241   P L R S P T F V T Y V N V R - - - - - - - - - D V W N F V E
SEQ ID NO 1243   V L M S P T H C I G Y E Y E - - - - - - - - - D A D L D A Q
SEQ ID NO 1222   M M L T P P A I G R S L D D - - - - - - - - - W A A I D D D
SEQ ID NO 1223   L I E P P P L A G Q S T W A - - - - - - - - - - E E D Y D
SEQ ID NO 1232   L I D P P P M A C D P A V G G G - - - - - - - - - E D D N D
SEQ ID NO 1221   L L I E P P P P T T - - - - - - - - - - - - A E G F C D
SEQ ID NO 1231   I I L Q M N S M I V L - - - - - - - - - - - - I H E L S K
SEQ ID NO 1227   L L V E P P A A G - - - - - - - - - - - - - A W W E D G
SEQ ID NO 1235   L L M E P P A S G A S - - - - - - - - - - - S D D D D D
SEQ ID NO 1230   M L M E P P S A A L G - - - - - - - - - - - D D G D - -
SEQ ID NO 1229   Y Y Y D G M G G G E - - Y Q S - - - - W Q - - M D G D D D
SEQ ID NO 1228   L L M E P P P A A T - - - - - - - - - - - - A L W D N G
SEQ ID NO 1246   L L V E P P - S A V T - - - - - - - - - - - - A F M D - -
SEQ ID NO 1247   L L V E P P P P P - - - - - - - - - - - - - - A A W D H G
SEQ ID NO 1244   L L V E P P P P P P P - - - - - - - - - - - - A A W D H G
SEQ ID NO 1245   C Y D D G M V S G S S D C W Q S G G G G W H S S V D G D D D
                 . L        P P  . .                                     . . . D .
```

FIGURE 5E

```
                            310             320          330
SEQ ID NO 186    - - - - - - - - - - V S L W S F D E
SEQ ID NO 1958   - - - - - - - - - - V S L W S Y
SEQ ID NO 1960   - - - - - - - - - - V S L W S Y
SEQ ID NO 1962   D - - - - - - - - - V S L W S Y
SEQ ID NO 1238   D D - - - - - - D E I S L W N F S I
SEQ ID NO 1242   D - - - - - - - A E V S L W N F S I
SEQ ID NO 1240   D D - - - - - - A E V S L W S F T V
SEQ ID NO 1241   D D - - - - - - A E V S L W S F T I
SEQ ID NO 1243   D - - - - - - - A E V S L W S F S I
SEQ ID NO 1222   D D H Y - - - H M D Y K L W M D
SEQ ID NO 1223   C - - - - - - - - - E V N L W S Y
SEQ ID NO 1232   G - - - - - - - - - E V Q L W S Y
SEQ ID NO 1221   D E G - - C G G A E M E L W S
SEQ ID NO 1231   Y Q V - - F L L L T M I T H H L F Q W R R
SEQ ID NO 1227   E - - - - L A G S D M P L W S Y
SEQ ID NO 1235   A I V D S S D I A D V S L W S Y
SEQ ID NO 1230   - - - - - A I L A D V P L W S Y
SEQ ID NO 1229   G G A G G Y G G G D V T L W S Y
SEQ ID NO 1228   D E - - - - - G A D I A L W S Y
SEQ ID NO 1246   - - - - - E G F A D V P L W S Y
SEQ ID NO 1247   D C S - - H S G A D V A L W S Y
SEQ ID NO 1244   D C C - - D S G A D V A L W S Y
SEQ ID NO 1245   G - - - - - - A G D M T L W S Y N A V E S V S S A G G W E R
                                 . . V . L W S Y 340             350          360
SEQ ID NO 186
SEQ ID NO 1958
SEQ ID NO 1960
SEQ ID NO 1962
SEQ ID NO 1238
SEQ ID NO 1242
SEQ ID NO 1240
SEQ ID NO 1241
SEQ ID NO 1243
SEQ ID NO 1222
SEQ ID NO 1223
SEQ ID NO 1232
SEQ ID NO 1221
SEQ ID NO 1231
SEQ ID NO 1227
SEQ ID NO 1235
SEQ ID NO 1230
SEQ ID NO 1229
SEQ ID NO 1228
SEQ ID NO 1246
SEQ ID NO 1247
SEQ ID NO 1244
SEQ ID NO 1245   R P R S G A T T G Q G R K W G S R E R V R I
```

```
SEQ ID NO:1875    1  MGRKKLEIKRIENKSSRQVTFSKRRNGLIEKARQLSVLCDASVALLVVSASGKLYSFSSG   60
SEQ ID NO:1735    1  MGRRKIEIKRIENKSSRQVTFSKRRNGLIDKARQLSILCESSVAVVVSASGKLYDSSSG   60
SEQ ID NO:568     1  MGRKKVEIKRIENKSSRQVTFSKRRNGLIEKARQLSILCESSIAVLVVSGGKLYKSASG   60
SEQ ID NO:944     1  MGRRKVEIKRIENKSSRQVTFSKRRKGLIEKARQLSILCESSIAVVAVSGSGKLYDSASG   60
SEQ ID NO:946     1  MGRRKVEIKRIENKSSRQVTFCKRRNGLMEKARQLSILCESSVALIISATGRLYSFSSG   60
SEQ ID NO:948     1  MGRRRVEIKRIENKSSRQVTFCKRRNGLMEKARQLSILCGSSVALFIVSSTGKLYNSSSG   60
                     ***. ..***************.***  *.****.*******.*  ..* .* .**

SEQ ID NO:1875   61  DNLVKILDRYGKQHADDLKALNYGSHYELLELVDSKLVGSNVKNVSIDALVQL        120
SEQ ID NO:1735   61  DDISKIIDRYEIQHADELRALDLEEKIQNYLPHKELLETVQSKLEEPNVDNVSVDSLISL  120
SEQ ID NO:568    61  DNMSKIIDRYEIHHADELEALDLAEKIRNYLPLKELLEIVQSKLEESNVDNASVDTLISL  120
SEQ ID NO:944    61  DNMSKIIDRYEIHHADELKALDLAEKIRNYLPHKELLEIVQSKLEESNVDNVSVDSLISM  120
SEQ ID NO:946    61  DSMAKILSRYELEQADDLKTLDLEEKTLNYLSHKELLETIQCKIEEAKSDNVSIDCLKSL  120
SEQ ID NO:948    61  DSMAKIISRFKIQQADDPETLDLEDKTQDYLSHKELLEIVQRKIEEAKGDNVSIESLISM  120
                     *    . .**   **   **     *      ****     *.       **  .

SEQ ID NO:1875  121  EEHLETALSVTRAKKTELMLKLVENLKEKEKMLKEENQ---VLASQMENNHHVGAEAE-M  176
SEQ ID NO:1735  121  EEQLETALSVSRARKAELMMEYIESLKEKEKLLREENQ---VLASQMGKNTLLATDDE-R  176
SEQ ID NO:568   121  EEQLETALSVTRARKTELMMGEVKSLQKTENLLREENQ---TLASQVGKKTFLVIEGD-R  176
SEQ ID NO:944   121  EEQLETALSVIRAKKTELMMEDMKSLQEREKLLIEENQ---ILASQVGKKTFLVIEGD-R  176
SEQ ID NO:946   121  EEQLKTALSVTRARKTELMMELVKTHQEKEKLLREENQSLTNQLIKMGKMKKSVEAEDAR  180
SEQ ID NO:948   121  BEQLKSALSVIRARKTELLMELVKNLQDKEKLLKEKNK---VLASEVGKLKKILETGDER  177
                     **.*  **** ** .**  *    *      *  *      **      .

SEQ ID NO:1875  177  EMS-PAGQISDNLPVTLPLLN   196
SEQ ID NO:1735  177  GMF-PGSSSGNKIPETLPLLN   196
SEQ ID NO:568   177  GMS-WENGSGNKVRETLPLLK   196
SEQ ID NO:944   177  GMS-RENGSGNKVPETLSLLK   196
SEQ ID NO:946   181  AMS-PESSSDNKPPETLLLLK   200
SEQ ID NO:948   178  AVMSPENSSGHSPPETLPLLK   198
                      .   *  * **  ** ** 
```

Alignment of Arabidopsis and Soy MAF Sequences

```
                              10                    20                        30
SEQ ID NO: 948   M G R R R V E I K R I E N K S S R Q V T F C K R R N G L M E
SEQ ID NO: 946   M G R R K V E I K R I E N K S S R Q V T F C K R R N G L M E
SEQ ID NO: 944   M G R R K V E I K R I E N K S S R Q V T F S K R R K G L I E
SEQ ID NO: 568   M G R K K V E I K R I E N K S S R Q V T F S K R R N G L I E
SEQ ID NO: 1735  M G R R K I E I K R I E N K S S R Q V T F S K R R N G L I D
SEQ ID NO: 1875  M G R K K L E I K R I E N K S S R Q V T F S K R R N G L I E
SEQ ID NO: 1971  M G K K K V E I K R I E N K S T R Q I T F S K R R N G L M K
SEQ ID NO: 1973  M G K K K L E I K R I E N K S N R Q I T F S K R R K G L M K
                 M G R . K V E I K R I E N K S S R Q V T F S K R R N G L . E 40                    50                        60
SEQ ID NO: 948   K A R Q L S I L C G S S V A L F I V S T G K L Y N S S S G
SEQ ID NO: 946   K A R Q L S I L C E S S V A L I I I S A T G R L Y S F S S G
SEQ ID NO: 944   K A R Q L S I L C E S S I A V V A V S G S G K L Y D S A S G
SEQ ID NO: 568   K A R Q L S I L C E S S I A V L V V S G S G K L Y K S A S G
SEQ ID NO: 1735  K A R Q L S I L C E S S V A V V V V S A S G K L Y D S S S G
SEQ ID NO: 1875  K A R Q L S V L C D A S V A L L V V S A S G K L Y S F S S G
SEQ ID NO: 1971  K A R E L S I L C D A K V A L L I F S S T G K L Y E L C N G
SEQ ID NO: 1973  K A R E L S I L C D A K L A L L I F S S T G K L Y E L C N G
                 K A R Q L S I L C . S S V A L . . V S . . G K L Y . S G 70                    80                        90
SEQ ID NO: 948   D S M A K I I S R F K I Q Q - - - A D D P E T L D L E D K T
SEQ ID NO: 946   D S M A K I L S R Y E L E Q - - - A D D L K T L D L E E K T
SEQ ID NO: 944   D N M S K I I D R Y E I H H - - - A D E L K A L D L A E K I
SEQ ID NO: 568   D N M S K I I D R Y E I H H - - - A D E L E A L D L A E K T
SEQ ID NO: 1735  D D I S K I I D R Y E I Q H - - - A D E L R A L D L A E K T
SEQ ID NO: 1875  D N L V K I L D R Y G K Q H - - - A D D L K A L D L E E K I
SEQ ID NO: 1971  D S L A E V V Q Q Y W D H L G A S G T D T K S Q E L C F E I
SEQ ID NO: 1973  D S L A E V V Q R Y W D N L G A S G T D T K G - - L R F E I
                 D . . K I . R Y . . .         A D D L K . . L D L . K 100                   110                       120
SEQ ID NO: 948   Q D Y L S H K E L L E I V Q R K I E E A K G D N V S I E S L
SEQ ID NO: 946   L N Y L S H K E L L E T I Q C K I E E A K S D N V S I D C L
SEQ ID NO: 944   R N Y L P H K E L L E I V Q S K L E E S N V D N V S V D S L
SEQ ID NO: 568   R N Y L P L K E L L E I V Q S K L E E S N V D N A S V D T L
SEQ ID NO: 1735  Q N Y L P H K E L L E T V Q S K L E E P N V D N V S V D S L
SEQ ID NO: 1875  L N Y G S H Y E L L E L V D S K L V G S N V K N V S I D A L
SEQ ID NO: 1971  A D I W S G S A F S Q M I K R H F G V S E L E H L S V S D L
SEQ ID NO: 1973  A D I W S D E A F S Q L V Q S H F G V S E L E H L S V T D L
                 N Y L S H K E L L E . V Q S K . E E S . D N V S V D . L
```

Figure 7A

```
                                       130                 140                 150
SEQ ID NO: 948    I S M E E Q L K S A L S V I R A R K T E L L M E L V K N L Q
SEQ ID NO: 946    K S L E E Q L K T A L S V T R A R K T E L M M E L V K T H Q
SEQ ID NO: 944    I S M E E Q L E T A L S V I R A K K T E L M M E D M K S L Q
SEQ ID NO: 568    I S L E E Q L E T A L S V T R A R K T E L M M G E V K S L Q
SEQ ID NO: 1735   I S L E E Q L E T A L S V S R A R K A E L M M E Y I E S L K
SEQ ID NO: 1875   V Q L E E H L E T A L S V T R A K K T E L M L K L V E N L K
SEQ ID NO: 1971   M E L E K L T H A A L S R I R S A K M R L M M E S V V N L K
SEQ ID NO: 1973   M E L E K L V H S A L S R I R S A K M R L M M E S G E N L K
                  . S L E E Q L   T A L S V   R A . K T E L M M E   V   . L .

160                 170                 180
SEQ ID NO: 948    D K E K L L K E K N K - - - V L A S E V G K L K K I L E T G
SEQ ID NO: 946    E K E K L L R E E N Q S L T N Q L I K M G K M K K S V E A E
SEQ ID NO: 944    E R E K L L I E E N Q - - - I L A S Q V G K K T F L V I E G
SEQ ID NO: 568    K T E N L L R E E N Q - - - T L A S Q V G K K T F L V I E G
SEQ ID NO: 1735   E K E K L L R E E N Q - - - V L A S Q M G K N T L L A T D D
SEQ ID NO: 1875   E K E K M L K E E N Q - - - V L A S Q M E N N H H V G A E A
SEQ ID NO: 1971   K K I E A L E K T N D - - - V - - - - - - - - - - - - - - N
SEQ ID NO: 1973   K K E H I L R N E G E - - - V W G K R M E G Q K R G G G G N
                  . K E K L L . E E N Q       V L A S . . G K       .       .

190                 200                 210
SEQ ID NO: 948    D E R A V M S P E N S S G H S P P E T L P L L K
SEQ ID NO: 946    D A R A M S - P E S S S D N K P P E T L L L L K
SEQ ID NO: 944    D - R G M S - R E N G S G N K V P E T L S L L K
SEQ ID NO: 568    D - R G M S - W E N G S G N K V R E T L P L L K
SEQ ID NO: 1735   E - R G M F - P G S S S G N K I P E T L P L L N
SEQ ID NO: 1875   E - M E M S - P A G Q I S D N L P V T L P L L N
SEQ ID NO: 1971   N V V T R S I D C D Q T D G V T H N L F P G L
SEQ ID NO: 1973   N V V T R F I D Y D Q T D R V T H N L L P G L
                  .   R   M S           S     .     P E T L P L L
```

Figure 7B

Table 14

| Polypeptide SEQ ID NO | Name | Gene ID | 1971 | 1973 | 1875 | 1735 | 568 | 944 | 946 | 948 |
|---|---|---|---|---|---|---|---|---|---|---|
| | | | SOY MADS1 | SOY MADS3 | FLC | MAF1 | MAF2 | MAF3 | MAF4 | MAF5 |
| | | | Soy1 | Soy3 | G1759 | G157 | G859 | G1842 | G1843 | G1844 |
| 1971 | SOY MADS1 | Soy1 | 100% (100%) | | | | | | | |
| 1973 | SOY MADS3 | Soy3 | 77% (83%) | 100% (100%) | | | | | | |
| 1875 | FLC | G1759 | 37% (53%) | 40% (58%) | 100% (100%) | | | | | |
| 1735 | MAF1 | G157 | 33% (53%) | 36% (56%) | 65% (79%) | 100% (100%) | | | | |
| 568 | MAF2 | G859 | 34% (52%) | 34% (53%) | 61% (74%) | 76% (85%) | 100% (100%) | | | |
| 944 | MAF3 | G1842 | 32% (43%) | 34% (56%) | 60% (75%) | 78% (87%) | 87% (90%) | 100% (100%) | | |
| 946 | MAF4 | G1843 | 35% (53%) | 36% (55%) | 57% (74%) | 65% (81%) | 64% (77%) | 64% (78%) | 100% (100%) | |
| 948 | MAF5 | G1844 | 36% (54%) | 36% (56%) | 53% (73%) | 63% (80%) | 63% (79%) | 65% (81%) | 71% (83%) | 100% (100%) |

Table 15. Flowering time of the maf2 mutant (a)

| Genotype | N | Days of cold treatment (b) | Photoperiod (hours) | Days to visible flower bud | Total leaf number (c) |
|---|---|---|---|---|---|
| Experiment 1 | | | | | |
| maf2 | 20 | 3 | 8 | 76-94 (81.1 +/- 2.7) | ND |
| wild type | 11 | 3 | 8 | 76-103 (89.8 +/- 5.7) | ND |
| maf2 | 24 | 3 | 12 | 28-42 (35.7 +/- 1.5) | 7-34 (23.1 +/- 2.5) |
| wild type | 23 | 3 | 12 | 20-46 (39.6 +/- 3.1) | 6-37 (27.6 +/- 3.5) |
| maf2 | 24 | 3 | 24 | 17-20 (18.1 +/- 0.3) | 10-13 (11.8 +/- 0.4) |
| wild type | 24 | 3 | 24 | 16-23 (20.0 +/- 0.7) | 9-16 (13.0 +/- 0.7) |
| Experiment 2 | | | | | |
| maf2 | 22 | 52 | 12 | 17-28 (19.8 +/- 1.2) | 7-12 (8.5 +/- 0.4) |
| maf2 | 24 | 3 | 12 | 25-35 (28.7 +/- 0.9) | 9-21 (16.0 +/- 1.7) |
| wild type | 33 | 52 | 12 | 15-33 (23.0 +/- 1.7) | 8-14 (10.2 +/- 0.5) |
| wild type | 36 | 3 | 12 | 22-43 (34.7 +/- 1.6) | 6-29 (21.5 +/- 1.7) |
| Experiment 3 | | | | | |
| maf2 | 24 | 10 | 12 | ND | 8-15 (11.1 +/- 0.7) |
| wild type | 24 | 10 | 12 | ND | 16-22 (19.0 +/- 0.8) |
| Experiment 4 | | | | | |
| maf2 | 12 | 3 | 12 | 21-43 (34.8 +/- 4.1) | ND |
| wild type | 12 | 3 | 12 | 34-48 (44.0 +/- 2.9) | ND |
| maf2 | 12 | 6 | 12 | 22-46 (33.3 +/- 5.9) | ND |
| wild type | 12 | 6 | 12 | 22-48 (39.9 +/- 6.1) | ND |
| maf2 | 12 | 10 | 12 | 19-32 (26.5 +/- 3.0) | ND |
| wild type | 12 | 10 | 12 | 26-48 (39.3 +/- 3.0) | ND |
| maf2 | 12 | 15 | 12 | 18-32 (24.2 +/- 2.4) | ND |
| wild type | 12 | 15 | 12 | 34-43 (38.5 +/- 1.9) | ND |
| maf2 | 12 | 21 | 12 | 16-21 (18.0 +/- 1.1) | 8-11 (8.5 +/- 0.6) |
| wild type | 12 | 21 | 12 | 33-43 (36.9 +/- 1.7) | ND |
| maf2 | 12 | 85 | 12 | 15-20 (18.3 +/- 0.9) | 7-9 (7.9 +/- 0.6) |
| wild type | 11 | 85 | 12 | 14-19 (16.4 +/- 1.3) | 7-9 (7.5 +/- 0.6) |

Notes:
(a) Range of values obtained followed by mean +/- Standard Error with 95% confidence limits attached (parentheses)
(b) Duration of cold treatment on imbibed seeds at 4 degrees C, before transfer to growth room
(c) Number of leaf primordia produced by primary shoot meristem before first flower.
N = number of plants in population
wild type = non-transformed Columbia plants
ND = Not determined Table 16. Flowering time of 35S:*MAF2-5* Stockholm and Columbia T1 lines (a)

| Genotype | Phenotype (b,c) | Penetrance | Days to visible flower bud | Total leaf number |
|---|---|---|---|---|
| Experiment 5 Columbia ecotype | | | | |
| Control (d) | wild-type | 43/43 | 17-25 (21.1 +/- 0.5) | 9-18 (14.3 +/- 0.7) |
| 35S:*MAF2* | early | 13/20 | 11-15 (12.8 +/- 0.7) | 5-8 (6.2 +/- 0.6) |
| | slightly early | 1/20 | 15-15 (15.0 +/- ND) | 9-9 (9.0 +/- ND) |
| | wild-type | 3/20 | 21-22 (21.3 +/- 1.4) | 10-13 (11.3 +/- 3.8) |
| | slightly late | 2/20 | 27-27 (27.0 +/- ND) | 14-16 (15.0 +/- ND) |
| | late | 1/20 | 27-27 (27.0 +/- ND) | 22-22 (22.0 +/- ND) |
| 35S:*MAF3* | early | 6/10 | 13-14 (13.5 +/- 0.6) | 7-8 (7.7 +/- 0.5) |
| | slightly early | 1/10 | 16-16 (16.0 +/- ND) | 9-9 (9.0 +/- ND) |
| | wild-type | 3/10 | 18-21 (19.3 +/- 3.8) | 10-14 (12.0 +/- 5.0) |
| 35S:*MAF4* (e) | early | 5/13 | 13-16 (15.2 +/- 1.6) | 6-7 (6.2 +/- 0.6) |
| | slightly early (f) | 3/13 | 18-27 (21.0 +/- 12.9) | 7-8 (7.3 +/- 1.4) |
| | wild-type | 2/13 | 23-25 (24.0 +/- ND) | 10-15 (12.5 +/- ND) |
| | slightly late (f) | 1/13 | 70-70 (70.0 +/- ND) | 15-15 (15.0 +/- ND) |
| | arrested growth (g) | 2/13 | ND | ND |
| 35S:*MAF5* | early | 5/10 | 14-15 (14.2 +/- 0.6) | 6-7 (6.2 +/- 0.6) |
| | wild-type | 5/10 | 17-25 (20.8 +/- 4.0) | 9-16 (12.6 +/- 3.8) |
| Experiment 6 Columbia ecotype | | | | |
| Control (h) | wild-type | 15/15 | 21-30 (25.3 +/- 1.3) | 9-15 (11.5 +/- 1.1) |
| 35S:*MAF2* | early | 5/19 | 15-20 (18.0 +/- 2.6) | 7-8 (7.4 +/- 0.7) |
| | slightly early | 2/19 | 22-23 (22.5 +/- ND) | 8-8 (8.0 +/- ND) |
| | wild-type | 10/19 | 22-28 (23.5 +/- 1.3) | 9-14 (11.1 +/- 1.0) |
| | late | 2/19 | 35-42 (38.5 +/- ND) | 26-29 (27.5 +/- ND) |
| 35S:*MAF3* | early | 5/8 | 16-20 (17.6 +/- 2.9) | 7-8 (7.4 +/- 0.7) |
| | slightly early | 2/8 | 17-17 (17.0 +/- ND) | 9-11 (10.0 +/- ND) |
| | wild-type | 1/8 | 21-21 (21.0 +/- ND) | 11-11 (11.0 +/- ND) |
| 35S:*MAF4* (e) | slightly early | 2/7 | 20-27 (23.5+/- ND) | 6-10 (8.0 +/- ND) |
| | wild-type | 5/7 | 24-30 (27.0 +/- 3.5) | 10-11 (10.3 +/- 0.8) |
| 35S:*MAF5* | early | 1/19 | 20-20 (20.0 +/- ND) | 8-8 (8.0 +/- ND) |
| | slightly early | 2/19 | 20-20 (20.0 +/- ND) | 11-13 (12.0 +/- ND) |
| | wild-type | 15/19 | 21-27 (23.9 +/- 0.9) | 9-15 (12.6 +/- 1.2) |
| | slightly late | 1/19 | 27-27 (27.0 +/- ND) | 18-18 (18.0 +/- ND) |
| Experiment 7 Stockholm ecotype | | | | |
| Control (i) | wild-type | 23/23 | 32-42 (37.6 +/- 1.0) | 30-42 (36.1 +/- 1.4) |
| 35S:*MAF2* | early | 1/13 | 31-31 (31.0 +/- ND) | 17-17 (17.0 +/- ND) |
| | slightly early | 5/13 | 32-34 (32.8 +/- 1.0) | 17-27 (21.4 +/- 5.4) |
| | wild-type | 6/13 | 36-40 (37.5 +/- 1.6) | 30-38 (33.3 +/- 2.8) |
| | late | 1/13 | 55-55 (55 +/- ND) | 44-44 (44 +/- ND) |
| 35S:*MAF3* | early | 5/20 | 21-31 (26.8 +/- 5.2) | 12-25 (17.6 +/- 7.4) |
| | slightly early | 5/20 | 32-36 (33.8 +/- 2.0) | 23-29 (26.6 +/- 3.1) |
| | wild-type | 7/20 | 34-42 (38.9 +/- 2.7) | 30-41 (36.6 +/- 3.5) |
| | slightly late | 3/20 | 39-43 (41.7 +/- 5.7) | 31-43 (36.0 +/- 15.5) |
| 35S:*MAF4* (e) | slightly early | 1/12 | 41-41 (41.0 +/- ND) | 29-29 (29.0 +/- ND) |
| | wild-type | 2/12 | 38-41 (39.5 +/- ND) | 33-33 (33.0 +/- ND) |
| | slightly late | 7/12 | 42-45 (43.9 +/- 1.1) | 35-43 (36.8 +/- 5.1) |
| | arrested growth (g) | 2/12 | ND | ND |
| 35S:*MAF5* | wild-type | 16/18 | 35-41 (37.9 +/- 0.9) | 32-41 (36.8 +/- 1.7) |
| | slightly late | 2/18 | 38-42 (40.0 +/- ND) | 43-44 (43.5 +/- ND) |

Notes:
Except where otherwise indicated, transgenic plants were selected MS agar plates containing kanamycin at 50mg/l
(a) Range of values obtained followed by mean +/- Standard Error with 95% confidence limits attached (parentheses) are shown for each class.
(b) Plants classified as early or late, flowered outside the wild type range in terms of both days to first open flower and total leaf number.
(c) Plants classified as slightly early or slightly late flowered outside wild type range in terms of either days to first open flower or total leaf number.
(d) Control is wild type Columbia.
(e) The majority of 35S:*MAF4* lines were small and stunted, and some showed (f) a slow rate of growth
(g) These plants senesced and died at the seedling stage without producing flower buds.
(h) Controls for experiment 6 were Columbia T2 transformants from a mix of lines, containing the 'empty' transformation vector, and selected on kanamycin plates.
(i) Controls for experiment 7 were Stockholm T1 (primary) transformants containing the 'empty' transformation vector.
Penetrance = number of plants out of population showing phenotype
Plants grown under 24 hours light at 20-25 degrees Celsius in all three experiments.
ND = not determined Table 17. Flowering time phenotypes of 35S:*MAF*2-5 T2 Columbia and Landsberg lines (a)

| Genotype | Line | N | T1 phenotype | T2 phenotype | Days of cold treatment (b) | Photoperiod (hours) | Days to visible flower bud | Total leaf number |
|---|---|---|---|---|---|---|---|---|
| Experiment 8 (Columbia) | | | | | | | | |
| 35S:*MAF2* | T2-16 | 13 | late | late | 3 | 24 | 25-39 (32.5 +/- 2.1) | 17-35 (25.9 +/- 3.5) |
| 35S:*MAF2* | T2-24 | 16 | late | late | 3 | 24 | 32-38 (34.9 +/- 1.2) | 25-34 (29.6 +/- 1.4) |
| 35S:*MAF2* | T2-32 | 20 | early | wild-type | 3 | 24 | 21-23 (21.5 +/- 0.4) | 10-18 (14.4 +/- 0.9) |
| 35S:*MAF2* | T2-36 | 15 | early | wild-type | 3 | 24 | 18-21 (20.8 +/- 0.4) | 9-14 (12.1 +/- 0.9) |
| 35S:*MAF3* | T2-2 | 17 | early | early | 3 | 24 | 16-20 (17.4 +/- 0.7) | 8-14 (9.8 +/- 0.8) |
| 35S:*MAF3* | T2-9 | 16 | early | early | 3 | 24 | 17-21 (19.1 +/- 0.7) | 8-15 (11.5 +/- 1.0) |
| 35S:*MAF4* (c) | T2-4 | 11 | slightly early | ND | 3 | 24 | 26-32 (29.0 +/- 1.4) | 11-16 (13.4 +/- 1.2) |
| 35S:*MAF4* (d) | T2-11 | 9 | slightly early | wild-type | 3 | 24 | 17-25 (22.1 +/- 1.7) | 7-15 (10.7 +/- 2.5) |
| 35S:*MAF5* | T2-10 | 19 | early | wild-type | 3 | 24 | 20-23 (21.6 +/- 0.5) | 13-17 (14.7 +/- 0.6) |
| 35S:*MAF5* | T2-25 | 16 | early | wild-type | 3 | 24 | 21-25 (22.0 +/- 0.7) | 11-18 (13.6 +/- 0.9) |
| 35S:*MAF5* | T2-7 | 14 | early | wild-type | 3 | 24 | 21-21 (21.0 +/- 0) | 11-16 (13.4 +/- 1.0) |
| Control (e) | NA | 47 | wild-type | wild-type | 3 | 24 | 18-23 (21.0 +/- 0.3) | 10-18 (13.8 +/- 0.6) |
| 35S:*MAF2* | T2-16 | 10 | late | late | 3 | 12 | 59-68 (63.8 +/- 3.0) | 38-49 (44.0 +/- 2.4) |
| 35S:*MAF2* | T2-24 | 17 | late | late | 3 | 12 | 52-66 (59.4 +/- 2.0) | 31-54 (46.2 +/- 3.3) |
| 35S:*MAF2* | T2-32 | 17 | early | slightly early | 3 | 12 | 28-40 (34.3 +/- 1.9) | 11-24 (17.0 +/- 1.9) |
| 35S:*MAF2* | T2-36 | 14 | early | slightly early | 3 | 12 | 22-46 (33.3 +/- 3.8) | 7-23 (14.3 +/- 3.1) |
| 35S:*MAF3* | T2-2 | 14 | early | early | 3 | 12 | 21-39 (27.1 +/- 2.7) | 7-18 (10.7 +/- 1.8) |
| 35S:*MAF3* | T2-9 | 18 | early | early | 3 | 12 | 21-42 (31.1 +/- 3.2) | 7-24 (13.7 +/- 2.1) |
| 35S:*MAF3* | T2-10 | 19 | early | slightly early | 3 | 12 | 28-42 (35.5 +/- 1.9) | 10-29 (17.0 +/- 2.1) |
| 35S:*MAF4* (c) | T2-4 | 20 | slightly early | ND | 3 | 12 | ND | ND |
| 35S:*MAF4* (d) | T2-11 | 8 | slightly early | ND | 3 | 12 | 22-49 (30.3 +/- 10.5) | 7-30 (21.0 +/- 7.3) |
| 35S:*MAF5* | T2-10 | 17 | early | wild-type | 3 | 12 | 27-45 (39.2 +/- 2.4) | 16-38 (24.3 +/- 2.9) |
| 35S:*MAF5* | T2-25 | 13 | early | wild-type | 3 | 12 | 23-45 (35.8 +/- 5.0) | 9-28 (20.3 +/- 3.6) |
| 35S:*MAF5* | T2-7 | 7 | early | wild-type | 3 | 12 | 30-40 (34.1 +/- 4.2) | 11-27 (16.9 +/- 5.4) |
| Control (e) | NA | 35 | wild-type | wild-type | 3 | 12 | 21-49 (38.5 +/- 2.3) | 8-32 (21.5 +/- 2.2) |
| Experiment 9 (Columbia) | | | | | | | | |
| 35S:*MAF2* T2 | 16 | 16 | late | late | 56 | 24 | 29-37 (32.8 +/- 1.2) | 21-31 (25.8 +/- 1.3) |
| 35S:*MAF2* T2 | 16 | 16 | late | late | 3 | 24 | 29-38 (32.4 +/- 1.3) | 24-33 (28.9 +/- 1.3) |
| control (e) | NA | 16 | NA | NA | 56 | 24 | 14-17 (15.1 +/- 0.6) | 7-11 (8.9 +/- 0.5) |
| control (e) | NA | 16 | NA | NA | 3 | 24 | 21-22 (21.1 +/- 0.2) | 13-18 (15.1 +/- 1.0) |
| control (f) | NA | 16 | NA | NA | 56 | 24 | 14-18 (14.9 +/- 0.9) | 7-10 (8.3 +/- 0.6) |
| control (f) | NA | 16 | NA | NA | 3 | 24 | 20-23 (21.2 +/- 0.7) | 13-21 (16.3 +/- 1.7) |
| Experiment 10 (Columbia) | | | | | | | | |
| 35S:*MAF2* T2 (g) | 16 | 10 | late | late | 76 | 12 | ND | 35-48 (40.0 +/- 3.3) |
| 35S:*MAF2* T2 (g) | 16 | 10 | late | late | 3 | 12 | ND | 38-49 (44.0 +/- 2.4) |
| control (f) | NA | 10 | NA | NA | 76 | 12 | 16-21 (18.5 +/- 1.8) | 6-8 (6.9 +/- 0.6) |
| control (f) | NA | 24 | NA | NA | 3 | 12 | 24-38 (30.2 +/- 1.9) | 10-22 (16.2 +/- 1.4) |
| Experiment 11 (Landsberg) | | | | | | | | |
| 35S:*MAF2* T2 | 207 | 16 | ND | late | 5 | 24 | 20-24 (21.6 +/- 0.7) | ND |
| 35S:*MAF2* T2 | 210 | 16 | ND | late | 5 | 24 | 27-36 (29.9 +/- 1.2) | ND |
| 35S:*MAF3* T2 | 102 | 16 | ND | slightly late | 5 | 24 | 17-24 (19.7 +/- 1.2) | ND |
| 35S:*MAF3* T2 | 105 | 16 | ND | wild-type | 5 | 24 | 17-21 (18.4 +/- 0.7) | ND |
| 35S:*MAF3* T2 | 115 | 16 | ND | late | 5 | 24 | 20-25 (22.6 +/- 1.0) | ND |
| 35S:*MAF3* T2 | 116 | 16 | ND | late | 5 | 24 | 20-22 (21.1 +/- 0.4) | ND |
| 35S:*MAF4* T2 (d) | 3 | 8 | ND | late | 5 | 24 | 22-42 (30.1 +/- 4.8) | ND |
| 35S:*MAF4* T2 (d) | 101 | 18 | ND | late | 5 | 24 | 20-28 (23.3 +/- 0.9) | ND |
| 35S:*MAF4* T2 (d) | 202 | 14 | ND | slightly late | 5 | 24 | 17-26 (19.8 +/- 1.6) | ND |
| 35S:*MAF4* T2 (d) | 204 | 12 | ND | late | 5 | 24 | 23-28 (25.2 +/- 1.3) | ND |
| 35S:*MAF5* T2 | 101 | 5 | ND | slightly late | 5 | 24 | 18-22 (20.2 +/- 1.8) | ND |
| 35S:*MAF5* T2 | 103 | 16 | ND | slightly late | 5 | 24 | 18-20 (19.3 +/- 0.5) | ND |
| 35S:*MAF5* T2 | 203 | 16 | ND | slightly late | 5 | 24 | 17-20 (19.6 +/- 0.5) | ND |
| 35S:*MAF5* T2 | 204 | 14 | ND | slightly late | 5 | 24 | 20-21 (20.4 +/- 0.3) | ND |
| control (f) | NA | 103 | NA | wild-type | 5 | 24 | 16-20 (18.4 +/- 0.7) | ND |
| 35S:*MAF2* T2 | 207 | 17 | ND | late | 5 | 12 | 21-49 (37.9 +/- 4.8) | ND |
| 35S:*MAF2* T2 | 210 | 13 | ND | late | 5 | 12 | 34-80 (72.6 +/- 7.7) | ND |
| 35S:*MAF3* T2 | 102 | 14 | ND | slightly late | 5 | 12 | 21-30 (24.2 +/- 1.6) | ND |
| 35S:*MAF3* T2 | 105 | 16 | ND | slightly late | 5 | 12 | 20-37 (25.1 +/- 2.4) | ND |
| 35S:*MAF3* T2 | 115 | 16 | ND | late | 5 | 12 | 56-80 (66.5 +/- 4.2) | ND |
| 35S:*MAF3* T2 | 116 | 14 | ND | late | 5 | 12 | 49-65 (57.2 +/- 4.1) | ND |
| 35S:*MAF4* T2 (d) | 3 | 9 | ND | late | 5 | 12 | 49-70 (59.4 +/- 5.7) | ND |
| 35S:*MAF4* T2 (d) | 101 | 11 | ND | late | 5 | 12 | 42-69 (56.6 +/- 5.4) | ND |
| 35S:*MAF4* T2 (d) | 202 | 8 | ND | late | 5 | 12 | 24-41 (33.4 +/- 5.2) | ND |
| 35S:*MAF4* T2 (d) | 204 | 14 | ND | late | 5 | 12 | 26-60 (47.2 +/- 6.2) | ND |
| 35S:*MAF5* T2 | 101 | 9 | ND | slightly late | 5 | 12 | 21-35 (24.2 +/- 3.7) | ND |
| 35S:*MAF5* T2 | 103 | 16 | ND | slightly late | 5 | 12 | 18-29 (24.4 +/- 1.9) | ND |
| 35S:*MAF5* T2 | 203 | 18 | ND | late | 5 | 12 | 21-31 (25.5 +/- 1.7) | ND |
| 35S:*MAF5* T2 | 204 | 10 | ND | late | 5 | 12 | 29-41 (36.6 +/- 3.3) | ND |
| control (f) | NA | 93 | NA | wild-type | 5 | 12 | 18-34 (22.9 +/- 0.6) | ND |

Notes:
Except where otherwise indicated, transgenic plants were selected MS agar plates containing kanamycin at 50mg/l
(a) Range of values obtained followed by mean +/- Standard Error with 95% confidence limits attached (brackets)
(b) Duration of cold treatment on imbibed seeds at 4 degrees C, before transfer to growth room
(c) Plants were small, produced leaves at a slower rate than wild-type, and showed premature leaf senescence.
(d) Plants were distinctly small compared to wild-type.
(e) Controls were Columbia T2 transformants from a mix of lines, containing the 'empty' transformation vector, selected on kanamycin plates.
(f) Wild type, not selected on kanamycin
(g) Not selected on kanamycin
NA = Not applicable
ND = Not determined
N = number of plants in population

POLYNUCLEOTIDES AND POLYPEPTIDES IN PLANTS

RELATIONSHIP TO COPENDING APPLICATIONS

This application is a continuation-in-part of application Ser. No. 10/295,403, filed Nov. 15, 2002 (abandoned), which is a divisional of application Ser. No. 09/394,519, filed Sep. 13, 1999 (abandoned), which claims the benefit of Application No. 60/101,349, filed Sep. 22, 1998 (expired), which also claims the benefit of Application No. 60/103,312, filed Oct. 6, 1998 (expired), which also claims the benefit of Application No. 60/108,734, filed Nov. 17, 1998 (expired), which also claims the benefit of Application No. 60/113,409, filed Dec. 22, 1998 (expired). This application is a continuation-in-part of application Ser. No. 09/489,376, filed Jan. 21, 2000 (abandoned), which claims the benefit of Application No. 60/116,841, filed Jan. 22, 1999 (expired). This application is a continuation-in-part of application Ser. No. 10/302,267, filed Nov. 22, 2002 (pending), which is a divisional of application Ser. No. 09/506,720, filed Feb. 17, 2000 (abandoned), which claims the benefit of Application No. 60/120,880, filed Feb. 18, 1999 (expired), which also claims the benefit of Application No. 60/121,037, filed Feb. 22, 1999 (expired), which also claims the benefit of Application No. 60/124,278, filed Mar. 11, 1999 (expired), which also claims the benefit of Application No. 60/129,450, filed Apr. 15, 1999 (expired), which also claims the benefit of Application No. 60/135,134, filed May 20, 1999 (expired), which also claims the benefit of Application No. 60/144,153, filed Jul. 15, 1999 (expired), which also claims the benefit of Application No. 60/161,143, filed Oct. 22, 1999 (expired), which also claims the benefit of Application No. 60/162,656, filed Nov. 1, 1999 (expired). This application is a continuation-in-part of application Ser. No. 10/286,264, filed Nov. 1, 2002 (pending), which is a divisional of application Ser. No. 09/533,030, filed Mar. 22, 2000 (abandoned), which claims the benefit of Application No. 60/125,814, filed on Mar. 23, 1999. This application is a continuation-in-part of application Ser. No. 10/278,173, filed Oct. 21, 2002 (pending), which is a divisional of application Ser. No. 09/533,392, filed Mar. 22, 2000 (abandoned), which claims the benefit of Application No. 60/125,814, filed on Mar. 23, 1999 (expired). This application is a continuation-in-part of application Ser. No. 09/533,029, filed on Mar. 22, 2000 (issued, U.S. Pat. No. 6,664,446), which claims the benefit of Application No. 60/125,814, filed Mar. 23, 1999 (expired). This application is a continuation-in-part of application Ser. No. 10/278,536, filed Oct. 22, 2002 (pending), which is a divisional of application Ser. No. 09/532,591, filed Mar. 22, 2000 (abandoned), which claims the benefit of Application No. 60/125,814, filed on Mar. 23, 1999 (expired). This application is a continuation-in-part of application Ser. No. 10/290,627, filed Nov. 7, 2002 (abandoned), which is a divisional of application Ser. No. 09/533,648, filed Mar. 22, 2000 (abandoned), which claims the benefit of Application No. 60/125,814, filed Mar. 23, 1999 (expired). This application is a continuation-in-part of 09/958,131, filed Jan. 30, 2002 (issued. U.S. Pat. No. 6,946,586), which is a 371 National Stage Application of International Application No. PCT/US00/09448, filed Apr. 6, 2000, which claims the benefit of Application No. 60/128,153, filed Apr. 7, 1999 (expired). This application is a continuation-in-part of application Ser. No. 09/713,994, filed Nov. 16, 2000 (pending), which claims the benefit of Application No. 60/166,228, filed Nov. 17, 1999 (expired), which also claims the benefit of Application No. 60/197,899, filed Apr. 17, 2000 (expired), which also claims the benefit of Application No. 60/227,439, filed Aug. 22, 2000 (expired). This application is a continuation-in-part of application Ser. No. 09/819,142, filed Mar. 27, 2001 (abandoned). This application is a continuation-in-part of application Ser. No. 09/934, 455, filed Aug. 22, 2001 (abandoned); and, application Ser. No. 09/934,455 is a continuation-in-part of application Ser. No. 09/713,994, filed Nov. 16, 2000 (pending), and a continuation-in-part of application Ser. No. 09/837,944, filed Apr. 18, 2001 (abandoned); and, application Ser. No. 09/934,455 claims the benefit of Application No. 60/227, 439, filed Aug. 22, 2000 (expired). This application is a continuation-in-part of application Ser. No. 10/225,068, filed Aug. 9, 2002 (pending), which claims the benefit of application Ser. No. 60/310,847, filed Aug. 9, 2001, which also claims the benefit of Application No. 60/336,049, filed Nov. 19, 2001 (expired), which also claims the benefit of Application No. 60/338,692, filed Dec. 11, 2001 (expired). Application Ser. No. 10/225,068 is also a continuation-in-part of application Ser. No. 09/837,944, filed Apr. 18, 2001 (abandoned), and also a continuation-in-part of application Ser. No. 10/171,468, filed Jun. 14, 2002 (abandoned). This application is a continuation-in-part of application Ser. No. 10/225,066, filed Aug. 9, 2002 (pending), which claims the benefit of Application No. 60/310,847, filed Aug. 9, 2001, which also claims the benefit of Application No. 60/336,049, filed Nov. 19, 2001 (expired), which also claims the benefit of Application No. 60/338,692, filed Dec. 11, 2001 (expired), application Ser. No. 10/225,066 is also a continuation-in-part of application Ser. No. 09/837,944, filed Apr. 18, 2001 (abandoned), and also a continuation-in-part of application Ser. No. 10/171,468, filed Jun. 14, 2002 (abandoned). This application is a continuation-in-part of application Ser. No. 10/225,067, filed Aug. 9, 2002 (pending), which claims the benefit of Application No. 60/310,847, filed Aug. 9, 2001, which also claims the benefit of Application No. 60/336,049, filed Nov. 19, 2001 (expired), which also claims the benefit of Application No. 60/338,692, filed Dec. 11, 2001 (expired). Application Ser. No. 10/225,067 is also a continuation-in-part of application Ser. No. 09/837,944, filed Apr. 18, 2001 (abandoned), and also a continuation-in-part of application Ser. No. 10/171,468, filed Jun. 14, 2002 (abandoned). This application is a continuation-in-part of application Ser. No. 10/374,780, filed Feb. 25, 2003 (pending). This application claims the benefit of Application No. 60/434,166, filed Dec. 17, 2002 (expired). The contents of application Ser. Nos. 09/394,519, 09/489,376, 09/506, 720, 09/533,030, 09/533,392, 09/533,029, 09/532,591, 09/533,648, 09/958,131, PCT/US00/09448, 09/713,994, 09/819,142, 09/837,944, 60/310,847, 60/336,049, 60/338, 692, 10/171,468, 10/225,066, 10/225,067, 10/225,068, 60/434,166, and 10/374,780 are hereby incorporated by reference in their entirety.

The claimed invention, in the field of functional genomics and the characterization of plant genes for the improvement of plants, was made by or on behalf of Mendel Biotechnology, Inc. and Monsanto Corporation as a result of activities undertaken within the scope of a joint research agreement, said agreement having been in effect on or before the date the claimed invention was made.

TECHNICAL FIELD

This invention relates to the field of plant biology. More particularly, the present invention pertains to compositions and methods for phenotypically modifying a plant.

BACKGROUND OF THE INVENTION

A plant's traits, such as its biochemical, developmental, or phenotypic characteristics, may be controlled through a number of cellular processes. One important way to manipulate that control is through transcription factors—proteins that influence the expression of a particular gene or sets of genes. Transformed and transgenic plants that comprise cells having altered levels of at least one selected transcription factor, for example, possess advantageous or desirable traits. Strategies for manipulating traits by altering a plant cell's transcription factor content can therefore result in plants and crops with new and/or improved commercially valuable properties.

Transcription factors can modulate gene expression, either increasing or decreasing (inducing or repressing) the rate of transcription. This modulation results in differential levels of gene expression at various developmental stages, in different tissues and cell types, and in response to different exogenous (e.g., environmental) and endogenous stimuli throughout the life cycle of the organism.

Because transcription factors are key controlling elements of biological pathways, altering the expression levels of one or more transcription factors can change entire biological pathways in an organism. For example, manipulation of the levels of selected transcription factors may result in increased expression of economically useful proteins or biomolecules in plants or improvement in other agriculturally relevant characteristics. Conversely, blocked or reduced expression of a transcription factor may reduce biosynthesis of unwanted compounds or remove an undesirable trait. Therefore, manipulating transcription factor levels in a plant offers tremendous potential in agricultural biotechnology for modifying a plant's traits. A number of the agriculturally relevant characteristics of plants, and desirable traits that may be imbued by modified transcription factor gene expression, are listed below.

Useful Plant Traits

Category: Abiotic Stress; Desired Trait: Chilling Tolerance

The term "chilling sensitivity" has been used to describe many types of physiological damage produced at low, but above freezing, temperatures. Most crops of tropical origins such as soybean, rice, maize and cotton are easily damaged by chilling. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. For example, photoinhibition of photosynthesis (disruption of photosynthesis due to high light intensities) often occurs under clear atmospheric conditions subsequent to cold late summer/autumn nights. By some estimates, chilling accounts for monetary losses in the United States (US) second only to drought and flooding. For example, chilling may lead to yield losses and lower product quality through the delayed ripening of maize. Another consequence of poor growth is the rather poor ground cover of maize fields in spring, often resulting in soil erosion, increased occurrence of weeds, and reduced uptake of nutrients. A retarded uptake of mineral nitrogen could also lead to increased losses of nitrate into the ground water.

Category: Abiotic Stress; Desired Trait: Freezing Tolerance.

Freezing is a major environmental stress that limits where crops can be grown and that reduces yields considerably, depending on the weather in a particular growing season. In addition to exceptionally stressful years that cause measurable losses of billions of dollars, less extreme stress almost certainly causes smaller yield reductions over larger areas to produce yield reductions of similar dollar value every year. For instance, in the US, the 1995 early fall frosts are estimated to have caused losses of over one billion dollars to corn and soybeans. The spring of 1998 saw an estimated $200 M of damages to Georgia alone, in the peach, blueberry and strawberry industries. The occasional freezes in Florida have shifted the citrus belt further south due to $100 M or more losses. California sustained $650 M of damage in 1998 to the citrus crop due to a winter freeze. In addition, certain crops such as Eucalyptus, which has the very favorable properties of rapid growth and good wood quality for pulping, are not able to grow in the southeastern states due to occasional freezes.

Inherent winter hardiness of the crop determines in which agricultural areas it can survive the winter. For example, for wheat, the northern central portion of the US has winters that are too cold for good winter wheat crops. Approximately 20% of the US wheat crop is spring wheat, with a market value of $2 billion. Areas growing spring wheat could benefit by growing winter wheat that had increased winter hardiness. Assuming a 25% yield increase when growing winter wheat, this would create $500 M of increased value. Additionally, the existing winter wheat is severely stressed by freezing conditions and should have improved yields with increased tolerance to these stresses. An estimate of the yield benefit of these traits is 10% of the $4.4 billion winter wheat crop in the US or $444 M of yield increase, as well as better survival in extreme freezing conditions that occur periodically.

Thus plants more resistant to freezing, both midwinter freezing and sudden freezes, would protect a farmers' investment, improve yield and quality, and allow some geographies to grow more profitable and productive crops. Additionally, winter crops such as canola, wheat and barley have 25% to 50% yield increases relative to spring planted varieties of the same crops. This yield increase is due to the "head start" the fall planted crop has over the spring planted crop and its reaching maturity earlier while the temperatures, soil moisture and lack of pathogens provide more favorable conditions.

Category: Abiotic Stress; Desired Trait: Salt Tolerance.

One in five hectares of irrigated land is damaged by salt, an important historical factor in the decline of ancient agrarian societies. This condition is only expected to worsen, further reducing the availability of arable land and crop production, since none of the top five food crops—wheat, corn, rice, potatoes, and soybean—can tolerate excessive salt.

Detrimental effects of salt on plants are a consequence of both water deficit resulting in osmotic stress (similar to drought stress) and the effects of excess sodium ions on critical biochemical processes. As with freezing and drought, high saline causes water deficit; the presence of high salt makes it difficult for plant roots to extract water from their environment (Buchanan et al. (2000) in *Biochemistry and Molecular Biology of Plants*, American Society of Plant Physiologists, Rockville, Md.). Soil salinity is thus one of the more important variables that determines where a plant may thrive. In many parts of the world, sizable land areas are uncultivable due to naturally high soil salinity. To compound the problem, salination of soils that are used for agricultural production is a significant and increasing problem in regions that rely heavily on agriculture. The latter is compounded by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. Thus, germination normally takes place at a salt concentration much higher than the mean salt level in the whole soil profile.

Category: Abiotic Stress; Desired Trait: Drought Tolerance.

While much of the weather that we experience is brief and short-lived, drought is a more gradual phenomenon, slowly taking hold of an area and tightening its grip with time. In severe cases, drought can last for many years, and can have devastating effects on agriculture and water supplies. With burgeoning population and chronic shortage of available fresh water, drought is not only the number one weather related problem in agriculture, it also ranks as one of the major natural disasters of all time, causing not only economic damage, but also loss of human lives. For example, losses from the US drought of 1988 exceeded $40 billion, exceeding the losses caused by Hurricane Andrew in 1992, the Mississippi River floods of 1993, and the San Francisco earthquake in 1989. In some areas of the world, the effects of drought can be far more severe. In the Horn of Africa the 1984-1985 drought led to a famine that killed 750,000 people.

Problems for plants caused by low water availability include mechanical stresses caused by the withdrawal of cellular water. Drought also causes plants to become more susceptible to various diseases (Simpson (1981). "The Value of Physiological Knowledge of Water Stress in Plants", In *Water Stress on Plants*, (Simpson, G. M., ed.), Praeger, N.Y., pp. 235-265).

In addition to the many land regions of the world that are too arid for most if not all crop plants, overuse and over-utilization of available water is resulting in an increasing loss of agriculturally-usable land, a process which, in the extreme, results in desertification. The problem is further compounded by increasing salt accumulation in soils, as described above, which adds to the loss of available water in soils.

Category: Abiotic Stress; Desired Trait: Heat Tolerance.

Germination of many crops is very sensitive to temperature. A transcription factor that would enhance germination in hot conditions would be useful for crops that are planted late in the season or in hot climates.

Seedlings and mature plants that are exposed to excess heat may experience heat shock, which may arise in various organs, including leaves and particularly fruit, when transpiration is insufficient to overcome heat stress. Heat also damages cellular structures, including organelles and cytoskeleton, and impairs membrane function (Buchanan, supra).

Heat shock may result a decrease in overall protein synthesis, accompanied by expression of heat shock proteins. Heat shock proteins function as chaperones and are involved in refolding proteins denatured by heat.

Category: Abiotic Stress; Desired Trait: Tolerance to Low Nitrogen and Phosphorus.

The ability of all plants to remove nutrients from their environment is essential to survival. Thus, identification of genes that encode polypeptides with transcription factor activity may allow for the generation of transgenic plants that are better able to make use of available nutrients in nutrient-poor environments.

Among the most important macronutrients for plant growth that have the largest impact on crop yield are nitrogenous and phosphorus-containing compounds. Nitrogen- and phosphorus-containing fertilizers are used intensively in agriculture practices today. An increase in grain crop yields from 0.5 to 1.0 metric tons per hectare to 7 metric tons per hectare accompanied the use of commercial fixed nitrogen fertilizer in production farming (Vance (2001) *Plant Physiol.* 127: 390-397). Given current practices, in order to meet food production demands in years to come, considerable increases in the amount of nitrogen- and phosphorus-containing fertilizers will be required (Vance, supra).

Nitrogen is the most abundant element on earth yet it is one of the most limiting elements to plant growth due to its lack of availability in the soil. Plants obtain N from the soil from several sources including commercial fertilizers, manure and the mineralization of organic matter. The intensive use of N fertilizers in present agricultural practices is problematic, the energy intensive Haber-Bosch process makes N fertilizer and it is estimated that the US uses annually between 3-5% of the nation's natural gas for this process. In addition to the expense of N fertilizer production and the depletion of non-renewable resources, the use of N fertilizers has led to the eutrophication of freshwater ecosystems and the contamination of drinking water due to the runoff of excess fertilizer into ground water supplies.

Phosphorus is second only to N in its importance as a macronutrient for plant growth and to its impact on crop yield. Phosphorus (P) is extremely immobile and not readily available to roots in the soil and is therefore often growth limiting to plants. Inorganic phosphate (Pi) is a constituent of several important molecules required for energy transfer, metabolic regulation and protein activation (Marschner (1995) *Mineral Nutrition of Higher Plants*, 2nd ed., Academic Press, San Diego, Calif.). Plants have evolved several strategies to help cope with P and N deprivation that include metabolic as well as developmental adaptations. Most, if not all, of these strategies have components that are regulated at the level of transcription and therefore are amenable to manipulation by transcription factors. Metabolic adaptations include increasing the availability of P and N by increasing uptake from the soil though the induction of high affinity and low affinity transporters, and/or increasing its mobilization in the plant. Developmental adaptations include increases in primary and secondary roots, increases in root hair number and length, and associations with mycorrhizal fungi (Bates and Lynch (1996) *Plant Cell Environ.* 19: 529-538; Harrison (1999) *Annu. Rev. Plant Physiol. Plant Mol. Biol.* 50: 361-389).

Category: Biotic Stress; Desired Trait: Disease Resistance.

Disease management is a significant expense in crop production worldwide. According to EPA reports for 1996 and 1997, us farmers spend approximately $6 billion on fungicides annually. Despite this expenditure, according to a survey conducted by the food and agriculture organization, plant diseases still reduce worldwide crop productivity by 12% and in the United States alone, economic losses due to plant pathogens amounts to 9.1 billion dollars (FAO, 1993). Data from these reports and others demonstrate that despite the availability of chemical control only a small proportion of the losses due to disease can be prevented. Not only are fungicides and anti-bacterial treatments expensive to growers, but their widespread application poses both environmental and health risks. The use of plant biotechnology to engineer disease resistant crops has the potential to make a significant economic impact on agriculture and forestry industries in two ways: reducing the monetary and environmental expense of fungicide application and reducing both pre-harvest and post-harvest crop losses that occur now despite the use of costly disease management practices.

Fungal, bacterial, oomycete, viral, and nematode diseases of plants are ubiquitous and important problems, and often severely impact yield and quality of crop and other plants. A very few examples of diseases of plants include:

Powdery mildew, caused by the fungi *Erysiphe, Sphaerotheca, Phyllactinia, Microsphaera, Podosphaera* or *Uncinula*, in, for example, wheat, bean, cucurbit, lettuce, pea, grape, tree fruit crops, as well as roses, phlox, lilacs, grasses, and Euonymus;

*Fusarium*-caused diseases such as *Fusarium* wilt in cucurbits, *Fusarium* head blight in barley and wheat, wilt and crown and root rot in tomatoes;

Sudden oak death, caused by the oomycete *Phytophthora ramorum*; this disease was first detected in 1995 in California tan oaks. The disease has since killed more than 100,000 tan oaks, coast live oaks, black oaks, and Shreve's oaks in coastal regions of northern California, and more recently in southwestern Oregon (Roach (2001) *National Geographic News*, Dec. 6, 2001);

Black Sigatoka, a fungal disease caused by *Mycosphaerella* species that attacks banana foliage, is spreading throughout the regions of the world that are responsible for producing most of the world's banana crop;

*Eutypa* dieback, caused by *Eutypa lata*, affects a number of crop plants, including vine grape. *Eutypa* dieback delays shoot emergence, and causes chlorosis, stunting, and tattering of leaves;

Pierce's disease, caused by the bacterium *Xylella fastidiosa*, precludes growth of grapes in the southeastern United States, and threatens the profitable wine grape industry in northern California. The bacterium clogs the vasculature of the grapevines, resulting in foliar scorching followed by slow death of the vines. There is no known treatment for Pierce's disease;

Bacterial Spot caused by the bacterium *Xanthomonas campestris* causes serious disease problems on tomatoes and peppers. It is a significant problem in the Florida tomato industry because it spreads rapidly, especially in warm periods where there is wind-driven rain. Under these conditions, there are no adequate control measures;

Diseases caused by viruses of the family Geminiviridae are a growing agricultural problem worldwide. Geminiviruses have caused severe crop losses in tomato, cassava, and cotton. For instance, in the 1991-1992 growing season in Florida, geminiviruses caused $140 million in damages to the tomato crop (Moffat (1991) *Science* 286: 1835). Geminiviruses have the ability to recombine between strains to rapidly produce new virulent varieties. Therefore, there is a pressing need for broad-spectrum geminivirus control;

The soybean cyst nematode, *Heterodera glycines*, causes stunting and chlorosis of soybean plants, which results in yield losses or plant death from severe infestation. Annual losses in the United States have been estimated at $1.5 billion (University of Minnesota Extension Service).

The aforementioned pathogens represent a very small fraction of diverse species that seriously affect plant health and yield. For a more complete description of numerous plant diseases, see, for example, Vidhyasekaran (1997) *Fungal Pathogenesis in Plants and Crops: Molecular Biology and Host Defense Mechanisms*, Marcel Dekker, Monticello, N.Y.), or Agrios (1997) *Plant Pathology*, Academic Press, New York, N.Y.). Plants that are able to resist disease may produce significantly higher yields and improved food quality. It is thus of considerable importance to find genes that reduce or prevent disease.

Category: Light Response; Desired Trait: Reduced Shade Avoidance.

Shade avoidance describes the process in which plants grown in close proximity attempt to out-compete each other by increasing stem length at the expense of leaf, fruit and storage organ development. This is caused by the plant's response to far-red radiation reflected from leaves of neighboring plants, which is mediated by phytochrome photoreceptors. Close proximity to other plants, as is produced in high-density crop plantings, increases the relative proportion of far-red irradiation, and therefore induces the shade avoidance response. Shade avoidance adversely affects biomass and yield, particularly when leaves, fruits or other storage organs constitute the desired crop (see, for example, Smith (1982) *Annu. Rev. Plant Physiol.* 33: 481-518; Ballare et al. (1990) *Science* 247: 329-332; Smith (1995) *Annu. Dev. Plant Physiol. Mol. Biol.*, 46: 289-315; and Schmitt et al. (1995), *American Naturalist*, 146: 937-953). Alteration of the shade avoidance response in tobacco through alteration of phytochrome levels has been shown to produce an increase in harvest index (leaf biomass/total biomass) at high planting density, which would result in higher yield (Robson et al. (1996) *Nature Biotechnol.* 14: 995-998).

Category: Flowering Time; Desired Trait: Altered Flowering Time and Flowering Control.

Timing of flowering has a significant impact on production of agricultural products. For example, varieties with different flowering responses to environmental cues are necessary to adapt crops to different production regions or systems. Such a range of varieties have been developed for many crops, including wheat, corn, soybean, and strawberry. Improved methods for alteration of flowering time will facilitate the development of new, geographically adapted varieties.

Breeding programs for the development of new varieties can be limited by the seed-to-seed cycle. Thus, breeding new varieties of plants with multi-year cycles (such as biennials, e.g. carrot, or fruit trees, such as citrus) can be very slow. With respect to breeding programs, there would be a significant advantage in having commercially valuable plants that exhibit controllable and modified periods to flowering ("flowering times"). For example, accelerated flowering would shorten crop and tree breeding programs.

Improved flowering control allows more than one planting and harvest of a crop to be made within a single season. Early flowering would also improve the time to harvest plants in which the flower portion of the plant constitutes the product (e.g., broccoli, cauliflower, and other edible flowers). In addition, chemical control of flowering through induction or inhibition of flowering in plants could provide a significant advantage to growers by inducing more uniform fruit production (e.g., in strawberry)

A sizable number of plants for which the vegetative portion of the plant forms the valuable crop tend to "bolt" dramatically (e.g., spinach, onions, lettuce), after which biomass production declines and product quality diminishes (e.g., through flowering-triggered senescence of vegetative parts). Delay or prevention of flowering may also reduce or preclude dissemination of pollen from transgenic plants.

Category: Growth Rate; Desired Trait: Modified Growth Rate.

For almost all commercial crops, it is desirable to use plants that establish more quickly, since seedlings and young plants are particularly susceptible to stress conditions such as salinity or disease. Since many weeds may outgrow young crops or out-compete them for nutrients, it would also be desirable to determine means for allowing young crop plants to out compete weed species. Increasing seedling growth rate (emergence) contributes to seedling vigor and allows for crops to be planted earlier in the season with less concern for losses due to environmental factors. Early planting helps add days to the critical grain-filling period and increases yield.

Providing means to speed up or slow down plant growth would also be desirable to ornamental horticulture. If such means be provided, slow growing plants may exhibit prolonged pollen-producing or fruiting period, thus improving fertilization or extending harvesting season.

Category: Growth Rate; Desired Trait: Modified Senescence and Cell Death.

Premature senescence, triggered by various plant stresses, can limit production of both leaf biomass and seed yield. Transcription factor genes that suppress premature senescence or cell death in response to stresses can provide means for increasing yield. Delay of normal developmental senescence could enhance yield also, particularly for those plants for which the vegetative part of the plant represents the commercial product (e.g., spinach, lettuce).

Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. In an experimental setting, tobacco plants engineered to inhibit leaf senescence had a longer photosynthetic lifespan, and produced a 50% increase in dry weight and seed yield (Gan and Amasino (1995) Science 270: 1986-1988). Delayed flower senescence may generate plants that retain their blossoms longer and this may be of potential interest to the ornamental horticulture industry, and delayed foliar and fruit senescence could improve post-harvest shelf-life of produce.

Further, programmed cell death plays a role in other plant responses, including the resistance response to disease, and some symptoms of diseases, for example, as caused by necrotrophic pathogens such as *Botrytis cinerea* and *Sclerotinia sclerotiorum* (Dickman et al. *Proc. Natl. Acad. Sci.*, 98: 6957-6962). Localized senescence and/or cell death can be used by plants to contain the spread of harmful microorganisms. A specific localized cell death response, the "hypersensitive response", is a component of race-specific disease resistance mediated by plant resistance genes. The hypersensitive response is thought to help limit pathogen growth and to initiate a signal transduction pathway that leads to the induction of systemic plant defenses. Accelerated senescence may be a defense against obligate pathogens, such as powdery mildew, that rely on healthy plant tissue for nutrients. With regard to powdery mildew, *Botrytis cinerea* and *Sclerotinia sclerotiorum* and other pathogens, transcription factors that ameliorate cell death and/or damage may reduce the significant economic losses encountered, such as, for example, *Botrytis cinerea* in strawberry and grape.

Category: Growth Regulator; Desired Trait: Altered Sugar Sensing

Sugars are key regulatory molecules that affect diverse processes in higher plants including germination, growth, flowering, senescence, sugar metabolism and photosynthesis. Sucrose, for example, is the major transport form of photosynthate and its flux through cells has been shown to affect gene expression and alter storage compound accumulation in seeds (source-sink relationships). Glucose-specific hexose-sensing has also been described in plants and is implicated in cell division and repression of "famine" genes (photosynthetic or glyoxylate cycles).

Category: Morphology; Desired Trait: Altered Morphology

Trichomes are branched or unbranched epidermal outgrowths or hair structures on a plant. Trichomes produce a variety of secondary biochemicals such as diterpenes and waxes, the former being important as, for example, insect pheromones, and the latter as protectants against-desiccation and herbivorous pests. Since diterpenes also have commercial value as flavors, aromas, pesticides and cosmetics, and potential value as anti-tumor agents and inflammation-mediating substances, they have been both products and the target of considerable research. In most cases where the metabolic pathways are impossible to engineer, increasing trichome density or size on leaves may be the only way to increase plant productivity. Thus, it would be advantageous to discover trichome-affecting transcription factor genes for the purpose of increasing trichome density, size, or type to produce plants that are better protected from insects or that yield higher amounts of secondary metabolites.

The ability to manipulate wax composition, amount, or distribution could modify plant tolerance to drought and low humidity or resistance to insects, as well as plant appearance. In particular, a possible application for a transcription factor gene that reduces wax production in sunflower seed coats would be to reduce fouling during seed oil processing. Antisense or co-suppression of transcription factors involved in wax biosynthesis in a tissue specific manner can be used to specifically alter wax composition, amount, or distribution in those plants and crops from which wax is either a valuable attribute or product or an undesirable constituent of plants.

Other morphological characteristics that may be desirable in plants include those of an ornamental nature. These include changes in seed color, overall color, leaf and flower shape, leaf color, leaf size, or glossiness of leaves. Plants that produce dark leaves may have benefits for human health; flavonoids, for example, have been used to inhibit tumor growth, prevent of bone loss, and prevention lipid oxidation in animals and humans. Plants in which leaf size is increased would likely provide greater biomass, which would be particularly valuable for crops in which the vegetative portion of the plant constitutes the product. Plants with glossy leaves generally produce greater epidermal wax, which, if it could be augmented, resulted in a pleasing appearance for many ornamentals, help prevent desiccation, and resist herbivorous insects and disease-causing agents. Changes in plant or plant part coloration, brought about by modifying, for example, anthocyanin levels, would provide novel morphological features.

In many instances, the seeds of a plant constitute a valuable crop. These include, for example, the seeds of many legumes, nuts and grains. The discovery of means for producing larger seed would provide significant value by bringing about an increase in crop yield.

Plants with altered inflorescence, including, for example, larger flowers or distinctive floral configurations, may have high value in the ornamental horticulture industry.

Modifications to flower structure may have advantageous or deleterious effects on fertility, and could be used, for example, to decrease fertility by the absence, reduction or screening of reproductive components. This could be a desirable trait, as it could be exploited to prevent or minimize the escape of the pollen of genetically modified organisms into the environment.

Manipulation of inflorescence branching patterns may also be used to influence yield and offer the potential for more effective harvesting techniques. For example, a "self pruning" mutation of tomato results in a determinate growth pattern and facilitates mechanical harvesting (Pnueli et al. (2001) *Plant Cell* 13(12): 2687-2702).

Alterations of apical dominance or plant architecture could create new plant varieties. Dwarf plants may be of potential interest to the ornamental horticulture industry.

Category: Seed Biochemistry; Desired Trait: Altered Seed Oil

The composition of seeds, particularly with respect to seed oil quantity and/or composition, is very important for the nutritional value and production of various food and feed products. Desirable improvements to oils include enhanced heat stability, improved nutritional quality through, for example, reducing the number of calories in seed, increasing the number of calories in animal feeds, or altering the ratio of saturated to unsaturated lipids comprising the oils.

Category: Seed Biochemistry; Desired Trait: Altered Seed Protein

As with seed oils, seed protein content and composition is very important for the nutritional value and production of various food and feed products. Altered protein content or concentration in seeds may be used to provide nutritional benefits, and may also prolong storage capacity, increase seed pest or disease resistance, or modify germination rates. Altered amino acid composition of seeds, through altered protein composition, is also a desired objective for nutritional improvement.

Category: Seed Biochemistry; Desired Trait: Altered Prenyl Lipids.

Prenyl lipids, including the tocopherols, play a role in anchoring proteins in membranes or membranous organelles. Tocopherols have both anti-oxidant and vitamin E activity. Modified tocopherol composition of plants may thus be useful in improving membrane integrity and function, which may mitigate abiotic stresses such as heat stress. Increasing the anti-oxidant and vitamin content of plants through increased tocopherol content can provide useful human health benefits.

Category: Leaf Biochemistry; Desired Trait: Altered Glucosinolate Levels

Increases or decreases in specific glucosinolates or total glucosinolate content can be desirable depending upon the particular application. For example: (i) glucosinolates are undesirable components of the oilseeds used in animal feed, since they produce toxic effects; low-glucosinolate varieties of canola have been developed to combat this problem; (ii) some glucosinolates have anti-cancer activity; thus, increasing the levels or composition of these compounds can be of use in production of nutraceuticals; and (iii) glucosinolates form part of a plant's natural defense against insects; modification of glucosinolate composition or quantity could therefore afford increased protection from herbivores. Furthermore, tissue specific promoters can be used in edible crops to ensure that these compounds accumulate specifically in particular tissues, such as the epidermis, which are not taken for human consumption.

Category: Leaf Biochemistry; Desired Trait: Flavonoid Production.

Expression of transcription factors that increase flavonoid production in plants, including anthocyanins and condensed tannins, may be used to alter pigment production for horticultural purposes, and possibly to increase stress resistance. Flavonoids have antimicrobial activity and could be used to engineer pathogen resistance. Several flavonoid compounds have human health promoting effects such as inhibition of tumor growth, prevention of bone loss and prevention of lipid oxidation. Increased levels of condensed tannins in forage legumes would provide agronomic benefits in ruminants by preventing pasture bloat by collapsing protein foams within the rumen. For a review on the utilities of flavonoids and their derivatives, see Dixon et al. (1999) *Trends Plant Sci.* 4: 394-400.

Genetic and molecular studies on *Arabidopsis* have revealed that the timing of flowering is influenced by a large number of different genes (Martinez-Zapater and Somerville (1990) *Plant Physiol.* 92: 770-776; Koornneef et al. (1991) *Mol. Gen. Genet.* 229: 57-66; Martinez-Zapater et al. (1994) In Meyerowitz and Somerville, editors, *Arabidopsis*, Cold Spring Harbor Laboratory Press, Cold Spring Harbor, N.Y., pp 403-433; Koornneef et al. (1998a) *Annu. Rev. Plant Physiol. Plant Mol. Biol.* 49: 345-370; Koornneef et al. (1998b) *Genetics* 148: 885-892; Levy and Dean (1998) *Plant Cell* 10: 1973-1990; Simpson et al. (1999) *Annu. Rev. Cell Dev. Biol.* 15: 519-550; Simpson and Dean (2002) *Science* 296: 285-289; and Ratcliffe and Riechmann (2002) *Curr. Issues Mol. Biol.* 4: 77-91). Such loci ensure that the switch from vegetative to reproductive growth takes place at the most appropriate time with respect to a variety of abiotic and biotic variables. Amongst the most intensively studied effects are the responses to day length and prolonged exposure to low temperatures (vernalization).

*Arabidopsis* flowers rapidly in long day photoperiodic conditions of 16 hours or continuous light. However, under short day conditions of 8-10 hours of light, the plants display a much more extensive period of vegetative growth prior to flowering. Genes that control this day length response were originally identified via mutations that cause late flowering under long days, but which do not alter flowering time in short day conditions. Examples of photoperiod pathway genes include CONSTANS (CO), GIGANTEA (GI), FE, FD, and FHA. A second group of genes, which includes LUMINIDEPENDENS (LD), FCA, FVE, FY, and FPA, form an autonomous pathway that monitors the developmental state of the plant and is active under all photoperiodic conditions. Mutants for this second class of genes flower later than wild type controls irrespective of the day length (Koornneef et al. (1991); Martinez-Zapater et al. (1994); Koornneef et al. (1998a); and Koornneef et al. (1998b); all supra).

Importantly, mutants from the photoperiod and autonomous pathways also show a differential response to vernalization. Via a vernalization response, *Arabidopsis* ecotypes from northern latitudes, such as Stockholm, Sweden, are adapted to flower in the spring following exposure to cold winter conditions. This avoids flowering in the late summer when seed maturation might be curtailed by the onset of winter conditions. (See, for example, Vince-Prue (1975) In *Photoperiodism in plants* McGraw Hill, London, UK, pp 263-291; Napp-Zinn (1957) *Z. Indukt. Abstammungs Vererbungsl.* 88: 253-285; and Reeves and Coupland (2000) *Curr. Opin. Plant Biol.* 3: 37-42).

When such ecotypes are grown in the laboratory they flower late, but will flower much earlier if subjected to a cold period of 4-8 weeks while the seed is germinating. In a comparable manner, mutants from the autonomous pathway exhibit a very marked reduction in flowering time when subjected to vernalization. By contrast, mutants from the photoperiod pathway show only a minor response to cold treatments. Thus, vernalization can overcome the requirement for the autonomous pathway. (See Martinez-Zapater and Somerville (1990) supra; Koornneef et al. (1991) supra; Bagnall (1992) *Aust. J. Plant Physiol.* 19: 401-409; Burn et al. (1993) *Proc. Natl. Acad. Sci.* 90: 287-291; Lee et al. (1993) *Mol. Gen. Genet.* 237: 171-176; Clarke and Dean (1994) *Mol. Gen. Genet.* 242: 81-89; Chandler et al. (1996) *Plant J.* 10: 637-644; Koornneef et al. (1998b) supra.)

Genetic and molecular analyses have revealed that a MADS box protein, FLOWERING LOCUS C (FLC), is a major determinant of the vernalization response (Koornneef et al. (1994) supra; Lee et al. (1994) supra; Sanda and Amasino (1996) *Mol. Gen. Genet.* 251: 69-74; Michaels and Amasino (2000) *Plant Cell and Environment* 23: 1145-1153; Sheldon et al. (1999) *Plant Cell* 11: 445-458; Sheldon et al. (2002) *Plant Cell* 14: 2527-2537; and Rouse et al. (2002) *Plant J.* 29: 183-191). High levels of both FLC gene transcript and protein are present in mutants for the autonomous pathway and also in naturally late flowering northern ecotypes, which contain active alleles of a second locus, FRIGIDA (FR1; Burn et al. (1993) supra; Clarke and Dean (1994) supra; Johanson et al. (2000) *Science* 290: 344-347). By contrast, mutants from the photoperiod pathway, and backgrounds lacking an active FRI allele, show relatively low levels of FLC transcript. Furthermore, null alleles of flc completely suppress the late flowering caused by autonomous pathway mutations and active FRI alleles, but have no effect on the delayed flowering in photoperiod pathway mutants (Michaels and Amasino (2001) *Plant Cell* 13: 935-941). FLC gene expression therefore appears to be supported by FRI and strongly repressed by floral activators within the autonomous pathway.

During vernalization, FLC transcript and protein levels fall, and the plants become competent to flower (Michaels and Amasino (1999) *Plant Cell* 11: 949-956; Michaels and Amasino (2001) supra; Sheldon et al. (1999) supra; Sheldon et al. (2000) *Proc. Natl. Acad. Sci.* 97: 3753-3758; Johanson et al. (2000) supra; and Rouse et al. (2002) supra). Additionally, overexpression of FLC from a 35S CaMV promoter in the Landsberg ecotype (which lacks an active FRI allele) is sufficient to severely delay or prevent flowering, and renders the plants insensitive to vernalization (Michaels and Amasino (1999) supra; Sheldon et al. (1999) supra). These findings indicate that FLC is a potent floral repressor; it has now been shown that such repression is achieved by FLC inhibiting downstream genes that promote flowering, including SOCI and FT (Borner et al. (2000) *Plant J.* 24: 591-599; Lee et al. (2000) *Genes Dev.* 14: 2366-2376; Onouchi et al. (2000) *Plant Cell* 12: 885-900; Samach et al. (2000) *Science* 288: 1613-1616; Michaels and Amasino (2001) supra). Thus, promotion of flowering by either the autonomous pathway or vernalization involves repression of FLC and the subsequent de-repression of FLC targets. Recently, regions within the FLC gene and its promoter have been defined which are required for its vernalization induced repression (Sheldon et al. (2002) supra). However, the molecular signaling events that lead to a fall in FLC levels during vernalization are still unclear. The products of VERNALIZATION2 and VERNALIZATION1 maintain repression of FLC, once levels of FLC transcript have declined (Gendall et al. (2001) *Cell* 107: 525-535; Levy et al. (2002) *Science* 297: 243-246), but it is not yet known how the decline is initially achieved.

A number of additional questions, regarding the molecular basis of vernalization, still remain unanswered. First, it has been observed that null flc mutants are responsive to vernalization (Michaels and Amasino (2001) supra). Therefore vernalization can promote flowering by other mechanisms as well as via repression of FLC. In addition, vernalization is a quantitative response to prolonged periods of cold (Sheldon et al. (2000) supra); a mechanism must therefore exist to ensure that vernalization does not always occur in response to short periods of cold, lasting only a few days.

Vernalization may also be desirable in plants that do not normally have a vernalization response. Such plants in which expression of a polynucleotide creates a vernalization response therefore may be propagated and cultivated at different latitudes and/or altitudes compared with the native plant species that do not express a polynucleotide creating a vernalization response.

The present invention relates to methods and compositions for producing transgenic plants with modified traits, particularly traits that address the agricultural and food needs described in the above background information. These traits may provide significant value in that they allow the plant to thrive in hostile environments, where, for example, temperature, water and nutrient availability or salinity may limit or prevent growth of non-transgenic plants. The traits may also comprise desirable morphological alterations, larger or smaller size, disease and pest resistance, alterations in flowering time, light response, and others.

We have identified polynucleotides encoding transcription factors, developed numerous transgenic plants using these polynucleotides, and have analyzed the plants for a variety of important traits. In so doing, we have identified important polynucleotide and polypeptide sequences for producing commercially valuable plants and crops as well as the methods for making them and using them. Other aspects and embodiments of the invention are described below and can be derived from the teachings of this disclosure as a whole.

SUMMARY OF THE INVENTION

Transgenic plants and methods for producing transgenic plants are provided. The transgenic plants a recombinant polynucleotide having a polynucleotide sequence, or a complementary polynucleotide sequence thereof, that encodes a transcription factor.

The polynucleotide sequences that may encode the transcription factors are listed in the Sequence Listing and include any of SEQ ID NO: 2N-1, where N=1-480, SEQ ID NO: 2N, where N=856-969, or SEQ ID NO: 961, 962, 963, 964, 965, 967, 968, 969, 970, 971, 972, 973, 974, 975, 976, 977, 978, 979, 980, 981, 982, 983, 984, 985, 986, 987, 988, 992, 993, 994, 995, 996, 997, 998, 999, 1000, 1003, 1004, 1005, 1006, 1007, 1008, 1009, 1010, 1011, 1013, 1014, 1015, 1016, 1017, 1019, 1020, 1023, 1024, 1026, 1030, 1031, 1032, 1033, 1035, 1036, 1037, 1038, 1039, 1040, 1041, 1042, 1043, 1044, 1045, 1046, 1047, 1048, 1049, 1052, 1053, 1054, 1055, 1056, 1057, 1058, 1059, 1060, 1061, 1062, 1063, 1064, 1065, 1066, 1067, 1068, 1069, 1070, 1071, 1077, 1078, 1079, 1080, 1081, 1082, 1083, 1084, 1085, 1086, 1087, 1088, 1089, 1090, 1096, 1097, 1098, 1099, 1100, 1101, 1102, 1103, 1104, 1105, 1106, 1107, 1108, 1113, 1114, 1115, 1116, 1117, 1118, 1119, 1120, 1121, 1122, 1123, 1124, 1125, 1126, 1127, 1128, 1129, 1130, 1131, 1132, 1133, 1134, 1135, 1136, 1137, 1138, 1139, 1140, 1141, 1142, 1143, 1144, 1145, 1146, 1147, 1148, 1149, 1151, 1152, 1153, 1154, 1155, 1156, 1157, 1158, 1159, 1160, 1161, 1162, 1163, 1164, 1170, 1171, 1172, 1173, 1174, 1175, 1176, 1177, 1178, 1179, 1180, 1181, 1182, 1183, 1184, 1185, 1186, 1187, 1188, 1192, 1193, 1194, 1195, 1196, 1200, 1201, 1202, 1203, 1204, 1205, 1206, 1207, 1208, 1209, 1210, 1211, 1212, 1217, 1218, 1219, 1220, 1221, 1222, 1223, 1224, 1225, 1228, 1229, 1230, 1231, 1232, 1234, 1235, 1236, 1237, 1238, 1240, 1241, 1242, 1243, 1244, 1245, 1248, 1249, 1250, 1251, 1252, 1253, 1254, 1255, 1256, 1257, 1260, 1261, 1262, 1263, 1264, 1265, 1266, 1267, 1268, 1270, 1271, 1272, 1273, 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1311, 1312, 1313, 1314, 1315, 1316, 1317, 1318, 1319, 1320, 1321, 1322, 1324, 1325, 1326, 1327, 1328, 1333, 1334, 1335, 1336, 1337, 1341, 1342, 1343, 1344, 1345, 1346, 1347, 1348, 1349, 1350, 1351, 1352, 1353, 1354, 1355, 1356, 1357, 1358, 1359, 1360, 1363, 1364, 1365, 1366, 1367, 1368, 1369, 1370, 1371, 1372, 1376, 1377, 1378, 1379, 1380, 1381, 1382, 1383, 1385, 1386, 1387, 1388, 1392, 1393, 1394, 1395, 1397, 1398, 1399, 1400, 1401, 1402, 1403, 1404, 1405, 1406, 1407, 1408, 1409, 1410, 1415, 1416, 1417, 1418, 1419, 1420, 1421, 1422, 1423, 1425, 1426, 1427, 1428, 1429, 1430, 1431, 1432, 1433, 1434, 1438, 1439, 1440, 1441, 1442, 1443, 1444, 1445, 1446, 1447, 1449, 1450, 1451, 1452, 1453, 1454, 1455, 1461, 1462, 1463, 1464, 1465, 1466, 1467, 1468, 1469, 1470, 1471, 1473, 1474, 1475, 1476, 1477, 1478, 1479, 1480, 1481, 1482, 1485, 1486, 1487, 1488, 1489, 1490, 1491, 1492, 1493, 1494, 1495, 1496, 1497, 1498, 1499, 1501, 1502, 1503, 1504, 1505, 1506, 1507, 1509, 1512, 1513, 1514, 1515, 1516, 1517, 1518, 1519, 1521, 1522, 1523, 1524, 1525, 1526, 1527, 1528, 1529, 1530, 1531, 1532, 1533, 1534, 1535, 1536, 1537, 1544, 1545, 1546, 1547, 1548, 1549, 1550, 1551, 1552, 1553, 1554, 1555, 1556, 1557, 1558, 1559, 1560, 1561, 1562, 1570, 1571, 1572, 1573, 1574, 1575, 1576, 1577, 1578, 1579, 1580, 1581, 1584, 1585, 1586, 1587, 1588, 1589, 1590, 1591, 1592, 1593, 1595, 1596, 1597, 1598, 1599, 1600, 1601, 1602, 1603, 1604, 1605, 1606, 1607, 1608, 1609, 1610, 1613, 1614, 1615, 1616, 1617, 1621, 1622, 1623, 1624, 1625, 1628, 1629, 1630, 1631, 1632, 1633, 1634, 1637, 1638, 1639, 1642, 1643, 1644, 1645, 1646, 1647, 1648, 1649, 1650, 1651, 1652, 1653, 1654, 1659, 1660, 1661, 1662, 1663, 1664, 1665, 1666, 1667, 1668, 1669, 1670, 1671, 1674, 1675, 1676, 1677, 1678, 1679, 1681, 1683, 1684, 1685, 1690, 1691, 1692, 1693, 1694, 1695, 1697, 1698, 1699, 1700, 1701, 1704, 1705, 1706, 1707, 1708, 1709, 1710, 1711, 1944, 1946, 1948, 1950, 1952, 1954, 1956, 1958, 1960, 1962, 1964, 1966, 1968, 1970, and 1972.

The transcription factors are comprised of polypeptide sequences listed in the Sequence Listing and include any of SEQ ID NO: 2N, wherein N=1-480, SEQ ID NO: 2N-1, where N=857-970, or SEQ ID NO: 989, 990, 991, 1001, 1002, 1012, 1018, 1021, 1022, 1025, 1027, 1028, 1029, 1034, 1050, 1051, 1072, 1073, 1074, 1075, 1076, 1091, 1092, 1093, 1094, 1095, 1109, 1110, 1111, 1112, 1150, 1165, 1166, 1167, 1168, 1169, 1189, 1190, 1191, 1197, 1198, 1199, 1213, 1214, 1215, 1216, 1226, 1227, 1233, 1239, 1246, 1247, 1258, 1259, 1269, 1307, 1308, 1309, 1310, 1323, 1329, 1330, 1331, 1332, 1338, 1339, 1340, 1361, 1362, 1373, 1374, 1375, 1384, 1389, 1390, 1391, 1396, 1411, 1412, 1413, 1414, 1424, 1435, 1436, 1437, 1448, 1456, 1457, 1458, 1459, 1460, 1472, 1483, 1484, 1500, 1508, 1510, 1511, 1520, 1538, 1539, 1540, 1541, 1542, 1543, 1563, 1564, 1565, 1566, 1567, 1568, 1569, 1582, 1583, 1594, 1611, 1612, 1618, 1619, 1620, 1626, 1627, 1635, 1636, 1640, 1641, 1655, 1656, 1657, 1658, 1672, 1673, 1680, 1682, 1686, 1687, 1688, 1689, 1696, 1702, 1703, 1945, 1947, 1949, 1951, 1953, 1955, 1957, 1959, 1961, 1963, 1965, 1967, 1969, 1971, and 1973.

The transgenic plant that comprises the recombinant polynucleotide has a polynucleotide sequence (or a sequence that is complementary to this polynucleotide sequence) selected from (a) a nucleotide sequence that encodes one of the aforementioned transcription factor polypeptide sequences; or (b) a polypeptide sequence that comprises one of the aforementioned transcription factor polypeptides.

In an example of a preferred embodiment, the transcription factor polynucleotide sequence of (a) comprises G682, or SEQ ID NO: 467. In another example of a preferred embodiment, the transcription factor polypeptide of (b) comprises G682, or SEQ ID NO: 468.

The transgenic plant may also comprise a polynucleotide sequence that is a variant of the sequences in (a) and (b) that encode a polypeptide and initiate transcription, including:

(c) a sequence variant of the nucleotide sequences of (a) or (b);

(d) an allelic variant of the nucleotide sequences of (a) or (b);

(e) a splice variant of the nucleotide sequences of (a) or (b);

(f) an orthologous sequence of the nucleotide sequences of (a) or (b);

(g) a paralogous sequence of the nucleotide sequences of (a) or (b);

(h) a nucleotide sequence encoding a polypeptide comprising a conserved domain that exhibits at least 70% sequence homology with the polypeptide of (a), and the polypeptide comprises a conserved domain that initiates transcription; or (i) a nucleotide sequence that hybridizes under stringent conditions to a nucleotide sequence of one or more polynucleotides of (a) or (b), and the nucleotide sequence encodes a polypeptide that initiates transcription.

A transcription factor sequence variant is one having at least 26% amino acid sequence similarity, at least 40% amino acid sequence identity, a preferred transcription factor sequence variant is one having at least 50% amino acid sequence identity and a more preferred transcription factor sequence variant is one having at least 65% amino acid sequence identity to the transcription factor amino acid sequences SEQ ID NO: 2N, wherein N=1-480, SEQ ID NO: 2N-1, where N=857-970, or SEQ ID NO: 989, 990, 991, 1001, 1002, 1012, 1018, 1021, 1022, 1025, 1027, 1028, 1029, 1034, 1050, 1051, 1072, 1073, 1074, 1075, 1076, 1091, 1092, 1093, 1094, 1095, 1109, 1110, 1111, 1112, 1150, 1165, 1166, 1167, 1168, 1169, 1189, 1190, 1191, 1197, 1198, 1199, 1213, 1214, 1215, 1216, 1226, 1227, 1233, 1239, 1246, 1247, 1258, 1259, 1269, 1307, 1308, 1309, 1310, 1323, 1329, 1330, 1331, 1332, 1338, 1339, 1340, 1361, 1362, 1373, 1374, 1375, 1384, 1389, 1390, 1391, 1396, 1411, 1412, 1413, 1414, 1424, 1435, 1436, 1437, 1448, 1456, 1457, 1458, 1459, 1460, 1472, 1483, 1484, 1500, 1508, 1510, 1511, 1520, 1538, 1539, 1540, 1541, 1542, 1543, 1563, 1564, 1565, 1566, 1567, 1568, 1569, 1582, 1583, 1594, 1611, 1612, 1618, 1619, 1620, 1626, 1627, 1635, 1636, 1640, 1641, 1655, 1656, 1657, 1658, 1672, 1673, 1680, 1682, 1686, 1687, 1688, 1689, 1696, 1702, 1703, 1945, 1947, 1949, 1951, 1953, 1955, 1957, 1959, 1961, 1963, 1965, 1967, 1969, 1971, and 1973, and which contains at least one functional or structural characteristic of the transcription factor amino acid sequences. Sequences having lesser degrees of identity but comparable biological activity are considered to be equivalents.

The transcription factor polypeptides of the present invention include at least one conserved domain, and the portions of the nucleotide sequences encoding the conserved domain exhibit at least 70% sequence identity with the aforementioned preferred nucleotide sequences. In the case of zinc finger transcription factors, the percent identity across the conserved domain may be as low as 50%.

The present invention also encompasses MAF transcription factor sequence variants. A MAF transcription factor sequence variant is one having at least 26% amino acid sequence similarity, at least 40% amino acid sequence identity, a preferred MAF transcription factor sequence variant is one having at least 50% amino acid sequence identity and a more preferred MAF transcription factor sequence variant is one having at least 65% amino acid sequence identity to the MAF transcription factor sequences SEQ ID NO: 568, SEQ ID NO: 944, SEQ ID NO: 946, SEQ ID NO: 948, SEQ ID NO: 1735, SEQ ID NO: 1875, SEQ ID NO: 1971, SEQ ID NO: 1973, SEQ ID NO: 1945, SEQ ID NO: 1947, SEQ ID NO: 1949, SEQ ID NO: 1951, SEQ ID NO: 1953, SEQ ID NO: 1955, SEQ ID NO: 1957, SEQ ID NO: 1959, SEQ ID NO: 1961, SEQ ID NO: 1963, SEQ ID NO: 1965, SEQ ID NO: 1967, SEQ ID NO: 1969, SEQ ID NO: 2010, or SEQ ID NO: 2011, and which contains at least one functional or structural characteristic of the MAF transcription factor amino acid sequences. In a further embodiment, the invention is a polynucleotide encoding a polypeptide having at least 36% amino acid residue identity to a MAF transcription factor selected from the group consisting of SEQ ID NOs: 568, SEQ ID NO: 944, SEQ ID NO: 946, SEQ ID NO: 948, SEQ ID NO: 1735, SEQ ID NO: 1875, SEQ ID NO: 1971, SEQ ID NO: 1973, SEQ ID NO: 1945, SEQ ID NO: 1947, SEQ ID NO: 1949, SEQ ID NO: 1951, SEQ ID NO: 1953, SEQ ID NO: 1955, SEQ ID NO: 1957, SEQ ID NO: 1959, SEQ ID NO: 1961, SEQ ID NO: 1963, SEQ ID NO: 1965, SEQ ID NO: 1967, SEQ ID NO: 1969, SEQ ID NO: 2010, or SEQ ID NO: 2011, and having MAF transcription factor activity. In a yet further embodiment the invention is a polynucleotide encoding a polypeptide having a conserved domain of a MAF transcription factor wherein the conserved domain has at least 54% identity to the conserved domain of SEQ ID NO: 568 comprising amino acid residues 2-74 of SEQ ID NO: 568. In a still further embodiment the invention is a polynucleotide encoding a polypeptide having a conserved domain of a MAF transcription factor wherein the conserved domain has at least 64% identity to the conserved domain of SEQ ID NO: 568 comprising amino acid residues 2-57 of SEQ ID NO: 568. Sequences having lesser degrees of identity but comparable biological activity are considered to be equivalents.

In a further aspect, the invention provides a progeny plant derived from a parental plant wherein said progeny plant exhibits, with respect to a specific gene, at least three fold greater messenger RNA (mRNA) levels than said parental plant, wherein the mRNA encodes a DNA-binding protein that is capable of binding to a DNA regulatory sequence and inducing expression of a plant trait gene, wherein the progeny plant is characterized by a change in the plant trait compared to said parental plant. In yet a further aspect, the progeny plant exhibits at least ten fold greater mRNA levels compared to said parental plant. In yet a further aspect, the progeny plant exhibits at least fifty fold greater mRNA levels compared to said parental plant.

Various types of plants may be used to generate the transgenic plants, including soybean, wheat, corn, potato, cotton, rice, oilseed rape, sunflower, alfalfa, clover, sugarcane, turf, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, watermelon, mint and other labiates, rosaceous fruits, and vegetable brassicas.

The transgenic plant may be monocotyledonous, plant, and the polynucleotide sequences used to transform the transgenic plant may be derived from either a monocot or a dicot plant. Alternatively, the transgenic plant may be dicotyledonous, plant, and the polynucleotide sequences used to transform the transgenic plant may be derived from either a monocot or a dicot plant.

These transgenic plants will generally possess traits that are altered as compared to a control plant, such as a wild-type or non-transformed plant (i.e., the non-transformed plant does not comprise the recombinant polynucleotide), thus producing an phenotype that is altered when compared to the control, wild-type or non-transformed plant. These transgenic plants may also express an altered level of one or more genes associated with a plant trait as compared to the non-transformed plant. The encoded polypeptides in these transgenic plants will generally be expressed and regulate transcription of at least one gene; this gene will generally confer at least one altered trait, phenotype or expression level.

The polynucleotide sequences (those listed in the Sequence Listing, their complements, of functional variants) used to transform the transgenic plants of the present invention may further comprise regulatory elements, for example, a constitutive, inducible, or tissue-specific promoter operably linked to the polynucleotide sequence.

Transformation of plants with presently disclosed transcription factor sequences will produce a variety of improved traits. For example, the altered trait may be an enhanced tolerance to abiotic stress, such as salt tolerance. Salt tolerance, a form of osmotic stress, may be mediated by increased root growth or increased root hairs relative to a non-transformed, control or wild-type plant. Tolerance to abiotic stresses such as salt tolerance may confer a number of survival, quality and yield improvements, including improved seed germination and improved seedling vigor, as well as improved yield, quality, and range.

Another example of an altered trait that may be conferred by transforming plants with the presently disclosed transcription factor sequences includes altered sugar sensing. Altered sugar sensing may also be used to confer improved seed germination and improved seedling vigor, as well as altered flowering, senescence, sugar metabolism and photosynthesis characteristics.

The invention also pertains to method to produce these transgenic plants.

The present invention also relates to a method of using transgenic plants transformed with the presently disclosed transcription factor sequences, their complements or their variants to grow a progeny plant by crossing the transgenic plant with either itself or another plant, selecting seed that develops as a result of the crossing; and then growing the progeny plant from the seed. The progeny plant will generally express mRNA that encodes a transcription factor: that is, a DNA-binding protein that binds to a DNA regulatory sequence and induces expression, such as that of a plant trait gene. The mRNA will generally be expressed at a level greater than a non-transformed plant; and the progeny plant is characterized by a change in a plant trait compared to the non-transformed plant.

The present invention also pertains to an expression cassette. The expression cassette comprises at least two elements, including:

(1) a constitutive, inducible, or tissue-specific promoter; and (2) a recombinant polynucleotide having a polynucleotide sequence, or a complementary polynucleotide sequence thereof, selected from the group consisting of a nucleotide sequence encoding a polypeptide sequence selected from the transcription factor sequences in the sequence listing, for example, polypeptide sequence G682, SEQ ID NO: 468; a nucleotide sequence selected from the transcription factor polynucleotides of the Sequence Listing, for example, polynucleotide sequence G682, SEQ ID NO: 467, or sequence variants such as allelic or splice variants of the nucleotide sequences of (a) or (b), where the sequence variant encodes a polypeptide that initiates transcription. The nucleotide sequence may also comprise an orthologous or paralogous sequence of the nucleotide sequences of (a) or (b), and these sequences encodes a polypeptide that initiates transcription, a nucleotide sequence that encodes a polypeptide having a conserved domain that exhibits 72% or greater sequence homology with the polypeptide of (a), where the polypeptide comprising the conserved domain initiates transcription, or a nucleotide sequence that hybridizes under stringent conditions to a nucleotide sequence of one or more polynucleotides of (a) or (b), where the latter nucleotide sequence initiates transcription. In all of these cases, the recombinant polynucleotide is operably linked to the promoter of the expression cassette.

The invention includes a host cell that comprises the expression cassette. The host cell may be a plant cell, such as a cell of a crop plant.

The invention also concerns a method for identifying at least one downstream polynucleotide sequence that is subject to a regulatory effect of any of the polypeptide transcription factors of the present invention, or a sequence variant, ortholog or paralog of any of these sequences. This method is conducted by expressing a polypeptide transcription factor, variant, ortholog or paralog in a plant cell, and then identifying an expression product, such as RNA or protein, produced as a result. The identification method used can be any method that identifies RNA or protein products of expression, such as, for example, Northern analysis, RT-PCR, microarray gene expression assays, reporter gene expression systems subtractive hybridization, differential display, representational differential analysis, or by two-dimensional gel electrophoresis of one or more protein products.

In another aspect the invention is a method of screening a plurality of plants to identify at least one plant that comprises a polynucleotide encoding a MAF transcription factor protein wherein the expression of the polynucleotide alters at least one of the plant's traits. The method comprises (a) selecting a first polynucleotide from the group consisting of a combination of plant polynucleotide sequences of SEQ ID NO: 567, SEQ ID NO: 943, SEQ ID NO: 945, SEQ ID NO: 947, SEQ ID NO: 1734, SEQ ID NO: 1874, SEQ ID NO: 1014, SEQ ID NO: 1970, SEQ ID NO: 1972, SEQ ID NO: 1944, SEQ ID NO: 1946, SEQ ID NO: 1948, SEQ ID NO: 1950, SEQ ID NO: 1952, SEQ ID NO: 1954, SEQ ID NO: 1956, SEQ ID NO: 1958, SEQ ID NO: 1960, SEQ ID NO: 1962, SEQ ID NO: 1964, SEQ ID NO: 1966, or SEQ ID NO: 1968; (b) comparing the first polynucleotide sequence with a second polynucleotide sequence wherein the second polynucleotide sequence is isolated from a second plant; (c) selecting the second polynucleotide sequence, wherein the second polynucleotide sequence encodes a polypeptide sequence that has at least 60% identity with a polypeptide sequence encoded by the sequence of the first polynucleotide; (d) comparing the second polynucleotide sequence with a third polynucleotide sequence wherein the third polynucleotide sequence is isolated from a third plant, wherein the third plant is selected from a plurality of plants; (e) selecting the third polynucleotide sequence, wherein the third polynucleotide sequence encodes a polypeptide sequence that has at least one amino acid substitution compared with a polypeptide sequence encoded by the sequence of the second polynucleotide; (f) identifying the third plant from which the third polynucleotide came; (g) measuring the expression level of the endogenous third polynucleotide sequence in another third plant; (h) identifying which other third plant expresses the third polynucleotide sequence; and (i) identifying a trait in the other third plant of step (h) which is changed when compared with the same trait in the second plant, wherein the trait is selected from the group consisting of at least one trait listed below.

In another embodiment, the method further comprises the third polynucleotide sequence that has at last one nucleotide base substitution compared with the polynucleotide sequence of the second polynucleotide.

BRIEF DESCRIPTION OF THE SEQUENCE LISTING, TABLES, AND DRAWINGS

The Sequence Listing provides exemplary polynucleotide and polypeptide sequences of the invention. The traits associated with the use of the sequences are included in the Examples.

CD-ROM1 (Copy 1) is a read-only memory computer-readable compact disc and contains a copy of the Sequence Listing in ASCII text format and a copy of Table 8 in ASCII text format. The Sequence Listing is named "MBI0048.ST25.txt", was created on Apr. 10, 2003, and is 4,267 kilobytes in size. Table 8 is named "MBI-0048CIP.Table_8.rev.txt" and is 822 kilobytes in size. Table 8 as filed was created on Apr. 10, 2003. The copies of the Sequence Listing and Table 8 on the CD-ROM disc are hereby incorporated by reference in their entirety.

CD-ROM2 (Copy 2) is an exact copy of CD-R1 (Copy 1).

CD-ROM3 contains a computer-readable format (CRF) copy of the Sequence Listing as a text (.txt) file.

Table 8 lists a summary of homologous sequences identified using BLAST (tblastx program). The first column shows the polynucleotide sequence identifier (SEQ ID NO:), the second column shows the corresponding cDNA identifier (Gene ID or GID), the third column shows the orthologous or homologous polynucleotide GenBank Accession Number (Test Sequence ID), the fourth column shows the calculated probability value that the sequence identity is due to chance (Smallest Sum Probability), the fifth column shows the plant species from which the test sequence was isolated (Test Sequence Species), and the sixth column shows the orthologous or homologous test sequence GenBank annotation (Test Sequence GenBank Annotation).

Table 14 shows the polypeptide sequence identities and similarities between exemplary polypeptides of the invention. The first column and first row shows the polypeptide SEQ ID NO (polypeptide SEQ ID NO); the second column and second row shows the Mendel Name (Name); the third column and third row shows the Mendel Gene identifier number (Gene ID). The percentage identity, and percentage similarity in parentheses, between the two polypeptide sequences are indicated at the intersection of each column and row.

Table 15 shows flowering times for the maf2 mutant. The first column shows the genotype of the *Arabidopsis* plant tested. The second column shows the number of plants tested; N=number. The third column shows the number of days the plant was cold-treated. The fourth column shows the photoperiod in hours. The fifth column shows the number of days elapsed from beginning of cold treatment at which time flower buds were visible. The sixth column shows the total leaf primordia produced by primary shoot meristem before first flower. Four separate experiments were done (Experiments 1 through 4).

Table 16 shows flowering times of transgenic plants over-expressing MAF2 (SEQ ID NO: 567), MAF3 (SEQ ID NO: 943), MAF4 (SEQ ID NO: 945), and MAF5 (SEQ ID NO: 947) in *Arabidopsis* Stockholm accession and Columbia accession transgenic T1 lines. The first column lists the genotype of the transgenic plants (Genotype). The second column shows the observed phenotype in the transgenic plants (Phenotype). The third column shows the penetrance of the observed altered phenotype as a fraction of total transgenic plants (Penetrance). The fourth column shows the number of days to a visible flower bud in all transgenic plants (Days to visible flower bud; range and (mean+/−S.E.M.)). The fifth column shows the total leaf number of all transgenic plants (Total leaf number; range and (mean+/−S.E.M.)).

Table 17 shows flowering times of transgenic plants over-expressing MAF2 (SEQ ID NO: 567), MAF3 (SEQ ID NO: 943), MAF4 (SEQ ID NO: 945), and MAF5 (SEQ ID NO: 947) in *Arabidopsis* T2 Columbia accession and Landsberg accession transgenic T1 lines. The first column lists the genotype of the transgenic plants (Genotype). The second column shows the T2 line analyzed (Line). The third column shows the total number of plants analyzed (N). The fourth column shows the observed phenotype in the T1 transgenic plants (Ti phenotype). The fifth column shows the observed phenotype in the T2 transgenic plants (T2 phenotype). The sixth column shows the number of days of cold treatment for the T2 lines (Days of cold treatment). The seventh column show the number of hours the transgenic plants were exposed to light per day (Photoperiod (hours)). The eighth column shows the number of days to a visible flower bud in all transgenic plants (Days to visible flower bud; range and (mean+/−S.E.M.)). The ninth column shows the total leaf number of all transgenic plants (Total leaf number; range and (mean+/−S.E.M.)). NA: not applicable; ND: not determined.

FIG. 1 shows a conservative estimate of phylogenetic relationships among the orders of flowering plants (modified from Angiosperm Phylogeny Group (1998) *Ann. Missouri Bot. Gard.* 84: 1-49). Those plants with a single cotyledon (monocots) are a monophyletic clade nested within at least two major lineages of dicots; the eudicots are further divided into rosids and asterids. *Arabidopsis* is a rosid eudicot classified within the order Brassicales; rice is a member of the monocot order Poales. FIG. 1 was adapted from Daly et al. (2001) *Plant Physiol.* 127: 1328-1333.

FIG. 2 shows a phylogenic dendogram depicting phylogenetic relationships of higher plant taxa, including clades containing tomato and *Arabidopsis*; adapted from Ku et al. (2000) *Proc. Natl. Acad. Sci.* 97: 9121-9126; and Chase et al. (1993) *Ann. Missouri Bot. Gard.* 80: 528-580.

FIGS. 3A, and 3B show an alignment of G682 (SEQ ID NO: 468) and polypeptide sequences that are paralogous and orthologous to G682.

FIGS. 4A, 4B, 4C and 4D show an alignment of G867 (SEQ ID NO: 580) and polypeptide sequences that are paralogous and orthologous to G867.

FIGS. 5A, 5B, 5C, 5D, 5E and 5F show an alignment of G912 (SEQ ID NO: 616) and polypeptide sequences that are paralogous and orthologous to G912.

FIG. 6 shows an alignment of the polypeptide sequences of FLC (SEQ ID NO: 1875) and MAF1-5 (SEQ ID NOs: 1735, 568, 944, 946, and 948) full-length polypeptides encoded by SEQ ID NOs: 1874, 1734, 567, 943, 945, and 947, respectively. The alignment was produced by manual alignment of the polypeptide sequences.

FIGS. 7A and 7B show an alignment of the polypeptide sequences of SEQ ID NO: 948 (G1844.pep; MAF5), SEQ ID NO: 946 (G1843.pep; MAF4), SEQ ID NO: 944 (G1842.pep; MAF3), SEQ ID NO: 568 (G859.pep; MAF2), SEQ ID NO: 1735 (G157.pep; MAF1), SEQ ID NO: 1875 (G1759.pep; FLC), SEQ ID NO: 1971 (Soy1.pep; SOY MADS1), and SEQ ID NO: 1973 (Soy3.pep; SOY MADS3) full-length polypeptides encoded by SEQ ID NOs: 947, 945, 943, 567, 1734, 1874, 1970, and 1972, respectively. Regions of identity between the polypeptide sequences are boxed. The calculated consensus sequence is shown beneath the alignments. The alignment was made using the CLUSTALW alignment program in the MACVECTOR sequence data package (MACVECTOR 6.0 or MACVECTOR 6.5 applications, Accelrys, San Diego Calif.).

Figure 8:
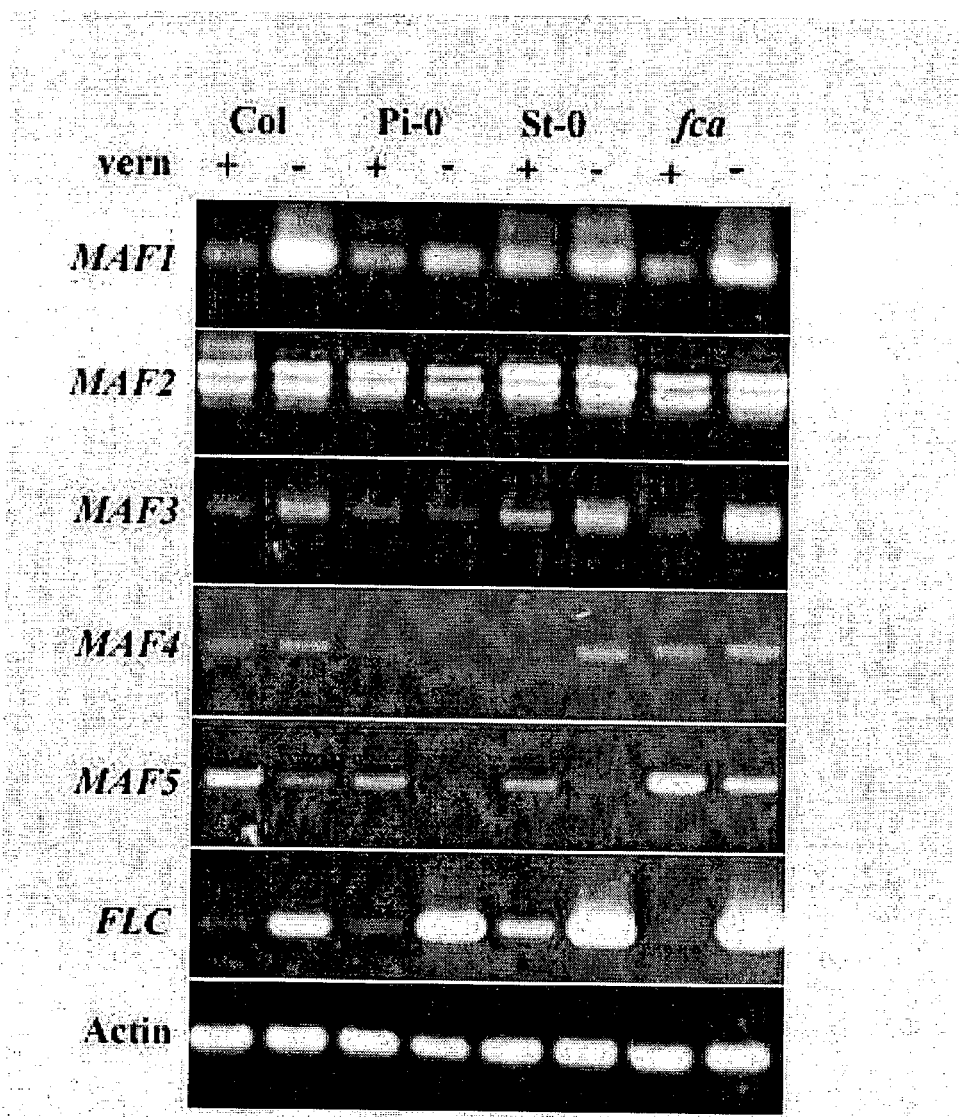

FIG. 8 shows the effects of vernalization on endogenous expression of MAF2-5 (SEQ ID NOs: 567, 943, 945, and 947) in different genetic backgrounds (accessions). Expression was monitored by RT-PCR (MAF1, 2, 3, 4, and 5, and FLC transcripts). Vernalized (+) samples were cold-treated for 6 weeks at 4° C., whereas non-vernalized (−) samples were stratified for only 3 days at 4° C. as imbibed seeds. Col=Columbia, Pi–0=Pitztal, St–0=Stockholm, fca=fca–9 mutant.

Figure 9:
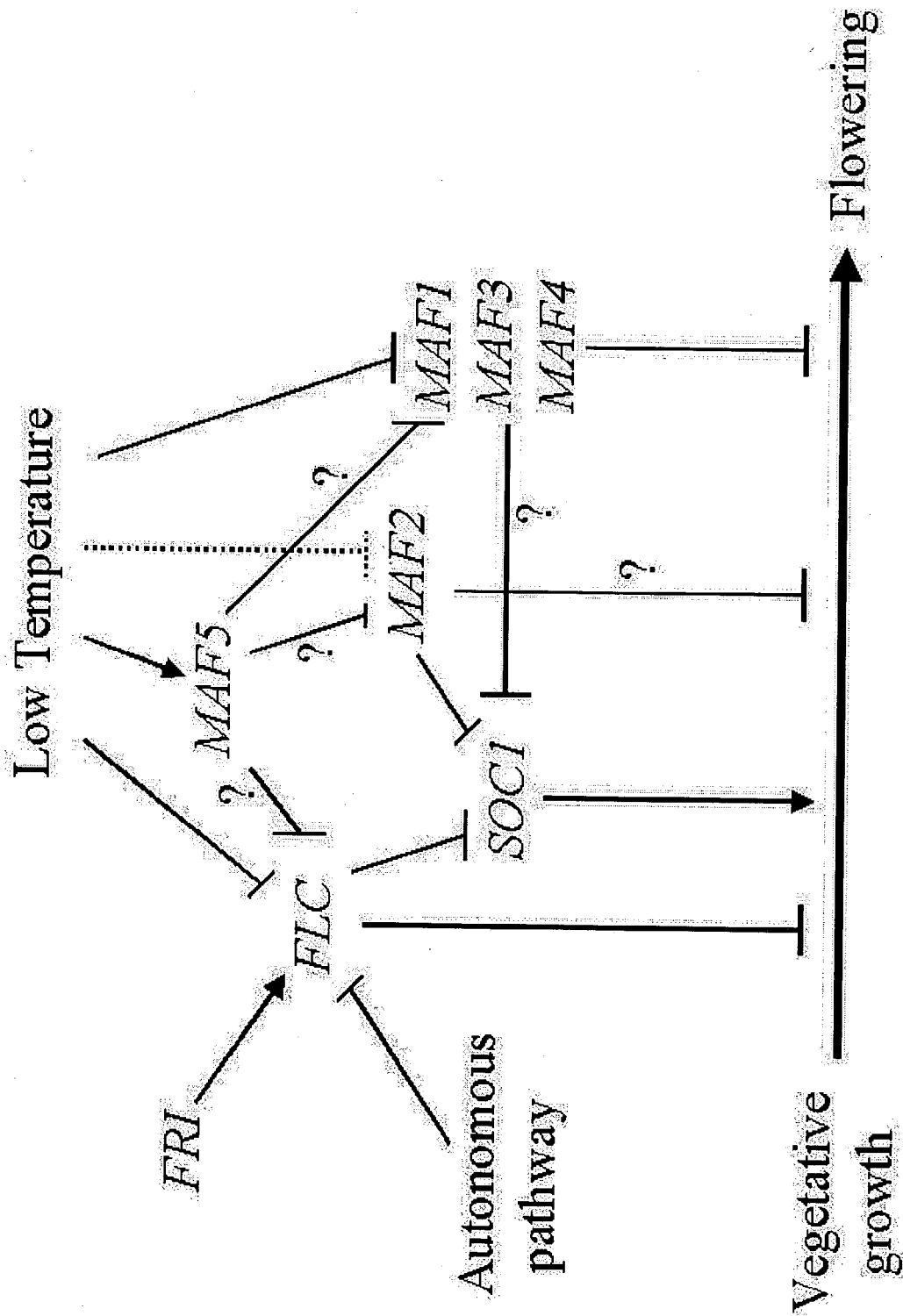

FIG. 9 is a schematic diagram summarizing the responses of FLC and MAF1-5 (SEQ ID NOs: 567, 943, 945, and 947) to vernalization, and their potential effects on the floral transition. Arrows indicate positive interactions, blunt-ended lines denote inhibition.

Figure 10:
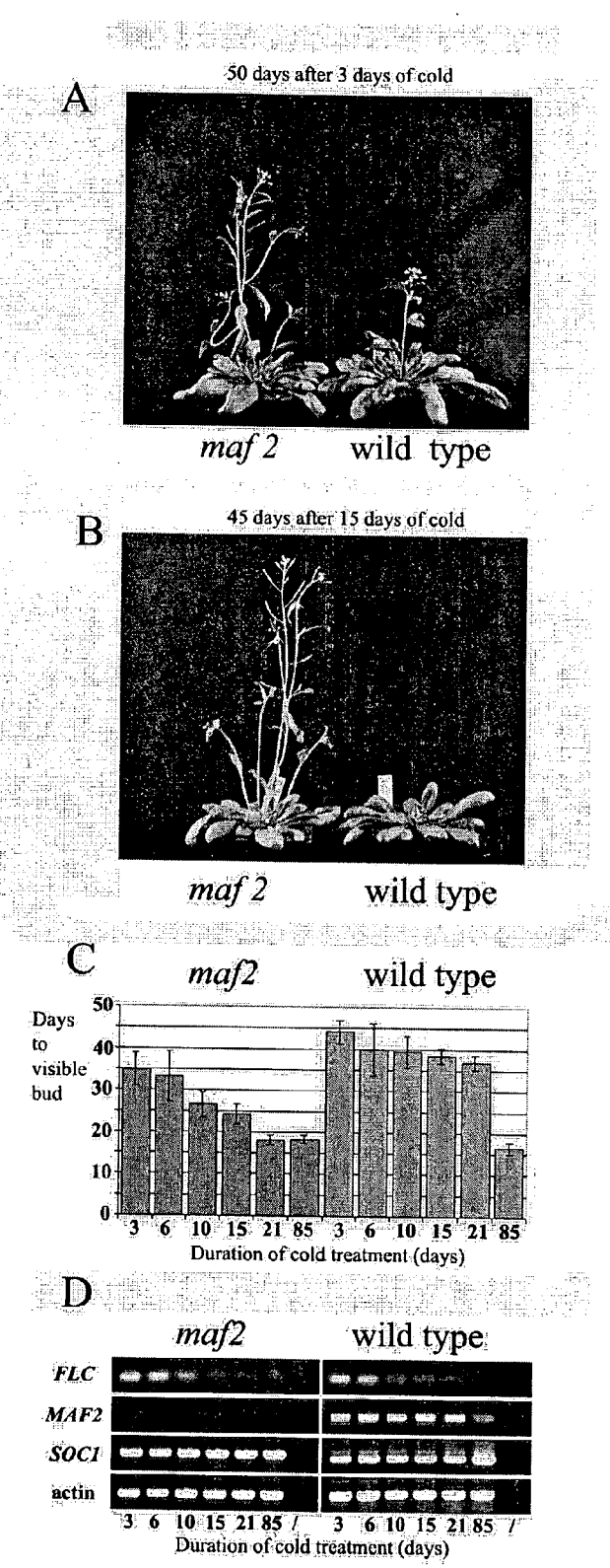

FIG. 10 shows the effect of vernalization on the maf2 mutant: (A) in the absence of vernalization; (B) following a vernalization treatment; (C) days to visible bud of maf2 mutant compared with wild type; and (D) RT-PCR transcript analysis of endogenous genes of maf2 mutant compared with those in wild type.

Figure 11:
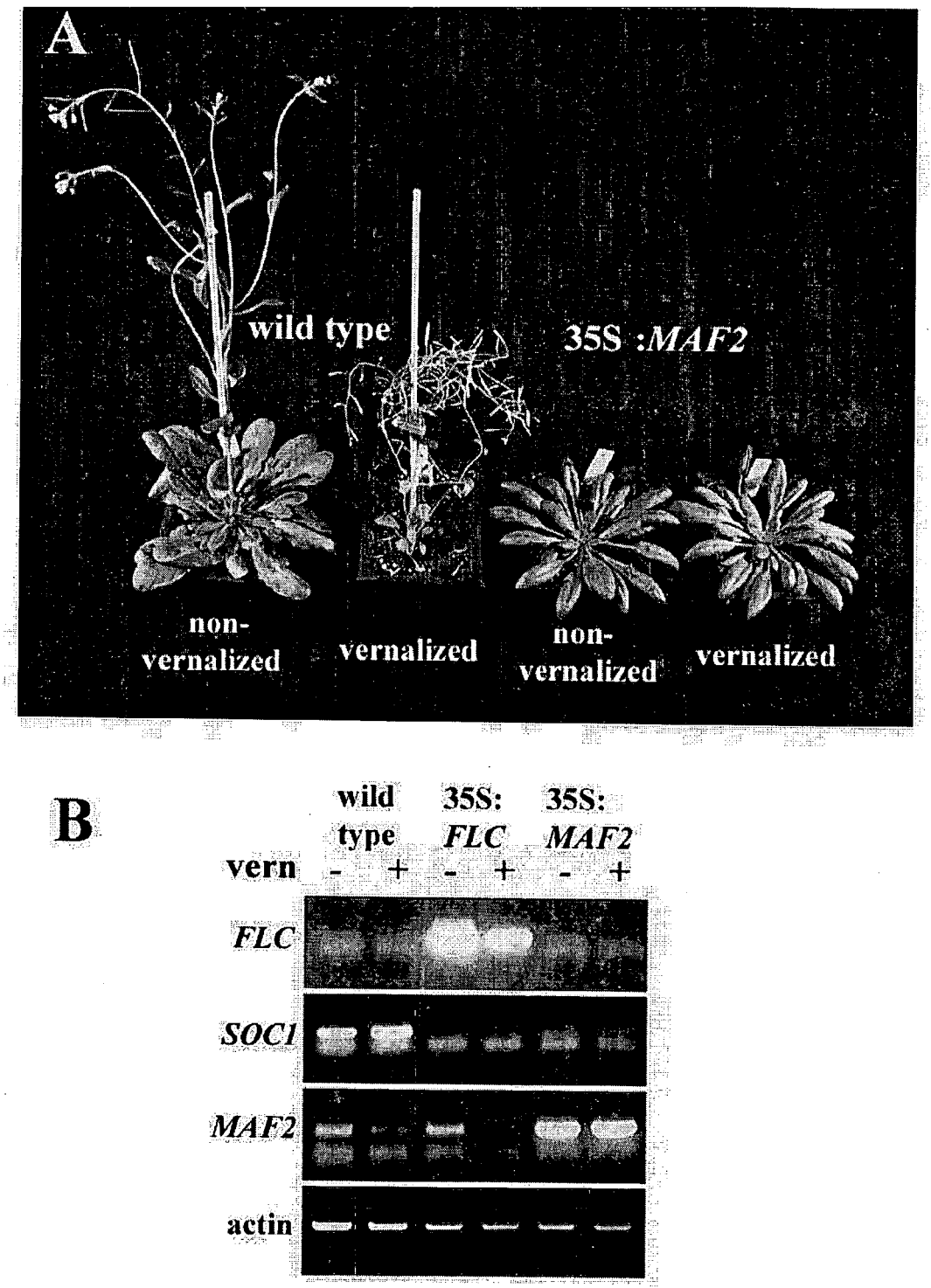

FIG. 11 shows the effects of MAF2 overexpression in the Columbia ecotype; (A) shows vernalized or non-vernalized transgenic 35S:MAF2 plants and wild type plants; and (B) shows RT-PCR transcript analysis of endogenous FLC, MAF2, and SOC1 transcripts in wild type (Columbia accession), transgenic 35S:MAF2, and transgenic 35S:FLC seedlings.

DETAILED DESCRIPTION OF EXEMPLARY EMBODIMENTS

In an important aspect, the present invention relates to polynucleotides and polypeptides, for example, for modifying phenotypes of plants. Throughout this disclosure, various information sources are referred to and/or are specifically incorporated. The information sources include scientific journal articles, patent documents, textbooks, and World Wide Web browser-inactive page addresses, for example. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the invention.

It must be noted that as used herein and in the appended claims, the singular forms "a," "an," and "the" include plural reference unless the context clearly dictates otherwise. Thus, for example, a reference to "a plant" includes a plurality of such plants, and a reference to "a stress" is a reference to one or more stresses and equivalents thereof known to those skilled in the art, and so forth.

The polynucleotide sequences of the invention encode polypeptides that are members of well-known transcription factor families, including plant transcription factor families, as disclosed in Tables 4-5. Generally, the transcription factors encoded by the present sequences are involved in cell differentiation and proliferation and the regulation of growth. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits. The sequences of the invention may also be used to transform a plant and introduce desirable traits not found in the wild-type cultivar or strain. Plants may then be selected for those that produce the most desirable degree of over- or under-expression of target genes of interest and coincident trait improvement.

The sequences of the present invention may be from any species, particularly plant species, in a naturally occurring form or from any source whether natural, synthetic, semi-synthetic or recombinant. The sequences of the invention may also include fragments of the present amino acid sequences. In this context, a "fragment" refers to a fragment of a polypeptide sequence which is at least 5 to about 15 amino acids in length, most preferably at least 14 amino acids, and which retain some biological activity of a transcription factor. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

As one of ordinary skill in the art recognizes, transcription factors can be identified by the presence of a region or domain of structural similarity or identity to a specific consensus sequence or the presence of a specific consensus DNA-binding site or DNA-binding site motif (see, for example, Riechmann et al. (2000) *Science* 290: 2105-2110). The plant transcription factors may belong to one of the following transcription factor families: the AP2 (APETALA2) domain transcription factor family (Riechmann and Meyerowitz (1998) *Biol. Chem.* 379: 633-646); the MYB transcription factor family (ENBib; Martin and Paz-Ares (1997) *Trends Genet.* 13: 67-73); the MADS domain transcription factor family (Riechmann and Meyerowitz (1997) *Biol. Chem.* 378: 1079-1101; Immink et al. (2003) *Mol. Gen. Genomics* 268:598-606); the WRKY protein family (Ishiguro and Nakamura (1994) *Mol. Gen. Genet.* 244: 563-571); the ankyrin-repeat protein family (Zhang et al. (1992) *Plant Cell* 4: 1575-1588); the zinc finger protein (Z) family (Klug and Schwabe (1995) *FASEB J.* 9: 597-604); Takatsuji (1998) *Cell. Mol. Life Sci.* 54:582-596); the homeobox (HB) protein family (Buerglin (1994) in *Guidebook to the Homeobox Genes*, Duboule (ed.) Oxford University Press); the CAAT-element binding proteins (Forsburg and Guarente (1989) *Genes Dev.* 3: 1166-1178); the squamosa promoter binding proteins (SPB) (Klein et al. (1996) *Mol. Gen. Genet.* 1996 250: 7-16); the NAM protein family (Souer et al. (1996) *Cell* 85: 159-170); the IAA/AUX proteins (Abel et al. (1995) *J. Mol. Biol.* 251: 533-549); the HLH/MYC protein family (Littlewood et al. (1994) *Prot. Profile* 1: 639-709); the DNA-binding protein (DBP) family (Tucker et al. (1994) *EMBO J.* 13: 2994-3002); the bZIP family of transcription factors (Foster et al. (1994) *FASEB J.* 8: 192-200); the Box P-binding protein (the BPF-1) family (da Costa e Silva et al. (1993) *Plant J.* 4: 125-135); the high mobility group (HMG) family (Bustin and Reeves (1996) *Prog. Nucl. Acids Res. Mol. Biol.* 54: 35-100); the scarecrow (SCR) family (Di Laurenzio et al. (1996) *Cell* 86: 423-433); the GF14 family (Wu et al. (1997) *Plant Physiol.* 114: 1421-1431); the polycomb (PCOMB) family (Goodrich et al. (1997) *Nature* 386: 44-51); the teosinte branched (TEO) family (Luo et al. (1996) Nature 383: 794-799); the ABI3 family (Giraudat et al. (1992) *Plant Cell* 4: 1251-1261); the triple helix (TH) family (Dehesh et al. (1990) *Science* 250: 1397-1399); the EIL family (Chao et al. (1997) *Cell* 89: 1133-44); the AT-HOOK family (Reeves and Nissen (1990) *J. Biol. Chem.* 265: 8573-8582); the S1FA family (Zhou et al. (1995) *Nucleic Acids Res.* 23: 1165-1169); the bZIPT2 family (Lu and Ferl (1995) *Plant Physiol.* 109: 723); the YABBY family (Bowman et al. (1999) *Development* 126: 2387-96); the PAZ family (Bohmert et al. (1998) *EMBO J.* 17: 170-80); a family of miscellaneous (MISC) transcription factors including the DPBF family (Kim et al. (1997) *Plant J.* 11: 1237-1251) and the SPF1 family (Ishiguro and Nakamura (1994) *Mol. Gen. Genet.* 244: 563-571); the GARP family (Hall et al. (1998) Plant Cell 10: 925-936), the TUBBY family (Boggin et al (1999) *Science* 286: 2119-2125), the heat shock family (Wu (1995) *Annu. Rev. Cell Dev. Biol.* 11: 441-469), the ENBP family (Christiansen et al. (1996) *Plant Mol. Biol.* 32: 809-821), the RING-zinc family (Jensen et al. (1998) *FEBS Letters* 436: 283287), the PDBP family (Janik et al. (1989) *Virology* 168: 320-329), the PCF family (Cubas et al. *Plant J.* (1999) 18: 215-22), the SRS(SHI-related) family (Fridborg et al. (1999) *Plant Cell* 11: 1019-1032), the CPP (cysteine-rich polycomb-like) family (Cvitanich et al. (2000) *Proc. Natl. Acad. Sci.* 97: 8163-8168), the ARF (auxin response factor) family (Ulmasov et al. (1999) *Proc. Natl. Acad. Sci.* 96: 5844-5849), the SWI/SNF family (Collingwood et al. (1999) *J. Mol. Endocrinol.* 23: 255-275), the ACBF family (Seguin et al. (1997) *Plant Mol. Biol.* 35: 281-291), PCGL (CG-1 like) *family (da Costa e Silva et al. (1994) Plant Mol. Biol.* 25: 921-924) the ARID family (Vazquez et al. (1999) *Development* 126: 733-742), the Jumonji family (Balciunas et al. (2000), *Trends Biochem. Sci.* 25: 274-276), the bZIP-NIN family (Schauser et al. (1999) *Nature* 402: 191-195), the E2F family (Kaelin et al. (1992) *Cell* 70: 351-364) and the GRF-like family (Knaap et al. (2000) *Plant Physiol.* 122: 695-704). As indicated by any part of the list above and as known in the art, transcription factors have been sometimes categorized by class, family, and sub-family according to their structural content and consensus DNA-binding site motif, for example. Many of the classes and many of the families and sub-families are listed here. However, the inclusion of one subfamily and not another, or the inclusion of one family and not another, does not mean that the invention does not encompass polynucleotides or polypeptides of a certain family or sub-family. The list provided here is merely an example of the types of transcription factors and the knowledge available concerning the consensus sequences and consensus DNA-binding site motifs that help define them as known to those of skill in the art (each of the references noted above are specifically incorporated herein by reference). A transcription factor may include, but is not limited to, any polypeptide that can activate or repress transcription of a single gene or a number of genes. This polypeptide group includes, but is not limited to, DNA-binding proteins, DNA-binding protein binding proteins, protein kinases, protein phosphatases, protein methyltransferases, GTP-binding proteins, and receptors, and the like.

In addition to methods for modifying a plant phenotype by employing one or more polynucleotides and polypeptides of the invention described herein, the polynucleotides and polypeptides of the invention have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, e.g., mutation reactions, PCR reactions, or the like; as substrates for cloning e.g., including digestion or ligation reactions; and for identifying exogenous or endogenous modulators of the transcription factors. A "polynucleotide" is a nucleic acid sequence comprising a plurality of polymerized nucleotides, e.g., at least about 15 consecutive polymerized nucleotides, optionally at least about 30 consecutive nucleotides, at least about 50 consecutive nucleotides. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single stranded or double stranded DNA or RNA. The polynucleotide optionally comprises modified bases or a modified backbone. The polynucleotide can be, e.g., genomic DNA or RNA, a transcript (such as an mRNA), a cDNA, a PCR product, a cloned DNA, a synthetic DNA or RNA, or the like. The polynucleotide can comprise a sequence in either sense or antisense orientations.

Definitions

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

An "isolated polynucleotide" is a polynucleotide whether naturally occurring or recombinant, that is present outside the cell in which it is typically found in nature, whether purified or not. Optionally, an isolated polynucleotide is subject to one or more enrichment or purification procedures, e.g., cell lysis, extraction, centrifugation, precipitation, or the like.

A "polypeptide" is an amino acid sequence comprising a plurality of consecutive polymerized amino acid residues e.g., at least about 15 consecutive polymerized amino acid residues, optionally at least about 30 consecutive polymerized amino acid residues, at least about 50 consecutive polymerized amino acid residues. In many instances, a polypeptide comprises a polymerized amino acid residue sequence that is a transcription factor or a domain or portion or fragment thereof. Additionally, the polypeptide may comprise 1) a localization domain, 2) an activation domain, 3) a repression domain, 4) an oligomerization domain, or 5) a DNA-binding domain, or the like. The polypeptide optionally comprises modified amino acid residues, naturally occurring amino acid residues not encoded by a codon, non-naturally occurring amino acid residues.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, e.g., by any of the various protein purification methods herein.

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value therebetween. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids at positions shared by the polypeptide sequences.

Figure 3A:
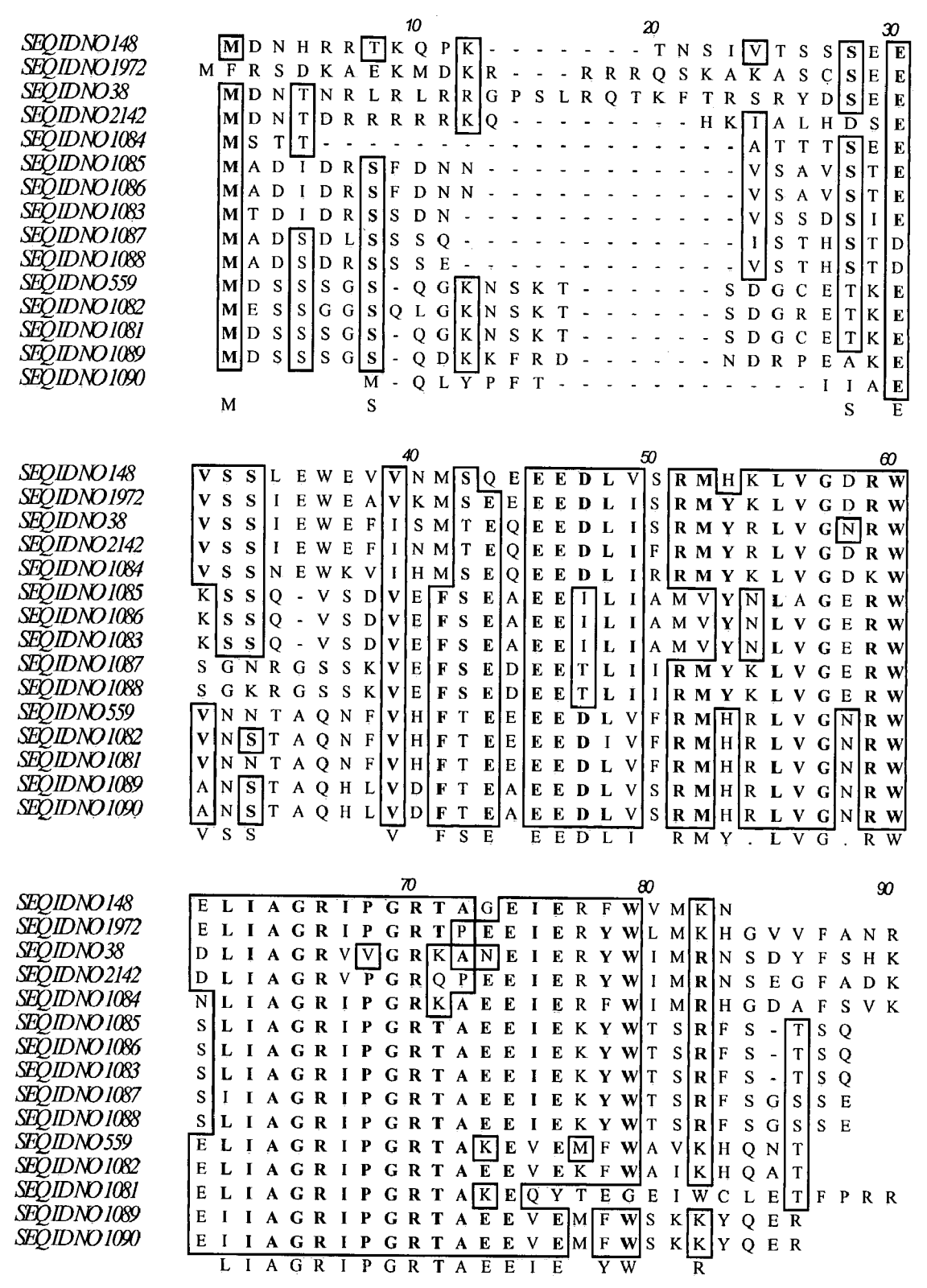

"Alignment" refers to a number of DNA or amino acid sequences aligned by lengthwise comparison so that components in common (i.e., nucleotide bases or amino acid residues) may be readily and graphically identified. The number of components in common is related to the homology or identity between the sequences. Alignments such as those of FIG. 3, 4 or 5 may be used to identify "conserved domains" and relatedness within these domains. An alignment may suitably be determined by means of computer programs known in the art, such as MacVector (1999) (Accelrys, Inc., San Diego, Calif.).

The terms "highly stringent" or "highly stringent condition" refer to conditions that permit hybridization of DNA strands whose sequences are highly complementary, wherein these same conditions exclude hybridization of significantly mismatched DNAS. Polynucleotide sequences capable of hybridizing under stringent conditions with the polynucleotides of the present invention may be, for example, variants of the disclosed polynucleotide sequences, including allelic or splice variants, or sequences that encode orthologs or paralogs of presently disclosed polypeptides. Nucleic acid hybridization methods are disclosed in detail by Kashima et al. (1985) *Nature* 313:402-404, and Sambrook et al. (1989) *Molecular Cloning: A Laboratory Manual,* 2nd Ed., Cold Spring Harbor Laboratory, Cold Spring Harbor, N.Y. ("Sambrook"); and by Haymes et al., "Nucleic Acid Hybridization: A Practical Approach", IRL Press, Washington, D.C. (1985), which references are incorporated herein by reference.

In general, stringency is determined by the temperature, ionic strength, and concentration of denaturing agents (e.g., formamide) used in a hybridization and washing procedure (for a more detailed description of establishing and determining stringency, see below). The degree to which two nucleic acids hybridize under various conditions of stringency is correlated with the extent of their similarity. Thus, similar nucleic acid sequences from a variety of sources, such as within a plant's genome (as in the case of paralogs) or from another plant (as in the case of orthologs) that may perform similar functions can be isolated on the basis of their ability to hybridize with known transcription factor sequences. Numerous variations are possible in the conditions and means by which nucleic acid hybridization can be performed to isolate transcription factor sequences having similarity to transcription factor sequences known in the art and are not limited to those explicitly disclosed herein. Such an approach may be used to isolate polynucleotide sequences having various degrees of similarity with disclosed transcription factor sequences, such as, for example, transcription factors having 60% identity, or more preferably greater than about 70% identity, most preferably 72% or greater identity with disclosed transcription factors.

The term "equivalog" describes members of a set of homologous proteins that are conserved with respect to function since their last common ancestor. Related proteins are grouped into equivalog families, and otherwise into protein families with other hierarchically defined homology types (definition provided the Institute for Genomic Research (TIGR) website).

The term "variant", as used herein, may refer to polynucleotides or polypeptides, that differ from the presently disclosed polynucleotides or polypeptides, respectively, in sequence from each other, and as set forth below.

With regard to polynucleotide variants, differences between presently disclosed polynucleotides and polynucleotide variants are limited so that the nucleotide sequences of the former and the latter are closely similar overall and, in many regions, identical. Due to the degeneracy of the genetic code, differences between the former and latter nucleotide sequences o may be silent (i.e., the amino acids encoded by the polynucleotide are the same, and the variant polynucleotide sequence encodes the same amino acid sequence as the presently disclosed polynucleotide. Variant nucleotide sequences may encode different amino acid sequences, in which case such nucleotide differences will result in amino acid substitutions, additions, deletions, insertions, truncations or fusions with respect to the similar disclosed polynucleotide sequences. These variations result in polynucleotide variants encoding polypeptides that share at least one functional characteristic. The degeneracy of the genetic code also dictates that many different variant polynucleotides can encode identical and/or substantially similar polypeptides in addition to those sequences illustrated in the Sequence Listing.

Also within the scope of the invention is a variant of a transcription factor nucleic acid listed in the Sequence Listing, that is, one having a sequence that differs from the one of the polynucleotide sequences in the Sequence Listing, or a complementary sequence, that encodes a functionally equivalent polypeptide (i.e., a polypeptide having some degree of equivalent or similar biological activity) but differs in sequence from the sequence in the Sequence Listing, due to degeneracy in the genetic code. Included within this definition are polymorphisms that may or may not be readily detectable using a particular oligonucleotide probe of the polynucleotide encoding polypeptide, and improper or unexpected hybridization to allelic variants, with a locus other than the normal chromosomal locus for the polynucleotide sequence encoding polypeptide.

"Allelic variant" or "polynucleotide allelic variant" refers to any of two or more alternative forms of a gene occupying the same chromosomal locus. Allelic variation arises naturally through mutation, and may result in phenotypic polymorphism within populations. Gene mutations may be "silent" or may encode polypeptides having altered amino acid sequence. "Allelic variant" and "polypeptide allelic variant" may also be used with respect to polypeptides, and in this case the term refer to a polypeptide encoded by an allelic variant of a gene.

"Splice variant" or "polynucleotide splice variant" as used herein refers to alternative forms of RNA transcribed from a gene. Splice variation naturally occurs as a result of alternative sites being spliced within a single transcribed RNA molecule or between separately transcribed RNA molecules, and may result in several different forms of mRNA transcribed from the same gene. This, splice variants may encode polypeptides having different amino acid sequences, which may or may not have similar functions in the organism. "Splice variant" or "polypeptide splice variant" may also refer to a polypeptide encoded by a splice variant of a transcribed mRNA.

As used herein, "polynucleotide variants" may also refer to polynucleotide sequences that encode paralogs and orthologs of the presently disclosed polypeptide sequences. "Polypeptide variants" may refer to polypeptide sequences that are paralogs and orthologs of the presently disclosed polypeptide sequences.

Differences between presently disclosed polypeptides and polypeptide variants are limited so that the sequences of the former and the latter are closely similar overall and, in many regions, identical. Presently disclosed polypeptide sequences and similar polypeptide variants may differ in amino acid sequence by one or more substitutions, additions, deletions, fusions and truncations, which may be present in any combination. These differences may produce silent changes and result in a functionally equivalent transcription factor. Thus, it will be readily appreciated by those of skill in the art, that any of a variety of polynucleotide sequences is capable of encoding the transcription factors and transcription factor homolog polypeptides of the invention. A polypeptide sequence variant may have "conservative" changes, wherein a substituted amino acid has similar structural or chemical properties. Deliberate amino acid substitutions may thus be made on the basis of similarity in polarity, charge, solubility, hydrophobicity, hydrophilicity, and/or the amphipathic nature of the residues, as long as the functional or biological activity of the transcription factor is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine (for more detail on conservative substitutions, see Table 2). More rarely, a variant may have "non-conservative" changes, e.g., replacement of a glycine with a tryptophan. Similar minor variations may also include amino acid deletions or insertions, or both. Related polypeptides may comprise, for example, additions and/or deletions of one or more N-linked or O-linked glycosylation sites, or an addition and/or a deletion of one or more cysteine residues. Guidance in determining which and how many amino acid residues may be substituted, inserted or deleted without abolishing functional or biological activity may be found using computer programs well known in the art, for example, DNASTAR software (see U.S. Pat. No. 5,840,544).

Figure 1:
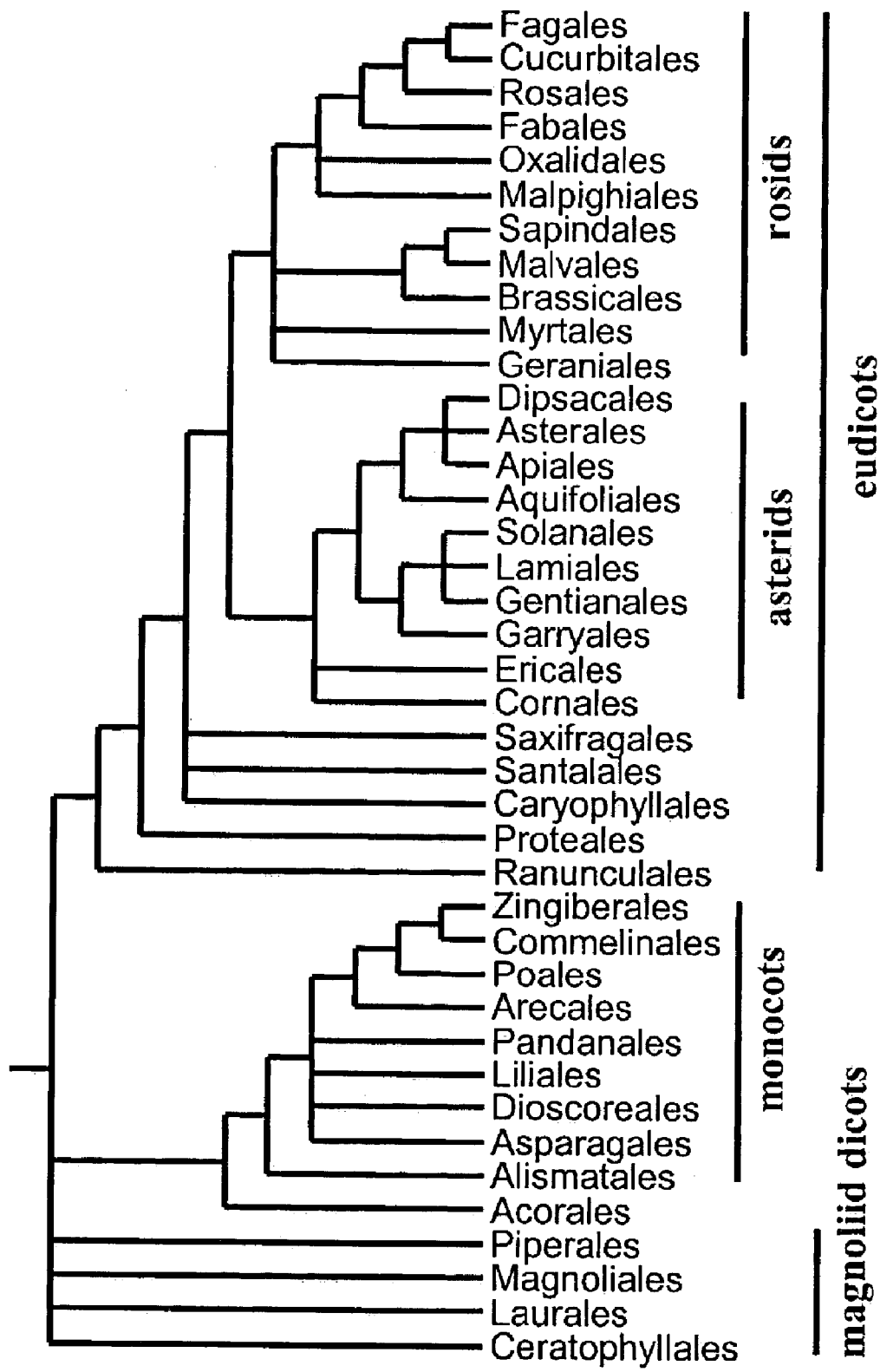
Figure 2:
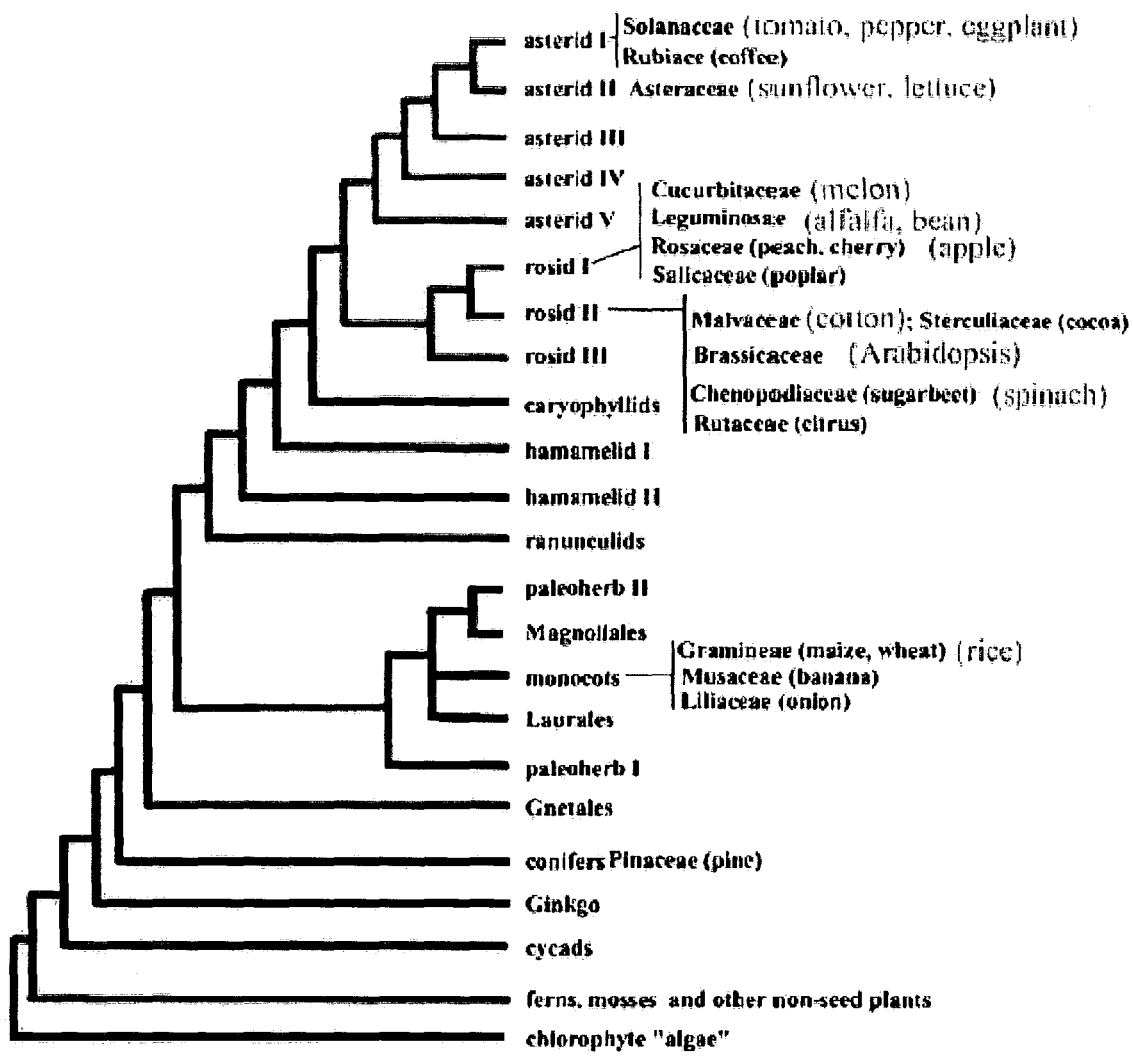

The term "plant" includes whole plants, shoot vegetative organs/structures (e.g., leaves, stems and tubers), roots, flowers and floral organs/structures (e.g., bracts, sepals, petals, stamens, carpels, anthers and ovules), seed (including embryo, endosperm, and seed coat) and fruit (the mature ovary), plant tissue (e.g., vascular tissue, ground tissue, and the like) and cells (e.g., guard cells, egg cells, and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, horsetails, psilophytes, lycophytes, bryophytes, and multicellular algae. (See for example, FIG. 1, adapted from Daly et al. (2001) *Plant Physiol.* 127: 1328-1333; FIG. 2, adapted from Ku et al. (2000) *Proc. Natl. Acad. Sci.* 97: 9121-9126; and see also Tudge, in *The Variety of Life*, Oxford University Press, New York, N.Y. (2000) pp. 547-606).

A "transgenic plant" refers to a plant that contains genetic material not found in a wild-type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic plant may contain an expression vector or cassette. The expression cassette typically comprises a polypeptide-encoding sequence operably linked (i.e., under regulatory control of) to appropriate inducible or constitutive regulatory sequences that allow for the expression of polypeptide. The expression cassette can be introduced into a plant by transformation or by breeding after transformation of a parent plant. A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell.

"Fragment", with respect to a polynucleotide, refers to a clone or any part of a polynucleotide molecule that retains a usable, functional characteristic. Useful fragments include oligonucleotides and polynucleotides that may be used in hybridization or amplification technologies or in the regulation of replication, transcription or translation. A polynucleotide fragment" refers to any subsequence of a polynucleotide, typically, of at least about 9 consecutive nucleotides, preferably at least about 30 nucleotides, more preferably at least about 50 nucleotides, of any of the sequences provided herein. Exemplary polynucleotide fragments are the first sixty consecutive nucleotides of the transcription factor polynucleotides listed in the Sequence Listing. Exemplary fragments also include fragments that comprise a region that encodes a conserved domain of a transcription factor.

Fragments may also include subsequences of polypeptides and protein molecules, or a subsequence of the polypeptide. Fragments may have uses in that they may have antigenic potential. In some cases, the fragment or domain is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as 3 amino acids to the full length of the intact polypeptide, but are preferably at least about 30 amino acids in length and more preferably at least about 60 amino acids in length. Exemplary polypeptide fragments are the first twenty consecutive amino acids of a mammalian protein encoded by are the first twenty consecutive amino acids of the transcription factor polypeptides listed in the Sequence Listing. Exemplary fragments also include fragments that comprise a conserved domain of a transcription factor, for example, amino acid residues 27-63 of G682 (SEQ ID NO: 468), as noted in Table 5.

The invention also encompasses production of DNA sequences that encode transcription factors and transcription factor derivatives, or fragments thereof, entirely by synthetic chemistry. After production, the synthetic sequence may be inserted into any of the many available expression vectors and cell systems using reagents well known in the art. Moreover, synthetic chemistry may be used to introduce mutations into a sequence encoding transcription factors or any fragment thereof.

A "conserved domain" or "conserved region" as used herein refers to a region in heterologous polynucleotide or polypeptide sequences where there is a relatively high degree of sequence identity between the distinct sequences. With respect to polynucleotides encoding presently disclosed transcription factors, a conserved region is preferably at least 10 base pairs (bp) in length.

A "conserved domain", with respect to presently disclosed polypeptides refers to a domain within a transcription factor family that exhibits a higher degree of sequence homology, such as at least 26% sequence similarity, at least 16% sequence identity, preferably at least 40% sequence identity, preferably at least 65% sequence identity including conservative substitutions, and more preferably at least 80% sequence identity, and even more preferably at least 85%, or at least about 86%, or at least about 87%, or at least about 88%, or at least about 90%, or at least about 95%, or at least about 98% amino acid residue sequence identity of a polypeptide of consecutive amino acid residues. A fragment or domain can be referred to as outside a conserved domain, outside a consensus sequence, or outside a consensus DNA-binding site that is known to exist or that exists for a particular transcription factor class, family, or subfamily. In this case, the fragment or domain will not include the exact amino acids of a consensus sequence or consensus DNA-binding site of a transcription factor class, family or subfamily, or the exact amino acids of a particular transcription factor consensus sequence or consensus DNA-binding site. Furthermore, a particular fragment, region, or domain of a polypeptide, or a polynucleotide encoding a polypeptide, can be "outside a conserved domain" if all the amino acids of the fragment, region, or domain fall outside of a defined conserved domain(s) for a polypeptide or protein. Sequences having lesser degrees of identity but comparable biological activity are considered to be equivalents.

As one of ordinary skill in the art recognizes, conserved domains may be identified as regions or domains of identity to a specific consensus sequence (see, for example, Riechmann et al. (2000) supra). Thus, by using alignment methods well known in the art, the conserved domains of the plant transcription factors for each of the following may be determined: the AP2 (APETALA2) domain transcription factor family (Riechmann and Meyerowitz (1998) supra; the MYB transcription factor family (ENBib; Martin and Paz-Ares (1997) supra); the MADS domain transcription factor family (Riechmann and Meyerowitz (1997) supra; Immink et al. (2003) supra); the WRKY protein family (Ishiguro and Nakamura (1994) supra); the ankyrin-repeat protein family (Zhang et al. (1992) supra); the zinc finger protein (Z) family (Klug and Schwabe (1995) supra; Takatsuji (1998) supra); the homeobox (HB) protein family (Buerglin (1994) supra); the CAAT-element binding proteins (Forsburg and Guarente (1989) supra); the squamosa promoter binding proteins (SPB) (Klein et al. (1996) supra); the NAM protein family (Souer et al. (1996) supra); the IAA/AUX proteins (Abel et al. (1995) supra); the HLH/MYC protein family (Littlewood et al. (1994) supra); the DNA-binding protein (DBP) family (Tucker et al. (1994) supra); the bZIP family of transcription factors (Foster et al. (1994) supra); the Box P-binding protein (the BPF-1) family (da Costa e Silva et al. (1993) supra); the high mobility group (HMG) family (Bustin and Reeves (1996) supra); the scarecrow (SCR) family (Di Laurenzio et al. (1996) supra); the GF14 family (Wu et al. (1997) supra); the polycomb (PCOMB) family (Goodrich et al. (1997) supra); the teosinte branched (TEO) family (Luo et al. (1996) supra); the ABI3 family (Giraudat et al. (1992) supra); the triple helix (TH) family (Dehesh et al. (1990) supra); the EIL family (Chao et al. (1997) Cell supra); the AT-HOOK family (Reeves and Nissen (1990 supra); the SIFA family (Zhou et al. (1995) supra); the bZIPT2 family (Lu and Ferl (1995) supra); the YABBY family (Bowman et al. (1999) supra); the PAZ family (Bohmert et al. (1998) supra); a family of miscellaneous (MISC) transcription factors including the DPBF family (Kim et al. (1997) supra) and the SPF1 family (Ishiguro and Nakamura (1994) supra); the GARP family (Hall et al. (1998) supra), the TUBBY family (Boggin et al. (1999) supra), the heat shock family (Wu (1995 supra), the ENBP family (Christiansen et al. (1996) supra), the RING-zinc family (Jensen et al. (1998) supra), the PDBP family (Janik et al. (1989) supra), the PCF family (Cubas et al. (1999) supra), the SRS(SHI-related) family (Fridborg et al. (1999) supra), the CPP (cysteine-rich polycomb-like) family (Cvitanich et al. (2000) supra), the ARF (auxin response factor) family (Ulmasov et al. (1999) supra), the SWI/SNF family (Collingwood et al. (1999) supra), the ACBF family (Seguin et al. (1997) supra), PCGL (CG-1 like) family (da Costa e Silva et al. (1994) supra) the ARID family (Vazquez et al. (1999) supra), the Jumonji family, (Balciunas et al. (2000) supra), the bZIP-NIN family (Schauser et al. (1999) supra), the E2F family Kaelin et al. (1992) supra) and the GRF-like family (Knaap et al (2000) supra).

The conserved domains for each of polypeptides of SEQ ID NO: 2N, wherein N=1-480, are listed in Table 5 as described in Example VII. Also, many of the polypeptides of Table 5 have conserved domains specifically indicated by start and stop sites. A comparison of the regions of the polypeptides in SEQ ID NO: 2N, wherein N=1-480, or of those in Table 5, allows one of skill in the art to identify conserved domain(s) for any of the polypeptides listed or referred to in this disclosure, including those in Tables 4-8.

The conserved domains for each of polypeptides of SEQ ID NOs: 568, 944, 946, 948, 1735, 1875, 1971, and 1973, are listed in Table 5 as described in Example VII. Also, many of the polypeptides of Table 5 have conserved domains specifically indicated by start and stop sites. A comparison of the regions of the polypeptides in SEQ ID NO: 568, SEQ ID NO: 944, SEQ ID NO: 946, SEQ ID NO: 948, SEQ ID NO: 1735, SEQ ID NO: 1875, SEQ ID NO: 1971, SEQ ID NO: 1973, SEQ ID NO: 1945, SEQ ID NO: 1947, SEQ ID NO: 1949, SEQ ID NO: 1951, SEQ ID NO: 1953, SEQ ID NO: 1955, SEQ ID NO: 1957, SEQ ID NO: 1959, SEQ ID NO: 1961, SEQ ID NO: 1963, SEQ ID NO: 1965, SEQ ID NO: 1967, or SEQ ID NO: 1969, or of those in Table 5, allows one of skill in the art to identify conserved domain(s) for any of the polypeptides listed or referred to in this disclosure, including those in Tables 4 8.

A gene is a functional unit of inheritance, and in physical terms is a particular segment or sequence of nucleotides along a molecule of DNA (or RNA, in the case of RNA viruses) involved in producing a polypeptide chain. The latter may be subjected to subsequent processing such as splicing and folding to obtain a functional protein or polypeptide. A gene may be isolated, partially isolated, or be found with an organism's genome. By way of example, a transcription factor gene encodes a transcription factor polypeptide, which may be functional or require processing to function as an initiator of transcription.

Operationally, genes may be defined by the cis-trans test, a genetic test that determines whether two mutations occur in the same gene and which may be used to determine the limits of the genetically active unit (Rieger et al. (1976) *Glossary of Genetics and Cytogenetics: Classical and Molecular*, 4th ed., Springer Verlag. Berlin). A gene generally includes regions preceding ("leaders"; upstream) and following ("trailers"; downstream) of the coding region. A gene may also include intervening, non-coded sequences, referred to as "introns", located between individual coding segments, referred to as "exons". Most genes have an associated promoter region, a regulatory sequence 5' of the transcription initiation codon (there are some genes that do not have an identifiable promoter). The function of a gene may also be regulated by enhancers, operators, and other regulatory elements.

A "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g. by measuring uptake of carbon dioxide, or by the observation of the expression level of a gene or genes, e.g., by employing Northern analysis, RT-PCR, microarray gene expression assays, or reporter gene expression systems, or by agricultural observations such as stress tolerance, yield, or pathogen tolerance. Any technique can be used to measure the amount of, comparative level of, or difference in any selected chemical compound or macromolecule in the transgenic plants, however.

"Trait modification" refers to a detectable difference in a characteristic in a plant ectopically expressing a polynucleotide or polypeptide of the present invention relative to a plant not doing so, such as a wild-type plant. In some cases, the trait modification can be evaluated quantitatively. For example, the trait modification can entail at least about a 2% increase or decrease in an observed trait (difference), at least a 5% difference, at least about a 10% difference, at least about a 20% difference, at least about a 30%, at least about at 50%, at least about a 70%, or at least about a 100%, or an even greater difference compared with a wild-type plant. It is known that there can be a natural variation in the modified trait. Therefore, the trait modification observed entails a change of the normal distribution of the trait in the plants compared with the distribution observed in wild-type plant.

"Wild type", as used herein, refers to a cell, tissue or plant that has not been genetically modified to knock out or overexpress one or more of the presently disclosed transcription factors. Wild-type cells, tissue or plants may be used as controls to compare levels of expression and the extent and nature of trait modification with cells, tissue or plants in which transcription factor expression is altered or ectopically expressed, e.g., in that it has been knocked out or overexpressed.

The term "transcript profile" refers to the expression levels of a set of genes in a cell in a particular state, particularly by comparison with the expression levels of that same set of genes in a cell of the same type in a reference state. For example, the transcript profile of a particular transcription factor in a suspension cell is the expression levels of a set of genes in a cell overexpressing that transcription factor compared with the expression levels of that same set of genes in a suspension cell that has normal levels of that transcription factor. The transcript profile can be presented as a list of those genes whose expression level is significantly different between the two treatments, and the difference ratios. Differences and similarities between expression levels may also be evaluated and calculated using statistical and clustering methods.

"Ectopic expression" or "altered expression" in reference to a polynucleotide indicates that the pattern of expression in, e.g., a transgenic plant or plant tissue, is different from the expression pattern in a wild-type plant or a reference plant of the same species. The pattern of expression may also be compared with a reference expression pattern in a wild-type plant of the same species. For example, the polynucleotide or polypeptide is expressed in a cell or tissue type other than a cell or tissue type in which the sequence is expressed in the wild-type plant, or by expression at a time other than at the time the sequence is expressed in the wild-type plant, or by a response to different inducible agents, such as hormones or environmental signals, or at different expression levels (either higher or lower) compared with those found in a wild-type plant. The term also refers to altered expression patterns that are produced by lowering the levels of expression to below the detection level or completely abolishing expression. The resulting expression pattern can be transient or stable, constitutive or inducible. In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "overexpression" as used herein refers to a greater expression level of a gene in a plant, plant cell or plant tissue, compared to expression in a wild-type plant, cell or tissue, at any developmental or temporal stage for the gene. Overexpression can occur when, for example, the genes encoding one or more transcription factors are under the control of a strong expression signal, such as one of the promoters described herein (e.g., the cauliflower mosaic virus 35S transcription initiation region). Overexpression may occur throughout a plant or in specific tissues of the plant, depending on the promoter used, as described below.

Overexpression may take place in plant cells normally lacking expression of polypeptides functionally equivalent or identical to the present transcription factors. Overexpression may also occur in plant cells where endogenous expression of the present transcription factors or functionally equivalent molecules normally occurs, but such normal expression is at a lower level. Overexpression thus results in a greater than normal production, or "overproduction" of the transcription factor in the plant, cell or tissue.

The term "phase change" refers to a plant's progression from embryo to adult, and, by some definitions, the transition wherein flowering plants gain reproductive competency. It is believed that phase change occurs either after a certain number of cell divisions in the shoot apex of a developing plant, or when the shoot apex achieves a particular distance from the roots. Thus, altering the timing of phase changes may affect a plant's size, which, in turn, may affect yield and biomass.

Traits That May Be Modified in Overexpressing or Knockout Plants

Trait modifications of particular interest include those to seed (such as embryo or endosperm), fruit, root, flower, leaf, stem, shoot, seedling or the like, including: enhanced tolerance to environmental conditions including freezing, chilling, heat, drought, water saturation, radiation and ozone; improved tolerance to microbial, fungal or viral diseases; improved tolerance to pest infestations, including insects, nematodes, mollicutes, parasitic higher plants or the like; decreased herbicide sensitivity; improved tolerance of heavy metals or enhanced ability to take up heavy metals; improved growth under poor photoconditions (e.g., low light and/or short day length), or changes in expression levels of genes of interest. Other phenotype that can be modified relate to the production of plant metabolites, such as variations in the production of taxol, tocopherol, tocotrienol, sterols, phytosterols, vitamins, wax monomers, anti-oxidants, amino acids, lignins, cellulose, tannins, prenyllipids (such as chlorophylls and carotenoids), glucosinolates, and terpenoids, enhanced or compositionally altered protein or oil production (especially in seeds), or modified sugar (insoluble or soluble) and/or starch composition. Physical plant characteristics that can be modified include cell development (such as the number of trichomes), fruit and seed size and number, yields of plant parts such as stems, leaves, inflorescences, and roots, the stability of the seeds during storage, characteristics of the seed pod (e.g., susceptibility to shattering), root hair length and quantity, internode distances, or the quality of seed coat. Plant growth characteristics that can be modified include growth rate, germination rate of seeds, vigor of plants and seedlings, leaf and flower senescence, male sterility, apomixis, flowering time, flower abscission, rate of nitrogen uptake, osmotic sensitivity to soluble sugar concentrations, biomass or transpiration characteristics, as well as plant architecture characteristics such as apical dominance, branching patterns, number of organs, organ identity, organ shape or size.

Transcription Factors Modify Expression of Endogenous Genes

Expression of genes that encode transcription factors that modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997) *Genes and Development* 11: 3194-3205, and Peng et al. (1999) *Nature* 400: 256-261. In addition, many others have demonstrated that an *Arabidopsis* transcription factor expressed in an exogenous plant species elicits the same or very similar phenotypic response. See, for example, Fu et al. (2001) *Plant Cell* 13: 1791-1802; Nandi et al. (2000, *Curr. Biol.* 10: 215-218; Coupland (1995) *Nature* 377: 482-483; and Weigel and Nilsson (1995) *Nature* 377: 482-500.

In another example, Mandel et al. (1992) *Cell* 71-133-143 and Suzuki et al. (2001) *Plant J.* 28: 409-418, teach that a transcription factor expressed in another plant species elicits the same or very similar phenotypic response of the endogenous sequence, as often predicted in earlier studies of *Arabidopsis* transcription factors in *Arabidopsis* (see Mandel et al. (1992) supra; Suzuki et al. (2001) supra).

Other examples include Muller et al. (2001) *Plant J.* 28: 169-179; Kim et al. (2001) *Plant J.* 25: 247-259; Kyozuka and Shimamoto (2002) *Plant Cell Physiol.* 43: 130-135; Boss and Thomas (2002) *Nature* 416: 847-850; He et al. (2000) *Transgenic Res.* 9: 223-227; and Robson et al. (2001) *Plant J.* 28: 619-631.

In yet another example, Gilmour et al. (1998) *Plant J.* 16: 433-442, teach an *Arabidopsis* AP2 transcription factor, CBF1 (SEQ ID NO: 44), which, when overexpressed in transgenic plants, increases plant freezing tolerance. Jaglo et al. (2001) *Plant Physiol.* 127: 910-917, further identified sequences in *Brassica napus* which encode CBF-like genes and that transcripts for these genes accumulated rapidly in response to low temperature. Transcripts encoding CBF-like proteins were also found to accumulate rapidly in response to low temperature in wheat, as well as in tomato. An alignment of the CBF proteins from *Arabidopsis, B. napus*, wheat, rye, and tomato revealed the presence of conserved consecutive amino acid residues, PKK/RPAGRxKFx-ETRHP and DSAWR, that bracket the AP2/EREBP DNA binding domains of the proteins and distinguish them from other members of the AP2/EREBP protein family. (See Jaglo et al. supra).

Gao et al. (2002) *Plant Molec. Biol.* 49: 459-471) have recently described four CBF transcription factors from *Brassica napus*: BNCBFs 5, 7, 16 and 17. They note that the first three CBFs (GenBank Accession Numbers AAM18958, AAM18959, and AAM18960, respectively) are very similar to *Arabidopsis* CBF1, whereas BNCBF17 (GenBank Accession Number AAM18961) is similar but contains two extra regions of 16 and 21 amino acids in its acidic activation domain. All four *B. napus* CBFs accumulate in leaves of the plants after cold-treatment, and BNCBFs 5, 7, 16 accumulated after salt stress treatment. The authors concluded that these BNCBFs likely function in low-temperature responses in *B. napus*.

In a functional study of CBF genes, Hsieh et al. ((2002) *Plant Physiol.* 129: 1086-1094) found that heterologous expression of *Arabidopsis* CBF1 in tomato plants confers increased tolerance to chilling and considerable tolerance to oxidative stress, which suggested to the authors that ectopic *Arabidopsis* CBF1 expression may induce several tomato stress responsive genes to protect the plants.

Polypeptides and Polynucleotides of the Invention

The present invention provides, among other things, transcription factors (TFs), and transcription factor homolog polypeptides, and isolated or recombinant polynucleotides encoding the polypeptides, or novel sequence variant polypeptides or polynucleotides encoding novel variants of transcription factors derived from the specific sequences provided here. These polypeptides and polynucleotides may be employed to modify a plant's characteristics.

Exemplary polynucleotides encoding the polypeptides of the invention were identified in the *Arabidopsis thaliana* GenBank database using publicly available sequence analysis programs and parameters. Sequences initially identified were then further characterized to identify sequences comprising specified sequence strings corresponding to sequence motifs present in families of known transcription factors. In addition, further exemplary polynucleotides encoding the polypeptides of the invention were identified in the plant GenBank database using publicly available sequence analysis programs and parameters. Sequences initially identified were then further characterized to identify sequences comprising specified sequence strings corresponding to sequence motifs present in families of known transcription factors. Polynucleotide sequences meeting such criteria were confirmed as transcription factors.

Additional polynucleotides of the invention were identified by screening *Arabidopsis thaliana* and/or other plant cDNA libraries with probes corresponding to known transcription factors under low stringency hybridization conditions. Additional sequences, including full length coding sequences were subsequently recovered by the rapid amplification of cDNA ends (RACE) procedure, using a commercially available kit according to the manufacturer's instructions. Where necessary, multiple rounds of RACE are performed to isolate 5' and 3' ends. The full-length cDNA was then recovered by a routine end-to-end polymerase chain reaction (PCR) using primers specific to the isolated 5' and 3' ends. Exemplary sequences are provided in the Sequence Listing.

The polynucleotides of the invention can be or were ectopically expressed in overexpressor or knockout plants and the changes in the characteristic(s) or trait(s) of the plants observed. Therefore, the polynucleotides and polypeptides can be employed to improve the characteristics of plants.

The polynucleotides of the invention can be or were ectopically expressed in overexpressor plant cells and the changes in the expression levels of a number of genes, polynucleotides, and/or proteins of the plant cells observed. Therefore, the polynucleotides and polypeptides can be employed to change expression levels of a genes, polynucleotides, and/or proteins of plants.

Mads Affecting Flowering (MAF) Transcription Factor Gene Family Polynucleotide and Polypeptide Sequences Examination of the *Arabidopsis* genome sequence has revealed the existence of five MADS box genes which encode proteins that are highly related to FLC (Alvarez-Buylla et al. (2000a) *Proc. Natl. Acad. Sci.* 97: 5328-5333; Ratcliffe et al. (2001) *Plant Physiol.* 126: 122-132). The first of the genes to be analyzed, MADS AFFECTING FLOWERING1, MAF1 (which has also been referred to as FLOWERING LOCUS M, FLM, Scortecci et al. (2001) *Plant J.* 26: 229-236, and as AGL27, Alvarez-Buylla et al. (2000a) supra), was shown to be a floral repressor (Ratcliffe et al. (2001) supra; Scortecci et al. (2001) supra). MAF1 expression shows a less clear-cut association with the vernalization response than that of FLC, and the gene potentially acts downstream or independently of FLC transcription (Ratcliffe et al. (2001) supra). The functions of four FLC related genes were analyzed and it was demonstrated that they influence the timing of flowering. In particular, a mechanism that prevents *Arabidopsis* plants becoming vernalized by short periods of cold was revealed.

The *Arabidopsis* genome contains four genes, which are highly related to FLC and MAF1, arranged in a tight cluster at the bottom of chromosome 5 (Ratcliffe et. al. (2001) supra). The gene cluster occupies approximately 22 kb and comprises At5g65050 (which corresponds to AGL31; Alvarez-Buylla et al. (2000a) supra), At5g65060, At5g65070, and At5g65080. As shown in FIG. 6, an alignment of the full-length protein sequences of SEQ ID NO: 1875 (FLC), SEQ ID NO: 1735 (MAF1), SEQ ID NO: 568 (MAF2), SEQ ID NO: 944 (MAF3), SEQ ID NO: 946 (MAF4), and SEQ ID NO: 948 (MAF5), shows that the protein sequences share a large degree of identity (residue identity denoted by asterisk: "*"; residue similarity denoted by period: ".") across the entire sequence, depending upon the pair-wise combination. This similarity suggested that the polynucleotide sequences and the encoded polypeptide sequences of MAF2, MAF3, MAF4, and MAF5 are MADS-domain family transcription factors which have functions related to those of MAF1 and FLC in the regulation of flowering time (Riechmann and Meyerowitz (1997) supra).

MAF polypeptide sequences from *Arabidopsis* and soy were aligned using the CLUSTAL W(1.4) multiple sequence alignment algorithm (MACVETOR) to create pairwise alignments. The results are shown in Table 14.

As shown in Table 14, SEQ ID NO: 568 (MAF2; G859) has 61% identity and 74% similarity to SEQ ID NO: 1875 (FLC: G1759), 76% identity and 85% similarity to SEQ ID NO: 1735 (MAF1: G157), 87% identity and 90% similarity to SEQ ID NO: 944 (MAF3: G1842), 64% identity and 77% similarity to SEQ ID NO: 946 (MAF4: G1843), 63% identity and 79% similarity to SEQ ID NO: 948 (MAF5: G1844), 34% identity and 52% similarity to SEQ ID NO: 1971 (SOY1: SOY MADS1), and 34% identity and 53% similarity to SEQ ID NO: 1973 (SOY3: SOY MADS3), respectively.

In addition, Table 14 shows that SEQ ID NO: 944 (MAF3; G1842) has 60% identity and 75% similarity to SEQ ID NO: 1875 (FLC: G1759), 78% identity and 87% similarity to SEQ ID NO: 1735 (MAF1: G157), 87% identity and 90% similarity to SEQ ID NO: 568 (MAF2: G859), 64% identity and 78% similarity to SEQ ID NO: 946 (MAF4: G1843), 65% identity and 81% similarity to SEQ ID NO: 948 (MAF5: G1844), 32% identity and 43% similarity to SEQ ID NO: 1971 (SOY1: SOY MADS1), and 34% identity and 56% similarity to SEQ ID NO: 1973 (SOY3: SOY MADS3), respectively.

In addition, Table 14 shows that SEQ ID NO: 946 (MAF4; G1843) has 57% identity and 74% similarity to SEQ ID NO: 1875 (FLC: G1759), 65% identity and 81% similarity to SEQ ID NO: 1735 (MAF1: G157), 64% identity and 77% similarity to SEQ ID NO: 568 (MAF2: G859), 64% identity and 78% similarity to SEQ ID NO: 944 (MAF3: G1842), 71% identity and 83% similarity to SEQ ID NO: 948 (MAF5: G1844), 35% identity and 53% similarity to SEQ ID NO: 1971 (SOY1: SOY MADS1), and 36% identity and 55% similarity to SEQ ID NO: 1973 (SOY3: SOY MADS3), respectively.

In addition, Table 14 shows that SEQ ID NO: 948 (MAF5; G1844) has 53% identity and 73% similarity to SEQ ID NO: 1875 (FLC: G1759), 63% identity and 80% similarity to SEQ ID NO: 1735 (MAF1: G157), 63% identity and 79% similarity to SEQ ID NO: 568 (MAF2: G859), 65% identity and 81% similarity to SEQ ID NO: 944 (MAF3: G1842), 71% identity and 83% similarity to SEQ ID NO: 946 (MAF4: G1843), 36% identity and 54% similarity to SEQ ID NO: 1971 (SOY1: SOY MADS1), and 36% identity and 56% similarity to SEQ ID NO: 1973 (SOY3: SOY MADS3), respectively.

The results show that a polypeptide of 186 amino acid residues (the length of the shortest of the MAF sequences; Soy 1. SOY MADS1; SEQ ID NO: 1971) shows at least 32% identity over the complete polypeptide sequence compared with SEQ ID NO: 944 (MAF3: G1842).

FIGS. 7A and 7B shows the alignment between the *Arabidopsis* and soy MAF polypeptide sequences produced using the CLASTAL W(1.4) multiple sequence alignment algorithm.

As shown in FIGS. 7A and 7B, a conserved domain of SEQ ID NO: 568 (MAF2, G859.pep; amino acid residues Gly2 through Ser57) has amino acid sequence identity with a conserved domain of SEQ ID NO: 1875 (FLC; G1759.pep; 83.9%), SEQ ID NO: 1735 (MAF1, G157.pep; 87.5%), SEQ ID NO: 944 (MAF3, G1842.pep; 92.9%), SEQ ID NO: 946 (MAF4, G1843.pep; 76.8%), SEQ ID NO: 948 (MAF5, G1844.pep; 78.6%), SEQ ID NO:14 (SOY MADS1, Soy1.pep; 69.6%), and SEQ ID NO: 1973 (SOY MADS3, Soy3.pep; 66.1%). SOY MADS1 (SEQ ID NO:14) and SOY MADS3 (SEQ ID NO:16) are therefore soy (Glycine max) MAF homologs of the *Arabidopsis* SEQ ID NOs: 568, 944, 946, 948, 1735, and 1875.

The conserved domain of MAF transcription factors exemplified by amino acid residues Gly2 through Ser57 of SEQ ID NO: 568 as shown in FIG. 7A is defined by the consensus amino acid residue sequence GX1X1X1X2EIKRIENKSXRQX2TFXKRRXGLXXKAR X3LSX2LCXXXX2AX2XX2XSXX4GX1LYXX, wherein X1 represent a basic residue such as K or R, X2 represent an aliphatic residue such as V, I, L, A, or G, X3 represents an acid or amide residue such as E or Q, or D or N, X4 represents an aliphatic hydroxyl residue such as T or S, and wherein X represents any amino acid residue. An exemplary consensus sequence is SEQ ID NO: 2010.

As also shown in FIG. 7A, an additional conserved domain (amino acid residues Ala58 through Gln74) flanks a region C-terminal to the conserved domain of amino acid residues Gly2 through Ser57 of SEQ ID NO: 568. This conserved domain of SEQ ID NO: 568 (MAF2, G859.pep; amino acid residues Ala58 through Gln74) has amino acid sequence identity with a conserved domain of SEQ ID NO: 1875 (FLC; G1759.pep; 58.8%), SEQ ID NO: 1735 (MAF1, G157.pep; 76.5%), SEQ ID NO: 944 (MAF3, G1842.pep; 100%), SEQ ID NO: 946 (MAF4, G1843.pep; 59.2%), SEQ ID NO: 948 (MAF5, G1844.pep; 58.8%), SEQ ID NO: 1971 (SOY MADS1, Soy1.pep; 23.5%), and SEQ ID NO: 1973 (SOY MADS3, Soy3.pep; 23.5%).

As also shown in FIG. 7A, the larger conserved domain (amino acid residues Gly2 through Gln74) of SEQ ID NO: 568. This conserved domain of SEQ ID NO: 568 (MAF2, G859.pep; amino acid residues Gly2 through Gln74) has amino acid sequence identity with a conserved domain of SEQ ID NO: 1875 (FLC; G1759.pep; 78.1%), SEQ ID NO:

1735 (MAF1, G157.pep; 84.9%), SEQ ID NO: 944 (MAF3, G1842.pep; 93.2%), SEQ ID NO: 946 (MAF4, G1843.pep; 72.6%), SEQ ID NO: 948 (MAF5, G1844.pep; 72.6%), SEQ ID NO: 1971 (SOY MADS1, Soy1.pep; 65.8%), and SEQ ID NO: 1973 (SOY MADS3, Soy3.pep; 54.8%).

The larger conserved domain shown in FIG. 7A is defined by the consensus amino acid residue sequence GX1X1X1X2EIKRIENKSXRQX2TFXKRRXGLXXKARX3LSX2 LCXXXX2AX2XX2XSXX4GX1LYXXXXGD XXXXX2X2XXX5XXXX, wherein X1 represent a basic residue such as K or R, X2 represent an aliphatic residue such as V, I, L, A, or G, X3 represents an acid or amide residue such as E or Q, or D or N, X4 represents an aliphatic hydroxyl residue such as T or S, X5 represents an aromatic residue such as F or Y, and wherein X represents any amino acid residue. An exemplary consensus sequence is SEQ ID NO: 2011.

In addition, FIG. 7 shows that FLC, MAF1, MAF2, MAF3, MAF4, MAF5, SOY MADS1, and SOY MADS3 share three potential protein kinase C phosphorylation sites at amino acid residues Ser15, Ser22, and Ser51; two potential protein kinase A phosphorylation sites at amino acid residues Thr20 and Ser36; a potential CaMPKII phosphorylation site at amino acid residue Ser36; FLC, MAF1, MAF2, MAF3, MAF4, and MAF5 share three potential protein kinase casein kinase I phosphorylation sites at amino acid residues Y55, S116, and S129; and MAF1, MAF2, MAF3, and MAF5 share three potential protein kinase casein kinase II phosphorylation sites at amino acid residue S57, S59, and S19.

Allelic variants of MAF2-5 are represented by SEQ ID NOs: 567, 1944, 1946, 1948, and 1950 (MAF2 variants); SEQ ID NOs: 943, 1952, 1954, 1956, and 1958 (MAF3 variants); SEQ ID NOs: 945, 1960, 1962, 1964, and 1966 (MAF4 variants); and SEQ ID NOs: 947 and 1968 (MAF5 variants).

FIG. 8 shows the effects of vernalization on expression of MAF2-5 (SEQ ID NOs: 567, 943, 945, and 947) in different genetic backgrounds (*Arabidopsis* accessions). FIG. 9 shows a schematic diagram summarizing the responses of FLC and MAF1-5 to vernalization, and their potential effects on the floral transition. Arrows indicate positive interactions, blunt-ended lines denote inhibition.

MAF2-5 (SEQ ID NOs: 567, 943, 945, and 947; encoding SEQ ID NOs: 568, 944, 946, and 948, respectively) are involved in regulation of the vernalization response. MAF2 (SEQ ID NO: 567) encodes a floral repressor (SEQ ID NO: 568), which participates in a previously unrecognized mechanism that prevents the plants being vernalized by short cold periods. MAF3 and MAF4 (SEQ ID NO: 943 and SEQ ID NO: 945, encoding SEQ ID NOs: 944 and 946, respectively) may have parallel roles to FLC in the maintenance of a vernalization requirement. MAF5 (SEQ ID NO: 947; encoding SEQ ID NO: 948), is activated by vernalization, and could therefore have an opposing role to FLC and MAF1-4.

Therefore, it was concluded that MAF2 (SEQ ID NO: 567; encoding SEQ ID NO: 568) compensates for the decrease in FLC levels that occurs following short cold spells, and thereby prevents a flowering response being triggered. In some environments, promotion of flowering in response to a few days of cold weather might be advantageous. However, winter annual strains of *Arabidopsis* from northern latitudes have evolved to over-winter vegetatively and commence flowering in the spring only after a sustained period of low temperature (Reeves and Coupland (2000) supra; Michaels and Amasino (2000) supra). Individual plants without MAF2-like activity would be more susceptible to transient cold spells in the autumn, when conditions for seed set are unfavorable. Thus, there would be likely a selective advantage for a plant to evolve MAF2 function. It would be advantageous for a plant that does not have an endogenous MAF2-like activity to be bred and/or transformed to have MAF2-like (MAF) activity in order to be less susceptible to transient cold.

The polynucleotide sequences of SEQ ID NOs: 1970, and 1972 may be altered such that amino acid sequences SEQ ID NOs: 1971 and 1973 (SOY MADS1 and SOY MADS3, respectively) have conservative and non-conservative similar amino acid substitutions to create sequences which can have MAF (such as MAF2-like) activity.

In general, a wide variety of applications exist for systems that either lengthen or shorten the time to flowering.

Accelerated Flowering:

Most modern crop varieties are the result of extensive breeding programs. Many generations of backcrossing can be required to introduce desired traits. Transgenic plants comprising systems that accelerate flowering could have valuable applications in such programs. A faster generation time can allow additional harvests of a crop to be made within a given growing season. With the advent of transformation systems for tree species such as oil palm and Eucalyptus, forest biotechnology is a growing area of interest. Acceleration of flowering, again, can reduce generation times and make breeding programs feasible which would otherwise be impossible. That this is a real possibility has already been demonstrated in aspen, a tree species that usually takes 8-20 years to flower. Transgenic aspen that over-express the *Arabidopsis* LFY gene flower after only 5 months. The flowers produced by these young aspen plants, however, were sterile (Weigel and Nilsson (1995) *Nature* 377: 495-500).

Delayed Flowering:

In species such as sugarbeet, where the vegetative parts of the plants constitute the crop and the reproductive tissues are discarded, it would be advantageous to delay or prevent flowering. Extending vegetative development could bring about large increases in yields.

Inducible Flowering:

By regulating the expression of flowering-time controlling genes, using inducible promoters, flowering could potentially be triggered as desired (for example, by application of a chemical inducer). This would allow, for example, flowering to be synchronized across a crop and facilitate more efficient harvesting. Such inducible systems could be used to tune the flowering of crop varieties to different latitudes. At present, species such as soybean and cotton are available as a series of maturity groups that are suitable for different latitudes on the basis of their flowering time (which is governed by day-length). A system in which flowering could be chemically controlled would allow a single high-yielding northern maturity group to be grown at any latitude. In southern regions such plants could be grown for longer, thereby increasing yields, before flowering was induced. In more northern areas, the induction would be used to ensure that the crop flowers prior to the first winter frosts. Currently, the existence of a series of maturity groups for different latitudes represents a major barrier to the introduction of new valuable traits. Any trait (e.g. disease resistance, vernalization response) has to be bred into each of the different maturity groups separately; a laborious and costly exercise. The availability of single strain, which could be grown at any latitude, would therefore greatly increase the potential for introducing new traits to crop species such as soybean and cotton.

Producing Polypeptides

The polynucleotides of the invention include sequences that encode transcription factors and transcription factor homolog polypeptides and sequences complementary thereto, as well as unique fragments of coding sequence, or sequence complementary thereto. Such polynucleotides can be, e.g., DNA or RNA, e.g., mRNA, cRNA, synthetic RNA, genomic DNA, cDNA synthetic DNA, oligonucleotides, etc. The polynucleotides are either double-stranded or single-stranded, and include either, or both sense (i.e., coding) sequences and antisense (i.e., non-coding, complementary) sequences. The polynucleotides include the coding sequence of a transcription factor, or transcription factor homolog polypeptide, in isolation, in combination with additional coding sequences (e.g., a purification tag, a localization signal, as a fusion-protein, as a pre-protein, or the like), in combination with non-coding sequences (e.g., introns or inteins, regulatory elements such as promoters, enhancers, terminators, and the like), and/or in a vector or host environment in which the polynucleotide encoding a transcription factor or transcription factor homolog polypeptide is an endogenous or exogenous gene.

A variety of methods exist for producing the polynucleotides of the invention. Procedures for identifying and isolating DNA clones are well known to those of skill in the art, and are described in, e.g., Berger and Kimmel, *Guide to Molecular Cloning Techniques, Methods in Enzymology*, vol. 152 Academic Press, Inc., San Diego, Calif. ("Berger"); Sambrook et al. (1989) *Molecular Cloning—A Laboratory Manual* (2nd Ed.), Vol. 1-3, Cold Spring Harbor Laboratory, Cold Spring Harbor, N.Y., and *Current Protocols in Molecular Biology*, Ausubel et al. eds., Current Protocols, a joint venture between Greene Publishing Associates, Inc. and John Wiley & Sons, Inc., (supplemented through 2000) ("Ausubel").

Alternatively, polynucleotides of the invention, can be produced by a variety of in vitro amplification methods adapted to the present invention by appropriate selection of specific or degenerate primers. Examples of protocols sufficient to direct persons of skill through in vitro amplification methods, including the polymerase chain reaction (PCR) the ligase chain reaction (LCR), Q-beta-replicase amplification and other RNA polymerase mediated techniques (e.g., NASBA), e.g., for the production of the homologous nucleic acids of the invention are found in Berger (supra), Sambrook (supra), and Ausubel (supra), as well as Mullis et al. (1987) *PCR Protocols A Guide to Methods and Applications* (Innis et al. eds) Academic Press Inc. San Diego, Calif. (1990) (Innis). Improved methods for cloning in vitro amplified nucleic acids are described in Wallace et al. U.S. Pat. No. 5,426,039. Improved methods for amplifying large nucleic acids by PCR are summarized in Cheng et al. (1994) *Nature* 369: 684-685 and the references cited therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, e.g., Ausubel, Sambrook and Berger, all supra.

Alternatively, polynucleotides and oligonucleotides of the invention can be assembled from fragments produced by solid-phase synthesis methods. Typically, fragments of up to approximately 100 bases are individually synthesized and then enzymatically or chemically ligated to produce a desired sequence, e.g., a polynucleotide encoding all or part of a transcription factor. For example, chemical synthesis using the phosphoramidite method is described, e.g., by Beaucage et al. (1981) *Tetrahedron Letters* 22: 1859-1869; and Matthes et al. (1984) *EMBO J.* 3: 801-805. According to such methods, oligonucleotides are synthesized, purified, annealed to their complementary strand, ligated and then optionally cloned into suitable vectors. And if so desired, the polynucleotides and polypeptides of the invention can be custom ordered from any of a number of commercial suppliers.

Homologous Sequences

Sequences homologous, i.e., that share significant sequence identity or similarity, to those provided in the Sequence Listing, derived from *Arabidopsis thaliana* or from other plants of choice, are also an aspect of the invention. Homologous sequences can be derived from any plant including monocots and dicots and in particular agriculturally important plant species, including but not limited to, crops such as soybean, wheat, corn (maize), potato, cotton, rice, rape, oilseed rape (including canola), sunflower, alfalfa, clover, sugarcane, and turf; or fruits and vegetables, such as banana, blackberry, blueberry, strawberry, and raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, tomatillo, watermelon, rosaceous fruits (such as apple, peach, pear, cherry and plum) and vegetable brassicas (such as broccoli, cabbage, cauliflower, Brussels sprouts, and kohlrabi). Other crops, including fruits and vegetables, whose phenotype can be changed and which comprise homologous sequences include barley; rye; millet; sorghum; currant; avocado; citrus fruits such as oranges, lemons, grapefruit and tangerines, artichoke, cherries; nuts such as the walnut and peanut; endive; leek; roots such as arrowroot, beet, cassaya, turnip, radish, yam, and sweet potato; and beans. The homologous sequences may also be derived from woody species, such pine, poplar and eucalyptus, or mint or other labiates. In addition, homologous sequences may be derived from plants that are evolutionarily-related to crop plants, but which may not have yet been used as crop plants. Examples include deadly nightshade (*Atropa belladona*), related to tomato; jimson weed (*Datura strommium*), related to peyote; and teosinte (*Zea* species), related to corn (maize).

Orthologs and Paralogs

Homologous sequences as described above can comprise orthologous or paralogous sequences. Several different methods are known by those of skill in the art for identifying and defining these functionally homologous sequences. Three general methods for defining orthologs and paralogs are described; an ortholog or paralog, including equivalogs, may be identified by one or more of the methods described below.

Orthologs and paralogs are evolutionarily related genes that have similar sequence and similar functions. Orthologs are structurally related genes in different species that are derived by a speciation event. Paralogs are structurally related genes within a single species that are derived by a duplication event.

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al. (1994) *Nucleic Acids Res.* 22: 4673-4680; Higgins et al. (1996) *Methods Enzymol.* 266: 383-402). Groups of similar genes can also be identified with pair-wise BLAST analysis (Feng and Doolittle (1987) *J. Mol. Evol.* 25: 351-360). For example, a clade of very similar MADS domain transcription factors from *Arabidopsis* all share a common function in flowering time (Ratcliffe et al. (2001) *Plant Physiol.* 126: 122-132), and a group of very similar AP2 domain transcription factors from *Arabidopsis* are involved in tolerance of plants to freezing (Gilmour et al. (1998) *Plant J.* 16: 433-442). Analysis of groups of similar genes with similar function that fall within one lade can yield sub-sequences that are particular to the clade. These sub-sequences, known as consensus sequences, can not only be used to define the sequences within each lade, but define the functions of these genes; genes within a lade may contain paralogous sequences, or orthologous sequences that share the same function (see also, for example, Mount (2001), in *Bioinformatics: Sequence and Genome Analysis*, Cold Spring Harbor Laboratory Press, Cold Spring Harbor, N.Y., page 543.)

Speciation, the production of new species from a parental species, can also give rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al. (1994) *Nucleic Acids Res.* 22: 4673-4680; Higgins et al. (1996) supra) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

Results from alignment analysis using SSERCH of 2,079 protein domains have shown that alignment of two unrelated polypeptide sequences have an upper threshold of percentage amino acid residue identity and that this percentage identity threshold decreases with the length of the alignment (Brenner et al. (1998) *Proc. Natl. Acad. Sci.* 95: 6073-6078). Brenner suggested that it is probably necessary for alignments to be at least 70 residues in length before 40% identity is a reasonable threshold, such that the likelihood of two sequences being related is not due to chance. Furthermore, Brenner et al. (1998, supra) showed that two sequences which have 30% identity is a reliable threshold for the database of 2,079 domains only for sequence alignments of at least 150 residues. Brenner et al. disclosed a chart which showed where the percentage identity and alignment length limits of such unrelated sequences cluster (see Brenner et al. (1998, supra), FIG. 3, page 6075). From such a chart, an alignment of two polypeptide sequences may be plotted to ascertain whether they fall within or without the region of unrelated sequences. For example, two polypeptide sequences which are aligned over 73 residues having at least 50% sequence identity are above the threshold for which they might be considered unrelated and therefore are, more likely than not, related to one another.

In addition, Bork has shown that there is a 70% accuracy rate for bioinformatics-based predictions in general, and a 90% accuracy rate for the prediction of functional features by homology (Bork (2000) *Genome Res.* 10:398-400; Table 1 on page 399).

Transcription factor gene sequences are conserved across diverse eukaryotic species lines (Goodrich et al. (1993) *Cell* 75: 519-530; Lin et al. (1991) *Nature* 353: 569-571; Sadowski et al. (1988) *Nature* 335: 563-564).et al. Plants are no exception to this observation; diverse plant species possess transcription factors that have similar sequences and functions.

Orthologous genes from different organisms have highly conserved functions, and very often essentially identical functions (Lee et al. (2002) *Genome Res.* 12: 493-502; Remm et al. (2001) *J. Mol. Biol.* 314: 1041-1052). Paralogous genes, which have diverged through gene duplication, may retain similar functions of the encoded proteins. In such cases, paralogs can be used interchangeably with respect to certain embodiments of the instant invention (for example, transgenic expression of a coding sequence). An example of such highly related paralogs is the CBF family, with three well-defined members in *Arabidopsis* and at least one ortholog in *Brassica napus* (SEQ ID NOs: 44, 46, 48, and 1941, respectively), all of which control pathways involved in both freezing and drought stress (Gilmour et al. (1998) *Plant J.* 16: 433-442; Jaglo et al. (1998) *Plant Physiol.* 127: 910-917).

The following references represent a small sampling of the many studies that demonstrate that conserved transcription factor genes from diverse species are likely to function similarly (i.e., regulate similar target sequences and control the same traits), and that transcription factors may be transformed into diverse species to confer or improve traits.

(1) The *Arabidopsis* NPR1 gene regulates systemic acquired resistance (SAR); over-expression of NPR1 leads to enhanced resistance-in *Arabidopsis*. When either *Arabidopsis* NPR1 or the rice NPR1 ortholog was overexpressed in rice (which, as a monocot, is diverse from *Arabidopsis*), challenge with the rice bacterial blight pathogen *Xanthomonas oryzae* pv. *Oryzae*, the transgenic plants displayed enhanced resistance (Chern et al. (2001) *Plant J.* 27: 101-113). NPR1 acts through activation of expression of transcription factor genes, such as TGA2 (Fan and Dong (2002) *Plant Cell* 14: 1377-1389).

(2) E2F genes are involved in transcription of plant genes for proliferating cell nuclear antigen (PCNA). Plant E2Fs share a high degree of similarity in amino acid sequence between monocots and dicots, and are even similar to the conserved domains of the animal E2Fs. Such conservation indicates a functional similarity between plant and animal E2Fs. E2F transcription factors that regulate meristem development act through common cis-elements, and regulate related (PCNA) genes (Kosugi and Ohashi, (2002) *Plant J.* 29: 45-59).

(3) The ABI5 gene (abscisic acid (ABA) insensitive 5) encodes a basic leucine zipper factor required for ABA response in the seed and vegetative tissues. Co-transformation experiments with AB15 cDNA constructs in rice protoplasts resulted in specific transactivation of the ABA-inducible wheat, *Arabidopsis*, bean, and barley promoters. These results demonstrate that sequentially similar AB15 transcription factors are key targets of a conserved ABA signaling pathway in diverse plants. (Gampala et al. (2001) *J. Biol. Chem.* 277: 1689-1694).

(4) Sequences of three *Arabidopsis* GAMYB-like genes were obtained on the basis of sequence similarity to GAMYB genes from barley, rice, and *L. temulentum*. These three *Arabadopsis* genes were determined to encode transcription factors (AtMYB33, AtMYB65, and AtMYB101) and could substitute for a barley GAMYB and control alpha-amylase expression (Gocal et al. (2001) *Plant Physiol.* 127: 16821693).

(5) The floral control gene LEAFY from *Arabidopsis* can dramatically accelerate flowering in numerous dictoyledonous plants. Constitutive expression of *Arabidopsis* LEAFY also caused early flowering in transgenic rice (a monocot), with a heading date that was 26-34 days earlier than that of wild-type plants. These observations indicate that floral regulatory genes from *Arabidopsis* are useful tools for heading date improvement in cereal crops (He et al. (2000) *Transgenic Res.* 9: 223-227).

(6) Bioactive gibberellins (GAs) are essential endogenous regulators of plant growth. GA signaling tends to be conserved across the plant kingdom. GA signaling is mediated via GAI, a nuclear member of the GRAS family of plant transcription factors. *Arabidopsis* GAI has been shown to function in rice to inhibit gibberellin response pathways (Fu et al. (2001) *Plant Cell* 13: 1791-1802).

(7) The *Arabidopsis* gene SUPERMAN (SUP), encodes a putative transcription factor that maintains the boundary between stamens and carpels. By over-expressing *Arabidopsis* SUP in rice, the effect of the gene's presence on whorl boundaries was shown to be conserved. This demonstrated that SUP is a conserved regulator of floral whorl boundaries and affects cell proliferation (Nandi et al. (2000) *Curr. Biol.* 10: 215-218).

(8) Maize, petunia and *Arabidopsis* myb transcription factors that regulate flavonoid biosynthesis are very genetically similar and affect the same trait in their native species, therefore sequence and function of these myb transcription factors correlate with each other in these diverse species (Borevitz et al. (2000) *Plant Cell* 12: 2383-2394).

(9) Wheat reduced height-1 (Rht-B1/Rht-D1) and maize dwarf-8 (d8) genes are orthologs of the *Arabidopsis* gibberellin insensitive (GAI) gene. Both of these genes have been used to produce dwarf grain varieties that have improved grain yield. These genes encode proteins that resemble nuclear transcription factors and contain an SH2-like domain, indicating that phosphotyrosine may participate in gibberellin signaling. Transgenic rice plants containing a mutant GAI allele from *Arabidopsis* have been shown to produce reduced responses to gibberellin and are dwarfed, indicating that mutant GAI orthologs could be used to increase yield in a wide range of crop species (Peng et al. (1999) *Nature* 400: 256-261).

Transcription factors that are homologous to the listed sequences will typically share, in at least one conserved domain, at least about 70% amino acid sequence identity, and with regard to zinc finger transcription factors, at least about 50% amino acid sequence identity. More closely related transcription factors can share at least about 70%, or about 75% or about 80% or about 90% or about 95% or about 98% or more sequence identity with the listed sequences, or with the listed sequences but excluding or outside a known consensus sequence or consensus DNA-binding site, or with the listed sequences excluding one or all conserved domain. Factors that are most closely related to the listed sequences share, e.g., at least about 85%, about 90% or about 95% or more % sequence identity to the listed sequences, or to the listed sequences but excluding or outside a known consensus sequence or consensus DNA-binding site or outside one or all conserved domain. At the nucleotide level, the sequences will typically share at least about 40% nucleotide sequence identity, preferably at least about 50%, about 60%, about 70% or about 80% sequence identity, and more preferably about 85%, about 90%, about 95% or about 97% or more sequence identity to one or more of the listed sequences, or to a listed sequence but excluding or outside a known consensus sequence or consensus DNA-binding site, or outside one or all conserved domain. The degeneracy of the genetic code enables major variations in the nucleotide sequence of a polynucleotide while maintaining the amino acid sequence of the encoded protein. Conserved domains within a transcription factor family may exhibit a higher degree of sequence homology, such as at least 65% amino acid sequence identity including conservative substitutions, and preferably at least 80% sequence identity, and more preferably at least 85%, or at least about 86%, or at least about 87%, or at least about 88%, or at least about 90%, or at least about 95%, or at least about 98% sequence identity. Transcription factors that are homologous to the listed sequences should share at least 30%, or at least about 60%, or at least about 75%, or at least about 80%, or at least about 90%, or at least about 95% amino acid sequence identity over the entire length of the polypeptide or the homolog.

Percent identity can be determined electronically, e.g., by using the MEGALIGN program (DNASTAR, Inc. Madison, Wis.). The MEGALIGN program can create alignments between two or more sequences according to different methods, for example, the clustal method. (See, for example, Higgins and Sharp (1988) *Gene* 73: 237-244.) The clustal algorithm groups sequences into clusters by examining the distances between all pairs. The clusters are aligned pairwise and then in groups. Other alignment algorithms or programs may be used, including FASTA, BLAST, or ENTREZ, FASTA and BLAST, and which may be used to calculate percent similarity. These are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, e.g., each amino acid gap is weighted as if it were a single amino acid or nucleotide mismatch between the two sequences (see U.S. Pat. No. 6,262,333).

Other techniques for alignment are described in Doolittle, R. F. (1996) *Methods in Enzymology: Computer Methods for Macromolecular Sequence Analysis*, vol. 266, Academic Press, Orlando, Fla., USA. Preferably, an alignment program that permits gaps in the sequence is utilized to align the sequences. The Smith-Waterman is one type of algorithm that permits gaps in sequence alignments (see Shpaer (1997) *Methods Mol. Biol.* 70: 173-187). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

The percentage similarity between two polypeptide sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, e.g., the Jotun Hein method. (See, e.g., Hein (1990) *Methods Enzymol.* 183: 626-645.) Identity between sequences can also be determined by other methods known in the art, e.g., by varying hybridization conditions (see US Patent Application No. 20010010913).

The percent identity between two conserved domains of a transcription factor DNA-binding domain consensus polypeptide sequence can be as low as 16%, as exemplified in the case of GATA1 family of eukaryotic $Cys_2/Cys_2$-type zinc finger transcription factors. The DNA-binding domain consensus polypeptide sequence of the GATA1 family is $CX_2CX_{17}CX_2C$, where X is any amino acid residue. (See, for example, Takatsuji, supra.) Other examples of such conserved consensus polypeptide sequences with low overall percent sequence identity are well known to those of skill in the art.

Thus, the invention provides methods for identifying a sequence similar or paralogous or orthologous or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an internet or intranet) and a query is made against the sequence database using the relevant sequences herein and associated plant phenotypes or gene functions.

In addition, one or more polynucleotide sequences or one or more polypeptides encoded by the polynucleotide sequences may be used to search against a BLOCKS (Bairoch et al. (1997) *Nucleic Acids Res.* 25: 217-221), PFAM, and other databases which contain previously identified and annotated motifs, sequences and gene functions. Methods that search for primary sequence patterns with secondary structure gap penalties (Smith et al. (1992) *Protein Engineering* 5: 35-51) as well as algorithms such as Basic Local Alignment Search Tool (BLAST; Altschul (1993) *J. Mol. Evol.* 36: 290-300; Altschul et al. (1990) supra), BLOCKS (Henikoff and Henikoff (1991) *Nucleic Acids Res.* 19: 6565-6572), Hidden Markov Models (HMM; Eddy (1996) *Curr. Opin. Str. Biol.* 6: 361-365; Sonnhammer et al. (1997) *Proteins* 28: 405-420), and the like, can be used to manipulate and analyze polynucleotide and polypeptide sequences encoded by polynucleotides. These databases, algorithms and other methods are well known in the art and are described in Ausubel et al. (1997; *Short Protocols in Molecular Biology*, John Wiley & Sons, New York, N.Y., unit 7.7) and in Meyers (1995; *Molecular Biology and Biotechnology*, Wiley VCH, New York, N.Y., p 856-853).

Furthermore, methods using manual alignment of sequences similar or homologous to one or more polynucleotide sequences or one or more polypeptides encoded by the polynucleotide sequences may be used to identify regions of similarity and conserved domains. Such manual methods are well-known of those of skill in the art and can include, for example, comparisons of tertiary structure between a polypeptide sequence encoded by a polynucleotide which comprises a known function with a polypeptide sequence encoded by a polynucleotide sequence which has a function not yet determined. Such examples of tertiary structure may comprise predicted alpha helices, beta-sheets, amphipathic helices, leucine zipper motifs, zinc finger motifs, proline-rich regions, cysteine repeat motifs, and the like.

Orthologs and paralogs of presently disclosed transcription factors may be cloned using compositions provided by the present invention according to methods well known in the art. cDNAs can be cloned using mRNA from a plant cell or tissue that expresses one of the present transcription factors. Appropriate mRNA sources may be identified by interrogating Northern blots with probes designed from the present transcription factor sequences, after which a library is prepared from the mRNA obtained from a positive cell or tissue. Transcription factor-encoding cDNA is then isolated using, for example, PCR, using primers designed from a presently disclosed transcription factor gene sequence, or by probing with a partial or complete cDNA or with one or more sets of degenerate probes based on the disclosed sequences. The cDNA library may be used to transform plant cells. Expression of the cDNAs of interest is detected using, for example, methods disclosed herein such as microarrays, Northern blots, quantitative PCR, or any other technique for monitoring changes in expression. Genomic clones may be isolated using similar techniques to those.

Identifying Polynucleotides or Nucleic Acids by Hybridization

Polynucleotides homologous to the sequences illustrated in the Sequence Listing and tables can be identified, e.g., by hybridization to each other under stringent or under highly stringent conditions. Single stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in the references cited above.

Encompassed by the invention are polynucleotide sequences that are capable of hybridizing to the claimed polynucleotide sequences, including any of the transcription factor polynucleotides within the Sequence Listing, and fragments thereof under various conditions of stringency (See, for example, Wahl and Berger (1987) *Methods Enzymol.* 152: 399-407; and Kimmel (1987) *Methods Enzymol.* 152: 507-511). In addition to the nucleotide sequences listed in Tables 4 and 5, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

With regard to hybridization, conditions that are highly stringent, and means for achieving them, are well known in the art. See, for example, Sambrook et al. (1989) *"Molecular Cloning: A Laboratory Manual"* (2nd ed., Cold Spring Harbor Laboratory); Berger and Kimmel, eds., (1987) "Guide to Molecular Cloning Techniques", In Methods in Enzymology: 152: 467-469; and Anderson and Young (1985) "Quantitative Filter Hybridisation." In: Hames and Higgins, ed., *Nucleic Acid Hybridisation, A Practical Approach.* Oxford, IRL Press, 73-111.

Stability of DNA duplexes is affected by such factors as base composition, length, and degree of base pair mismatch. Hybridization conditions may be adjusted to allow DNAs of different sequence relatedness to hybridize. The melting temperature ($T_m$) is defined as the temperature when 50% of the duplex molecules have dissociated into their constituent single strands. The melting temperature of a perfectly matched duplex, where the hybridization buffer contains formamide as a denaturing agent, may be estimated by the following equations:

(I) DNA-DNA:

$$T_m(°C.)=81.5+16.6(\log [Na+])+0.41(\% G+C)-0.62(\% \text{ formamide})-500/L$$

(II) DNA-RNA:

$$T_m(°C.)=79.8+18.5(\log [Na+])+0.58(\% G+C)+0.12(\% G+C)^2-0.5(\% \text{ formamide})-820/L$$

(III) RNA-RNA:

$$T_m(°C.)=79.8+18.5(\log [Na+])+0.58(\% G+C)+0.12(\% G+C)^2-0.35(\% \text{ formamide})-820/L$$

where L is the length of the duplex formed, [Na+] is the molar concentration of the sodium ion in the hybridization or washing solution, and % G+C is the percentage of (guanine+cytosine) bases in the hybrid. For imperfectly matched hybrids, approximately 1° C. is required to reduce the melting temperature for each 1% mismatch.

Hybridization experiments are generally conducted in a buffer of pH between 6.8 to 7.4, although the rate of hybridization is nearly independent of pH at ionic strengths likely to be used in the hybridization buffer (Anderson et al. (1985) supra). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinylpyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency (as described by the formula above). As a general guidelines high stringency is typically performed at $T_m-5°$ C. to $T_m-20°$ C., moderate stringency at $T_m-20°$ C. to $T_m-35°$ C. and low stringency at $T_m-35°$ C. to $T_m-50°$ C. for duplex >150 base pairs. Hybridization may be performed at low to moderate stringency (25-50° C. below $T_m$), followed by post-hybridization washes at increasing stringencies. Maximum rates of hybridization in solution are determined empirically to occur at $T_m-25°$ C. for DNA-DNA duplex and $T_m-15°$ C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or northern blot for hybridization of complementary nucleic acids that have more than 100 complementary residues is about 5° C. to 20° C. lower than the thermal melting point ($T_m$) for the specific sequence at a defined ionic strength and pH. Conditions used for hybridization may include about 0.02 M to about 0.15 M sodium chloride, about 0.5% to about 5% casein, about 0.02% SDS or about 0.1% N-laurylsarcosine, about 0.001 M to about 0.03 M sodium citrate, at hybridization temperatures between about 50° C. and about 70° C. More preferably, high stringency conditions are about 0.02 M sodium chloride, about 0.5% casein, about 0.02% SDS, about 0.001 M sodium citrate, at a temperature of about 50° C. Nucleic acid molecules that hybridize under stringent conditions will typically hybridize to a probe based on either the entire DNA molecule or selected portions, e.g., to a unique subsequence, of the DNA.

Stringent salt concentration will ordinarily be less than about 750 mM NaCl and 75 mM trisodium citrate. Increasingly stringent conditions may be obtained with less than about 500 mM NaCl and 50 mM trisodium citrate, to even greater stringency with less than about 250 mM NaCl and 25 mM trisodium citrate. Low stringency hybridization can be obtained in the absence of organic solvent, e.g., formamide, whereas high stringency hybridization may be obtained in the presence of at least about 35% formamide, and more preferably at least about 50% formamide. Stringent temperature conditions will ordinarily include temperatures of at least about 300 C, more preferably of at least about 37° C., and most preferably of at least about 42° C. with formamide present. Varying additional parameters, such as hybridization time, the concentration of detergent, e.g., sodium dodecyl sulfate (SDS) and ionic strength, are well known to those skilled in the art. Various levels of stringency are accomplished by combining these various conditions as needed.

The washing steps that follow hybridization may also vary in stringency; the post-hybridization wash steps primarily determine hybridization specificity, with the most critical factors being temperature and the ionic strength of the final wash solution. Wash stringency can be increased by decreasing salt concentration or by increasing temperature. Stringent salt concentration for the wash steps will preferably be less than about 30 mM NaCl and 3 mM trisodium citrate, and most preferably less than about 15 mM NaCl and 1.5 mM trisodium citrate.

Thus, hybridization and wash conditions that may be used to bind and remove polynucleotides with less than the desired homology to the nucleic acid sequences or their complements that encode the present transcription factors include, for example:

6×SSC at 65° C.;
50% formamide, 4×SSC at 42° C.; or
0.5×SSC, 0.1% SDS at 650 C;

with, for example, two wash steps of 10-30 minutes each. Useful variations on these conditions will be readily apparent to those skilled in the art.

A person of skill in the art would not expect substantial variation among polynucleotide species encompassed within the scope of the present invention because the highly stringent conditions set forth in the above formulae yield structurally similar polynucleotides.

If desired, one may employ wash steps of even greater stringency, including about 0.2×SSC, 0.1% SDS at 65° C. and washing twice, each wash step being about 30 min, or about 0.1×SSC, 0.1% SDS at 65° C. and washing twice for 30 min. The temperature for the wash solutions will ordinarily be at least about 250 C, and for greater stringency at least about 42° C. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C. For identification of less closely related homolog, wash steps may be performed at a lower temperature, e.g., 500 C.

An example of a low stringency wash step employs a solution and conditions of at least 25° C. in 30 mM NaCl, 3 mM trisodium citrate, and 0.1% SDS over 30 min. Greater stringency may be obtained at 42° C. in 15 mM NaCl, with 1.5 mM trisodium citrate, and 0.1% SDS over 30 min. Even higher stringency wash conditions are obtained at 65° C.-68° C. in a solution of 15 mM NaCl, 1.5 mM trisodium citrate, and 0.1% SDS. Wash procedures will generally employ at least two final wash steps. Additional variations on these conditions will be readily apparent to those skilled in the art (see, for example, U.S. Patent Application No. 20010010913).

Stringency conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a transcription factor known as of the filing date of the application. It may be desirable to select conditions for a particular assay such that a higher signal to noise ratio, that is, about 15× or more, is obtained. Accordingly, a subject nucleic acid will hybridize to a unique coding oligonucleotide with at least a 2× or greater signal to noise ratio as compared to hybridization of the coding oligonucleotide to a nucleic acid encoding known polypeptide. The particular signal will depend on the label used in the relevant assay, e.g., a fluorescent label, a colorimetric label, a radioactive label, or the like. Labeled hybridization or PCR probes for detecting related polynucleotide sequences may be produced by oligolabeling, nick translation, end-labeling, or PCR amplification using a labeled nucleotide.

Identifying Polynucleotides or Nucleic Acids with Expression Libraries

In addition to hybridization methods, transcription factor homolog polypeptides can be obtained by screening an expression library using antibodies specific for one or more transcription factors. With the provision herein of the disclosed transcription factor, and transcription factor homolog nucleic acid sequences, the encoded polypeptide(s) can be expressed and purified in a heterologous expression system (e.g., *E. coli*) and used to raise antibodies (monoclonal or polyclonal) specific for the polypeptide(s) in question. Antibodies can also be raised against synthetic peptides derived from transcription factor, or transcription factor homolog, amino acid sequences. Methods of raising antibodies are well known in the art and are described in Harlow and Lane (1988), *Antibodies: A Laboratory Manual*, Cold Spring Harbor Laboratory, New York. Such antibodies can then be used to screen an expression library produced from the plant from which it is desired to clone additional transcription factor homologs, using the methods described above. The selected cDNAs can be confirmed by sequencing and enzymatic activity.

Encompassed by the invention are polynucleotide sequences that are capable of hybridizing to the claimed polynucleotide sequences, and, in particular, to those shown in SEQ ID NO: 567, SEQ ID NO: 943, SEQ ID NO: 945, SEQ ID NO: 947, SEQ ID NO: 1734, SEQ ID NO: 1874, SEQ ID NO: 1014, SEQ ID NO: 1970, SEQ ID NO: 1972, SEQ ID NO: 1944, SEQ ID NO: 1946, SEQ ID NO: 1948, SEQ ID NO: 1950, SEQ ID NO: 1952, SEQ ID NO: 1954, SEQ ID NO: 1956, SEQ ID NO: 1958, SEQ ID NO: 1960, SEQ ID NO: 1962, SEQ ID NO: 1964, SEQ ID NO: 1966, SEQ ID NO: 1968, SEQ ID NO: 1970, SEQ ID NO: 1972, and fragments thereof under various conditions of stringency. (See, e.g., Wahl and Berger (1987) *Methods Enzymol.* 152: 399-407; Kimmel (1987) *Methods Enzymol.* 152: 507-511.) Estimates of homology are provided by either DNA-DNA or DNA-RNA hybridization under conditions of stringency as is well understood by those skilled in the art (Hames and Higgins, Eds. (1985) *Nucleic Acid Hybridisation*, IRL Press, Oxford, U.K.). Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

Sequence Variations

It will readily be appreciated by those of skill in the art, that any of a variety of polynucleotide sequences are capable of encoding the transcription factors and transcription factor homolog polypeptides of the invention. Due to the degeneracy of the genetic code, many different polynucleotides can encode identical and/or substantially similar polypeptides in addition to those sequences illustrated in the Sequence Listing. Nucleic acids having a sequence that differs from the sequences shown in the Sequence Listing, or complementary sequences, that encode functionally equivalent peptides (i.e., peptides having some degree of equivalent or similar biological activity) but differ in sequence from the sequence shown in the Sequence Listing due to degeneracy in the genetic code, are also within the scope of the invention.

Altered polynucleotide sequences encoding polypeptides include those sequences with deletions, insertions, or substitutions of different nucleotides, resulting in a polynucleotide encoding a polypeptide with at least one functional characteristic of the instant polypeptides. Included within this definition are polymorphisms which may or may not be readily detectable using a particular oligonucleotide probe of the polynucleotide encoding the instant polypeptides, and improper or unexpected hybridization to allelic variants, with a locus other than the normal chromosomal locus for the polynucleotide sequence encoding the instant polypeptides.

Allelic variant refers to any of two or more alternative forms of a gene occupying the same chromosomal locus. Allelic variation arises naturally through mutation, and may result in phenotypic polymorphism within populations. Gene mutations can be silent (i.e., no change in the encoded polypeptide) or may encode polypeptides having altered amino acid sequence. The term allelic variant is also used herein to denote a protein encoded by an allelic variant of a gene. Splice variant refers to alternative forms of RNA transcribed from a gene. Splice variation arises naturally through use of alternative splicing sites within a transcribed RNA molecule, or less commonly between separately transcribed RNA molecules, and may result in several mRNAs transcribed from the same gene. Splice variants may encode polypeptides having altered amino acid sequence. The term splice variant is also used herein to denote a protein encoded by a splice variant of an mRNA transcribed from a gene.

Those skilled in the art would recognize that, for example, G682, SEQ ID NO: 468, represents a single transcription factor; allelic variation and alternative splicing may be expected to occur. Allelic variants of SEQ ID NO: 467 can be cloned by probing cDNA or genomic libraries from different individual organisms according to standard procedures. Allelic variants of the DNA sequence shown in SEQ ID NO: 467, including those containing silent mutations and those in which mutations result in amino acid sequence changes, are within the scope of the present invention, as are proteins which are allelic variants of SEQ ID NO: 468. cDNAs generated from alternatively spliced mRNAs, which retain the properties of the transcription factor are included within the scope of the present invention, as are polypeptides encoded by such cDNAs and mRNAs. Allelic variants and splice variants of these sequences can be cloned by probing cDNA or genomic libraries from different individual organisms or tissues according to standard procedures known in the art (see U.S. Pat. No. 6,388,064).

Those skilled in the art would recognize that G859, SEQ ID NOs: 567 and 568, represents a single MAF transcription factor; allelic variation and alternative splicing may be expected to occur. Allelic variants of SEQ ID NO: 567 can be cloned by probing cDNA or genomic libraries from different individual organisms according to standard procedures. Allelic variants of the DNA sequence shown in SEQ ID NO: 567, including those containing silent mutations and those in which mutations result in amino acid sequence changes, are within the scope of the present invention, as are proteins which are allelic variants of SEQ ID NO: 568. cDNAs generated from alternatively spliced mRNAs, which retain the properties of the MAF transcription factor are included within the scope of the present invention, as are polypeptides encoded by such cDNAs and mRNAs. Allelic variants and splice variants of these sequences can be cloned by probing cDNA or genomic libraries from different individual organisms or tissues according to standard procedures known in the art (see U.S. Pat. No. 6,388,064).

An example of allelic variants or alternatively spliced variants of SEQ ID NO: 567 (G859) are SEQ ID NO: 1946 (G859.1), SEQ ID NO: 1944 (G859.3), SEQ ID NO: 1948 (G859.4), and SEQ ID NO: 1950 (G849.5). These variants encode SEQ ID NOs: 1947, 1945, 1949, and 1951, respectively, which are variants of SEQ ID NO: 568.

Thus, in addition to the sequences set forth in the Sequence Listing and in Table 4, the invention also encompasses related nucleic acid molecules that include allelic or splice variants of SEQ ID NO: 567, SEQ ID NO: 943, SEQ ID NO: 945, SEQ ID NO: 947, SEQ ID NO: 1734, SEQ ID NO: 1874, SEQ ID NO: 1014, SEQ ID NO: 1970, SEQ ID NO: 1972, SEQ ID NO: 1944, SEQ ID NO: 1946, SEQ ID NO: 1948, SEQ ID NO: 1950, SEQ ID NO: 1952, SEQ ID NO: 1954, SEQ ID NO: 1956, SEQ ID NO: 1958, SEQ ID NO: 1960, SEQ ID NO: 1962, SEQ ID NO: 1964, SEQ ID NO: 1966, or SEQ ID NO: 1968, and include sequences which are complementary to any of the above nucleotide sequences. Related nucleic acid molecules also include nucleotide sequences encoding a polypeptide comprising or consisting essentially of a substitution, modification, addition and/or deletion of one or more amino acid residues compared to the polypeptide as set forth in any of SEQ ID NO: 568, SEQ ID NO: 944, SEQ ID NO: 946, SEQ ID NO: 948, SEQ ID NO: 1735, SEQ ID NO: 1875, SEQ ID NO: 1971, SEQ ID NO: 1973, SEQ ID NO: 1945, SEQ ID NO: 1947, SEQ ID NO: 1949, SEQ ID NO: 1951, SEQ ID NO: 1953, SEQ ID NO: 1955, SEQ ID NO: 1957, SEQ ID NO: 1959, SEQ ID NO: 1961, SEQ ID NO: 1963, SEQ ID NO: 1965, SEQ ID NO: 1967, or SEQ ID NO: 1969. Such related polypeptides may comprise, for example, additions and/or deletions of one or more N-linked or O-linked glycosylation sites, or an addition and/or a deletion of one or more cysteine residues.

Thus, in addition to the transcription factor sequences set forth in the Sequence Listing, the invention also encompasses related nucleic acid molecules that include allelic or splice variants of the transcription factor sequences in the Sequence Listing, and include sequences that are complementary to any of the above nucleotide sequences. Related nucleic acid molecules also include nucleotide sequences encoding a polypeptide comprising or consisting essentially of a substitution, modification, addition and/or deletion of one or more amino acid residues compared to the polypeptide as set forth in any of SEQ ID NO: 2N, wherein N=1-SEQ ID NO: 2N, wherein N=1-480, SEQ ID NO: 2N-1, where N=857-970, or SEQ ID NO: 989, 990, 991, 1001, 1002, 1012, 1018, 1021, 1022, 1025, 1027, 1028, 1029, 1034, 1050, 1051, 1072, 1073, 1074, 1075, 1076, 1091, 1092, 1093, 1094, 1095, 1109, 1110, 1111, 1112, 1150, 1165, 1166, 1167, 1168, 1169, 1189, 1190, 1191, 1197, 1198, 1199, 1213, 1214, 1215, 1216, 1226, 1227, 1233, 1239, 1246, 1247, 1258, 1259, 1269, 1307, 1308, 1309, 1310, 1323, 1329, 1330, 1331, 1332, 1338, 1339, 1340, 1361, 1362, 1373, 1374, 1375, 1384, 1389, 1390, 1391, 1396, 1411, 1412, 1413, 1414, 1424, 1435, 1436, 1437, 1448, 1456, 1457, 1458, 1459, 1460, 1472, 1483, 1484, 1500, 1508, 1510, 1511, 1520, 1538, 1539, 1540, 1541, 1542, 1543, 1563, 1564, 1565, 1566, 1567, 1568, 1569, 1582, 1583, 1594, 1611, 1612, 1618, 1619, 1620, 1626, 1627, 1635, 1636, 1640, 1641, 1655, 1656, 1657, 1658, 1672, 1673, 1680, 1682, 1686, 1687, 1688, 1689, 1696, 1702 or 1703. Such related polypeptides may comprise, for example, additions and/or deletions of one or more N-linked or O-linked glycosylation sites, or an addition and/or a deletion of one or more cysteine residues.

For example, Table 1 illustrates, e.g., that the codons AGC, AGT, TCA, TCC, TCG, and TCT all encode the same amino acid: serine. Accordingly, at each position in the sequence where there is a codon encoding serine, any of the above trinucleotide sequences can be used without altering the encoded polypeptide.

TABLE 1

| Amino acid | | | Possible Codons | | | | | |
|---|---|---|---|---|---|---|---|---|
| Alanine | Ala | A | GCA | GCC | GCG | GCU | | |
| Cysteine | Cys | C | TGC | TGT | | | | |
| Aspartic acid | Asp | D | GAC | GAT | | | | |
| Glutamic acid | Glu | E | GAA | GAG | | | | |
| Phenylalanine | Phe | F | TTC | TTT | | | | |
| Glycine | Gly | G | GGA | GGC | GGG | GGT | | |
| Histidine | His | H | CAC | CAT | | | | |
| Isoleucine | Ile | I | ATA | ATC | ATT | | | |
| Lysine | Lys | K | AAA | AAG | | | | |
| Leucine | Leu | L | TTA | TTG | CTA | CTC | CTG | CTT |
| Methionine | Met | M | ATG | | | | | |
| Asparagine | Asn | N | AAC | AAT | | | | |
| Proline | Pro | P | CCA | CCC | CCG | CCT | | |
| Glutamine | Gln | Q | CAA | CAG | | | | |
| Arginine | Arg | R | AGA | AGG | CGA | CGC | CGG | CGT |
| Serine | Ser | S | AGC | AGT | TCA | TCC | TCG | TCT |
| Threonine | Thr | T | ACA | ACC | ACG | ACT | | |
| Valine | Val | V | GTA | GTC | GTG | GTT | | |
| Tryptophan | Trp | W | TGG | | | | | |
| Tyrosine | Tyr | Y | TAC | TAT | | | | |

Sequence alterations that do not change the amino acid sequence encoded by the polynucleotide are termed "silent" variations. With the exception of the codons ATG and TGG, encoding methionine and tryptophan, respectively, any of the possible codons for the same amino acid can be substituted by a variety of techniques, e.g., site-directed mutagenesis, available in the art. Accordingly, any and all such variations of a sequence selected from the above table are a feature of the invention.

In addition to silent variations, other conservative variations that alter one, or a few amino acids in the encoded polypeptide, can be made without altering the function of the polypeptide, these conservative variants are, likewise, a feature of the invention.

For example, substitutions, deletions and insertions introduced into the sequences provided in the Sequence Listing, are also envisioned by the invention. Such sequence modifications can be engineered into a sequence by site-directed mutagenesis (Wu (ed.) *Methods Enzymol.* (1993) vol. 217, Academic Press) or the other methods noted below. Amino acid substitutions are typically of single residues;

insertions usually will be on the order of about from 1 to 10 amino acid residues; and deletions will range about from 1 to 30 residues. In preferred embodiments, deletions or insertions are made in adjacent pairs, e.g., a deletion of two residues or insertion of two residues. Substitutions, deletions, insertions or any combination thereof can be combined to arrive at a sequence. The mutations that are made in the polynucleotide encoding the transcription factor should not place the sequence out of reading frame and should not create complementary regions that could produce secondary mRNA structure. Preferably, the polypeptide encoded by the DNA performs the desired function.

Conservative substitutions are those in which at least one residue in the amino acid sequence has been removed and a different residue inserted in its place. Such substitutions generally are made in accordance with the Table 2 when it is desired to maintain the activity of the protein. Table 2 shows amino acids which can be substituted for an amino acid in a protein and which are typically regarded as conservative substitutions.

TABLE 2

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Similar substitutions are those in which at least one residue in the amino acid sequence has been removed and a different residue inserted in its place. Such substitutions generally are made in accordance with the Table 3 when it is desired to maintain the activity of the protein. Table 3 shows amino acids which can be substituted for an amino acid in a protein and which are typically regarded as structural and functional substitutions. For example, a residue in column 1 of Table 3 may be substituted with a residue in column 2; in addition, a residue in column 2 of Table 3 may be substituted with the residue of column 1.

TABLE 3

| Residue | Similar Substitutions |
|---|---|
| Ala | Ser; Thr; Gly; Val; Leu; Ile |
| Arg | Lys; His; Gly |
| Asn | Gln; His; Gly; Ser; Thr |
| Asp | Glu, Ser; Thr |
| Gln | Asn; Ala |
| Cys | Ser; Gly |
| Glu | Asp |
| Gly | Pro; Arg |
| His | Asn; Gln; Tyr; Phe; Lys; Arg |
| Ile | Ala; Leu; Val; Gly; Met |
| Leu | Ala; Ile; Val; Gly; Met |
| Lys | Arg; His; Gln; Gly; Pro |
| Met | Leu; Ile; Phe |
| Phe | Met; Leu; Tyr; Trp; His; Val; Ala |
| Ser | Thr; Gly; Asp; Ala; Val; Ile; His |
| Thr | Ser; Val; Ala; Gly |
| Trp | Tyr; Phe; His |
| Tyr | Trp; Phe; His |
| Val | Ala; Ile; Leu; Gly; Thr; Ser; Glu |

Substitutions that are less conservative than those in Table 2 can be selected by picking residues that differ more significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. The substitutions which in general are expected to produce the greatest changes in protein properties will be those in which (a) a hydrophilic residue, e.g., seryl or threonyl, is substituted for (or by) a hydrophobic residue, e.g., leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine.

Further Modifying Sequences of the Invention—Mutation/Forced Evolution

In addition to generating silent or conservative substitutions as noted, above, the present invention optionally includes methods of modifying the sequences of the Sequence Listing. In the methods, nucleic acid or protein modification methods are used to alter the given sequences to produce new sequences and/or to chemically or enzymatically modify given sequences to change the properties of the nucleic acids or proteins.

Thus, in one embodiment, given nucleic acid sequences are modified, e.g., according to standard mutagenesis or artificial evolution methods to produce modified sequences. The modified sequences may be created using purified natural polynucleotides isolated from any organism or may be synthesized from purified compositions and chemicals using chemical means well know to those of skill in the art. For example, Ausubel, supra, provides additional details on mutagenesis methods. Artificial forced evolution methods are described, for example, by Stemmer (1994) *Nature* 370: 389-391, Stemmer (1994) *Proc. Natl. Acad. Sci.* 91: 10747-10751, and U.S. Pat. Nos. 5,811,238, 5,837,500, and 6,242,568. Methods for engineering synthetic transcription factors and other polypeptides are described, for example, by Zhang et al. (2000) *J. Biol. Chem.* 275: 33850-33860, Liu et al.

(2001) *J. Biol. Chem.* 276: 11323-11334, and Isalan et al. (2001) *Nature Biotechnol.* 19: 656-660. Many other mutation and evolution methods are also available and expected to be within the skill of the practitioner.

Similarly, chemical or enzymatic alteration of expressed nucleic acids and polypeptides can be performed by standard methods. For example, sequence can be modified by addition of lipids, sugars, peptides, organic or inorganic compounds, by the inclusion of modified nucleotides or amino acids, or the like. For example, protein modification techniques are illustrated in Ausubel, supra. Further details on chemical and enzymatic modifications can be found herein. These modification methods can be used to modify any given sequence, or to modify any sequence produced by the various mutation and artificial evolution modification methods noted herein.

Accordingly, the invention provides for modification of any given nucleic acid by mutation, evolution, chemical or enzymatic modification, or other available methods, as well as for the products produced by practicing such methods, e.g., using the sequences herein as a starting substrate for the various modification approaches.

For example, optimized coding sequence containing codons preferred by a particular prokaryotic or eukaryotic host can be used e.g., to increase the rate of translation or to produce recombinant RNA transcripts having desirable properties, such as a longer half-life, as compared with transcripts produced using a non-optimized sequence. Translation stop codons can also be modified to reflect host preference. For example, preferred stop codons for *Saccharomyces cerevisiae* and mammals are TAA and TGA, respectively. The preferred stop codon for monocotyledonous plants is TGA, whereas insects and *E. coli* prefer to use TAA as the stop codon.

The polynucleotide sequences of the present invention can also be engineered in order to alter a coding sequence for a variety of reasons, including but not limited to, alterations which modify the sequence to facilitate cloning, processing and/or expression of the gene product. For example, alterations are optionally introduced using techniques which are well known in the art, e.g., site-directed mutagenesis, to insert new restriction sites, to alter glycosylation patterns, to change codon preference, to introduce splice sites, etc.

Furthermore, a fragment or domain derived from any of the polypeptides of the invention can be combined with domains derived from other transcription factors or synthetic domains to modify the biological activity of a transcription factor. For instance, a DNA-binding domain derived from a transcription factor of the invention can be combined with the activation domain of another transcription factor or with a synthetic activation domain. A transcription activation domain assists in initiating transcription from a DNA-binding site. Examples include the transcription activation region of VP16 or GAL4 (Moore et al. (1998) *Proc. Natl. Acad. Sci.* 95: 376-381; Aoyama et al. (1995) *Plant Cell* 7: 1773-1785), peptides derived from bacterial sequences (Ma and Ptashne (1987) *Cell* 51: 113-119) and synthetic peptides (Giniger and Ptashne (1987) *Nature* 330: 670-672).

Expression and Modification of Polypeptides

Typically, polynucleotide sequences of the invention are incorporated into recombinant DNA (or RNA) molecules that direct expression of polypeptides of the invention in appropriate host cells, transgenic plants, in vitro translation systems, or the like. Due to the inherent degeneracy of the genetic code, nucleic acid sequences which encode substantially the same or a functionally equivalent amino acid sequence can be substituted for any listed sequence to provide for cloning and expressing the relevant homolog.

The transgenic plants of the present invention comprising recombinant polynucleotide sequences are generally derived from parental plants, which may themselves be non-transformed (or non-transgenic) plants. These transgenic plants may either have a transcription factor gene "knocked out" (for example, with a genomic insertion by homologous recombination, an antisense or ribozyme construct) or expressed to a normal or wild-type extent. However, overexpressing transgenic "progeny" plants will exhibit greater mRNA levels, wherein the mRNA encodes a transcription factor, that is, a DNA-binding protein that is capable of binding to a DNA regulatory sequence and inducing transcription, and preferably, expression of a plant trait gene. Preferably, the mRNA expression level will be at least three-fold greater than that of the parental plant, or more preferably at least ten-fold greater mRNA levels compared to said parental plant, and most preferably at least fifty-fold greater compared to said parental plant.

Vectors, Promoters, and Expression Systems

The present invention includes recombinant constructs comprising one or more of the nucleic acid sequences herein. The constructs typically comprise a vector, such as a plasmid, a cosmid, a phage, a virus (e.g., a plant virus), a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

General texts that describe molecular biological techniques useful herein, including the use and production of vectors, promoters and many other relevant topics, include Berger, Sambrook, supra and Ausubel, supra. Any of the identified sequences can be incorporated into a cassette or vector, e.g., for expression in plants. A number of expression vectors suitable for stable transformation of plant cells or for the establishment of transgenic plants have been described including those described in Weissbach and Weissbach (1989) *Methods for Plant Molecular Biology*, Academic Press, and Gelvin et al. (1990) *Plant Molecular Biology Manual*, Kluwer Academic Publishers. Specific examples include those derived from a Ti plasmid of *Agrobacterium tumefaciens*, as well as those disclosed by Herrera-Estrella et al. (1983) *Nature* 303: 209, Bevan (1984) *Nucleic Acids Res.* 12: 8711-8721, Klee (1985) *Bio/Technology* 3: 637-642, for dicotyledonous plants.

Alternatively, non-Ti vectors can be used to transfer the DNA into monocotyledonous plants and cells by using free DNA delivery techniques. Such methods can involve, for example, the use of liposomes, electroporation, microprojectile bombardment, silicon carbide whiskers, and viruses. By using these methods transgenic plants such as wheat, rice (Christou (1991) *Bio/Technology* 9: 957-962) and corn (Gordon-Kamm (1990) *Plant Cell* 2: 603-618) can be produced. An immature embryo can also be a good target tissue for monocots for direct DNA delivery techniques by using the particle gun (Weeks et al. (1993) *Plant Physiol.* 102: 1077-1084; Vasil (1993) *Bio/Technology* 10: 667-674; Wan and Lemeaux (1994) *Plant Physiol.* 104: 37-48, and for Agrobacterium-mediated DNA transfer (Ishida et al. (1996) *Nature Biotechnol.* 14: 745-750).

Typically, plant transformation vectors include one or more cloned plant coding sequence (genomic or cDNA) under the transcriptional control of 5' and 3' regulatory sequences and a dominant selectable marker. Such plant transformation vectors typically also contain a promoter (e.g., a regulatory region controlling inducible or constitutive, environmentally-or developmentally-regulated, or cell- or tissue-specific expression), a transcription initiation start site, an RNA processing signal (such as intron splice sites), a transcription termination site, and/or a polyadenylation signal.

A potential utility for the transcription factor polynucleotides disclosed herein is the isolation of promoter elements from these genes that can be used to program expression in plants of any genes. Each transcription factor gene disclosed herein is expressed in a unique fashion, as determined by promoter elements located upstream of the start of translation, and additionally within an intron of the transcription factor gene or downstream of the termination codon of the gene. As is well known in the art, for a significant portion of genes, the promoter sequences are located entirely in the region directly upstream of the start of translation. In such cases, typically the promoter sequences are located within 2.0 kb of the start of translation, or within 1.5 kb of the start of translation, frequently within 1.0 kb of the start of translation, and sometimes within 0.5 kb of the start of translation.

The promoter sequences can be isolated according to methods known to one skilled in the art.

Examples of constitutive plant promoters which can be useful for expressing the TF sequence include: the cauliflower mosaic virus (CaMV) 35S promoter, which confers constitutive, high-level expression in most plant tissues (see, e.g., Odell et al. (1985) *Nature* 313: 810-812); the nopaline synthase promoter (An et al. (1988) *Plant Physiol.* 88: 547-552); and the octopine synthase promoter (Fromm et al. (1989) *Plant Cell* 1: 977-984).

A variety of plant gene promoters that regulate gene expression in response to environmental, hormonal, chemical, developmental signals, and in a tissue-active manner can be used for expression of a TF sequence in plants. Choice of a promoter is based largely on the phenotype of interest and is determined by such factors as tissue (e.g., seed, fruit, root, pollen, vascular tissue, flower, carpel, etc.), inducibility (e.g., in response to wounding, heat, cold, drought, light, pathogens, etc.), timing, developmental stage, and the like. Numerous known promoters have been characterized and can favorably be employed to promote expression of a polynucleotide of the invention in a transgenic plant or cell of interest. For example, tissue specific promoters include: seed-specific promoters (such as the napin, phaseolin or DC3 promoter described in U.S. Pat. No. 5,773,697), fruit-specific promoters that are active during fruit ripening (such as the dru 1 promoter (U.S. Pat. No. 5,783,393), or the 2A11 promoter (U.S. Pat. No. 4,943,674) and the tomato polygalacturonase promoter (Bird et al. (1988) *Plant Mol. Biol.* 11: 651-662), root-specific promoters, such as those disclosed in U.S. Pat. Nos. 5,618,988, 5,837,848 and 5,905,186, pollen-active promoters such as PTA29, PTA26 and PTA13 (U.S. Pat. No. 5,792,929), promoters active in vascular tissue (Ringli and Keller (1998) *Plant Mol. Biol.* 37: 977-988), flower-specific (Kaiser et al. (1995) *Plant Mol. Biol.* 28: 231-243), pollen (Baerson et al. (1994) *Plant Mol. Biol.* 26: 1947-1959), carpels (Ohl et al. (1990) *Plant Cell* 2: 837-848), pollen and ovules (Baerson et al. (1993) *Plant Mol. Biol.* 22: 255-267), auxin-inducible promoters (such as that described in van der Kop et al. (1999) *Plant Mol. Biol.* 39: 979-990 or Baumann et al. (1999) *Plant Cell* 11: 323-334), cytokinin-inducible promoter (Guevara-Garcia (1998) *Plant Mol. Biol.* 38: 743-753), promoters responsive to gibberellin (Shi et al. (1998) *Plant Mol. Biol.* 38: 1053-1060, Willmott et al. (1998) 38: 817-825) and the like. Additional promoters are those that elicit expression in response to heat (Ainley et al. (1993) *Plant Mol. Biol.* 22: 13-23), light (e.g., the pea rbcS-3A promoter, Kuhlemeier et al. (1989) *Plant Cell* 1: 471478, and the maize rbcS promoter, Schaffner and Sheen (1991) *Plant Cell* 3: 997-1012); wounding (e.g., wunI, Siebertz et al. (1989) *Plant Cell* 1: 961-968); pathogens (such as the PR-1 promoter described in Buchel et al. (1999) *Plant Mol. Biol.* 40: 387-396, and the PDF1.2 promoter described in Manners et al. (1998) *Plant Mol. Biol.* 38: 1071-1080), and chemicals such as methyl jasmonate or salicylic acid (Gatz (1997) *Annu. Rev. Plant Physiol. Plant Mol. Biol.* 48: 89-108). In addition, the timing of the expression can be controlled by using promoters such as those acting at senescence (Gan and Amasino (1995) *Science* 270: 1986-1988); or late seed development (Odell et al. (1994) *Plant Physiol.* 106: 447-458).

Plant expression vectors can also include RNA processing signals that can be positioned within, upstream or downstream of the coding sequence. In addition, the expression vectors can include additional regulatory sequences from the 3'-untranslated region of plant genes, e.g., a 3' terminator region to increase mRNA stability of the mRNA, such as the PI-II terminator region of potato or the octopine or nopaline synthase 3' terminator regions.

Additional Expression Elements

Specific initiation signals can aid in efficient translation of coding sequences. These signals can include, e.g., the ATG initiation codon and adjacent sequences. In cases where a coding sequence, its initiation codon and upstream sequences are inserted into the appropriate expression vector, no additional translational control signals may be needed. However, in cases where only coding sequence (e.g., a mature protein coding sequence), or a portion thereof, is inserted, exogenous transcriptional control signals including the ATG initiation codon can be separately provided. The initiation codon is provided in the correct reading frame to facilitate transcription. Exogenous transcriptional elements and initiation codons can be of various origins, both natural and synthetic. The efficiency of expression can be enhanced by the inclusion of enhancers appropriate to the cell system in use.

Expression Hosts

The present invention also relates to host cells which are transduced with vectors of the invention, and the production of polypeptides of the invention (including fragments thereof) by recombinant techniques. Host cells are genetically engineered (i.e., nucleic acids are introduced, e.g., transduced, transformed or transfected) with the vectors of this invention, which may be, for example, a cloning vector or an expression vector comprising the relevant nucleic acids herein. The vector is optionally a plasmid, a viral particle, a phage, a naked nucleic acid, etc. The engineered host cells can be cultured in conventional nutrient media modified as appropriate for activating promoters, selecting transformants, or amplifying the relevant gene. The culture conditions, such as temperature, pH and the like, are those previously used with the host cell selected for expression, and will be apparent to those skilled in the art and in the references cited herein, including, Sambrook, supra and Ausubel, supra.

The host cell can be a eukaryotic cell, such as a yeast cell, or a plant cell, or the host cell can be a prokaryotic cell, such as a bacterial cell. Plant protoplasts are also suitable for some applications. For example, the DNA fragments are introduced into plant tissues, cultured plant cells or plant protoplasts by standard methods including electroporation (Fromm et al. (1985) *Proc. Natl. Acad. Sci.* 82: 5824-5828, infection by viral vectors such as cauliflower mosaic virus (CaMV) (Hohn et al. (1982) *Molecular Biology of plant Tumors* Academic Press, New York, N.Y., pp. 549-560; U.S. Pat. No. 4,407,956), high velocity ballistic penetration by small particles with the nucleic acid either within the matrix of small beads or particles, or on the surface (Klein et al. (1987) *Nature* 327: 70-73), use of pollen as vector (WO 85/01856), or use of *Agrobacterium tumefaciens* or *A. rhizogenes* carrying a T-DNA plasmid in which DNA fragments are cloned. The T-DNA plasmid is transmitted to plant cells upon infection by *Agrobacterium tumefaciens*, and a portion is stably integrated into the plant genome (Horsch et al. (1984) *Science* 233: 496-498; Fraley et al. (1983) Proc. Natl. Acad. Sci. 80: 4803-4807).

The cell can include a nucleic acid of the invention that encodes a polypeptide, wherein the cell expresses a polypeptide of the invention. The cell can also include vector sequences, or the like. Furthermore, cells and transgenic plants that include any polypeptide or nucleic acid above or throughout this specification, e.g., produced by transduction of a vector of the invention, are an additional feature of the invention.

For long-term, high-yield production of recombinant proteins, stable expression can be used. Host cells transformed with a nucleotide sequence encoding a polypeptide of the invention are optionally cultured under conditions suitable for the expression and recovery of the encoded protein from cell culture. The protein or fragment thereof produced by a recombinant cell may be secreted, membrane-bound, or contained intracellularly, depending on the sequence and/or the vector used. As will be understood by those of skill in the art, expression vectors containing polynucleotides encoding mature proteins of the invention can be designed with signal sequences which direct secretion of the mature polypeptides through a prokaryotic or eukaryotic cell membrane.

Modified Amino Acid Residues

Polypeptides of the invention may contain one or more modified amino acid residues. The presence of modified amino acids may be advantageous in, for example, increasing polypeptide half-life, reducing polypeptide antigenicity or toxicity, increasing polypeptide storage stability, or the like. Amino acid residue(s) are modified, for example, co-translationally or post-translationally during recombinant production or modified by synthetic or chemical means.

Non-limiting examples of a modified amino acid residue include incorporation or other use of acetylated amino acids, glycosylated amino acids, sulfated amino acids, prenylated (e.g., farnesylated, geranylgeranylated) amino acids, PEG modified (e.g., "PEGylated") amino acids, biotinylated amino acids, carboxylated amino acids, phosphorylated amino acids, etc. References adequate to guide one of skill in the modification of amino acid residues are replete throughout the literature.

The modified amino acid residues may prevent or increase affinity of the polypeptide for another molecule, including, but not limited to, polynucleotide, proteins, carbohydrates, lipids and lipid derivatives, and other organic or synthetic compounds.

Identification of Additional Factors

A transcription factor provided by the present invention can also be used to identify additional endogenous or exogenous molecules that can affect a phentoype or trait of interest. On the one hand, such molecules include organic (small or large molecules) and/or inorganic compounds that affect expression of (i.e., regulate) a particular transcription factor. Alternatively, such molecules include endogenous molecules that are acted upon either at a transcriptional level by a transcription factor of the invention to modify a phenotype as desired. For example, the transcription factors can be employed to identify one or more downstream genes that are subject to a regulatory effect of the transcription factor. In one approach, a transcription factor or transcription factor homolog of the invention is expressed in a host cell, e.g., a transgenic plant cell, tissue or explant, and expression products, either RNA or protein, of likely or random targets are monitored, e.g., by hybridization to a microarray of nucleic acid probes corresponding to genes expressed in a tissue or cell type of interest, by two-dimensional gel electrophoresis of protein products, or by any other method known in the art for assessing expression of gene products at the level of RNA or protein. Alternatively, a transcription factor of the invention can be used to identify promoter sequences (such as binding sites on DNA sequences) involved in the regulation of a downstream target. After identifying a promoter sequence, interactions between the transcription factor and the promoter sequence can be modified by changing specific nucleotides in the promoter sequence or specific amino acids in the transcription factor that interact with the promoter sequence to alter a plant trait. Typically, transcription factor DNA-binding sites are identified by gel shift assays. After identifying the promoter regions, the promoter region sequences can be employed in double-stranded DNA arrays to identify molecules that affect the interactions of the transcription factors with their promoters (Bulyk et al. (1999) *Nature Biotechnol.* 17: 573-577).

The identified transcription factors are also useful to identify proteins that modify the activity of the transcription factor. Such modification can occur by covalent modification, such as by phosphorylation, or by protein-protein (homo or -heteropolymer) interactions. Any method suitable for detecting protein-protein interactions can be employed. Among the methods that can be employed are co-immunoprecipitation, cross-linking and co-purification through gradients or chromatographic columns, and the two-hybrid yeast system.

The two-hybrid system detects protein interactions in vivo and is described in Chien et al. (1991) *Proc. Natl. Acad. Sci.* 88: 9578-9582, and is commercially available from Clontech (Palo Alto, Calif.). In such a system, plasmids are constructed that encode two hybrid proteins: one consists of the DNA-binding domain of a transcription activator protein fused to the TF polypeptide and the other consists of the transcription activator protein's activation domain fused to an unknown protein that is encoded by a cDNA that has been recombined into the plasmid as part of a cDNA library. The DNA-binding domain fusion plasmid and the cDNA library are transformed into a strain of the yeast *Saccharomyces cerevisiae* that contains a reporter gene (e.g., lacZ) whose regulatory region contains the transcription activator's binding site. Either hybrid protein alone cannot activate transcription of the reporter gene. Interaction of the two hybrid proteins reconstitutes the functional activator protein and results in expression of the reporter gene, which is detected by an assay for the reporter gene product. Then, the library plasmids responsible for reporter gene expression are isolated and sequenced to identify the proteins encoded by the library plasmids. After identifying proteins that interact with the transcription factors, assays for compounds that interfere with the TF protein-protein interactions can be preformed.

Identification of Modulators

In addition to the intracellular molecules described above, extracellular molecules that alter activity or expression of a transcription factor, either directly or indirectly, can be identified. For example, the methods can entail first placing a candidate molecule in contact with a plant or plant cell. The molecule can be introduced by topical administration, such as spraying or soaking of a plant, or incubating a plant in a solution containing the molecule, and then the molecule's effect on the expression or activity of the TF polypeptide or the expression of the polynucleotide monitored. Changes in the expression of the TF polypeptide can be monitored by use of polyclonal or monoclonal antibodies, gel electrophoresis or the like. Changes in the expression of the corresponding polynucleotide sequence can be detected by use of microarrays, Northerns, quantitative PCR, or any other technique for monitoring changes in mRNA expression. These techniques are exemplified in Ausubel et al. (eds.) Current Protocols in Molecular Biology, John Wiley & Sons (1998, and supplements through 2001).Changes in the activity of the transcription factor can be monitored, directly or indirectly, by assaying the function of the transcription factor, for example, by measuring the expression of promoters known to be controlled by the transcription factor (using promoter-reporter constructs), measuring the levels of transcripts using microarrays, Northern blots, quantitative PCR, etc. Such changes in the expression levels can be correlated with modified plant traits and thus identified molecules can be useful for soaking or spraying on fruit, vegetable and grain crops to modify traits in plants.

Essentially any available composition can be tested for modulatory activity of expression or activity of any nucleic acid or polypeptide herein. Thus, available libraries of compounds such as chemicals, polypeptides, nucleic acids and the like can be tested for modulatory activity. Often, potential modulator compounds can be dissolved in aqueous or organic (e.g., DMSO-based) solutions for easy delivery to the cell or plant of interest in which the activity of the modulator is to be tested. Optionally, the assays are designed to screen large modulator composition libraries by automating the assay steps and providing compounds from any convenient source to assays, which are typically run in parallel (e.g., in microtiter formats on microplates in robotic assays).

In one embodiment, high throughput screening methods involve providing a combinatorial library containing a large number of potential compounds (potential modulator compounds). Such "combinatorial chemical libraries" are then screened in one or more assays, as described herein, to identify those library members (particular chemical species or subclasses) that display a desired characteristic activity. The compounds thus identified can serve as target compounds.

A combinatorial chemical library can be, e.g., a collection of diverse chemical compounds generated by chemical synthesis or biological synthesis. For example, a combinatorial chemical library such as a polypeptide library is formed by combining a set of chemical building blocks (e.g., in one example, amino acids) in every possible way for a given compound length (i.e., the number of amino acids in a polypeptide compound of a set length). Exemplary libraries include peptide libraries, nucleic acid libraries, antibody libraries (see, e.g., Vaughn et al. (1996) Nature Biotechnol. 14: 309-314 and PCT/US96/10287), carbohydrate libraries (see, e.g., Liang et al. Science (1996) 274: 1520-1522 and U.S. Pat. No. 5,593,853), peptide nucleic acid libraries (see, e.g., U.S. Pat. No. 5,539,083), and small organic molecule libraries (see, e.g., benzodiazepines, in Baum Chem. & Engineering News Jan. 18, 1993, page 33; isoprenoids, U.S. Pat. No. 5,569,588; thiazolidinones and metathiazanones, U.S. Pat. No. 5,549,974; pyrrolidines, U.S. Pat. Nos. 5,525,735 and 5,519,134; morpholino compounds, U.S. Pat. No. 5,506,337) and the like.

Preparation and screening of combinatorial or other libraries is well known to those of skill in the art. Such combinatorial chemical libraries include, but are not limited to, peptide libraries (see, e.g., U.S. Pat. No. 5,010,175; Furka, (1991) Int. J. Pept. Prot. Res. 37: 487-493; and Houghton et al. (1991) Nature 354: 84-88). Other chemistries for generating chemical diversity libraries can also be used.

In addition, as noted, compound screening equipment for high-throughput screening is generally available, e.g., using any of a number of well known robotic systems that have also been developed for solution phase chemistries useful in assay systems. These systems include automated workstations including an automated synthesis apparatus and robotic systems utilizing robotic arms. Any of the above devices are suitable for use with the present invention, e.g., for high-throughput screening of potential modulators. The nature and implementation of modifications to these devices (if any) so that they can operate as discussed herein will be apparent to persons skilled in the relevant art.

Indeed, entire high-throughput screening systems are commercially available. These systems typically automate entire procedures including all sample and reagent pipetting, liquid dispensing, timed incubations, and final readings of the microplate in detector(s) appropriate for the assay. These configurable systems provide high throughput and rapid start up as well as a high degree of flexibility and customization. Similarly, microfluidic implementations of screening are also commercially available.

The manufacturers of such systems provide detailed protocols the various high throughput. Thus, for example, Zymark Corp provides technical bulletins describing screening systems for detecting the modulation of gene transcription, ligand binding, and the like. The integrated systems herein, in addition to providing for sequence alignment and, optionally, synthesis of relevant nucleic acids, can include such screening apparatus to identify modulators that have an effect on one or more polynucleotides or polypeptides according to the present invention.

In some assays it is desirable to have positive controls to ensure that the components of the assays are working properly. At least two types of positive controls are appropriate. That is, known transcriptional activators or inhibitors can be incubated with cells or plants, for example, in one sample of the assay, and the resulting increase/decrease in transcription can be detected by measuring the resulting increase in RNA levels and/or protein expression, for example, according to the methods herein. It will be appreciated that modulators can also be combined with transcriptional activators or inhibitors to find modulators that inhibit transcriptional activation or transcriptional repression. Either expression of the nucleic acids and proteins herein or any additional nucleic acids or proteins activated by the nucleic acids or proteins herein, or both, can be monitored.

In an embodiment, the invention provides a method for identifying compositions that modulate the activity or expression of a polynucleotide or polypeptide of the invention. For example, a test compound, whether a small or large molecule, is placed in contact with a cell, plant (or plant tissue or explant), or composition comprising the polynucleotide or polypeptide of interest and a resulting effect on the cell, plant, (or tissue or explant) or composition is evaluated by monitoring, either directly or indirectly, one or more of: expression level of the polynucleotide or polypeptide, activity (or modulation of the activity) of the polynucleotide or polypeptide. In some cases, an alteration in a plant phenotype can be detected following contact of a plant (or plant cell, or tissue or explant) with the putative modulator, e.g., by modulation of expression or activity of a polynucleotide or polypeptide of the invention. Modulation of expression or activity of a polynucleotide or polypeptide of the invention may also be caused by molecular elements in a signal transduction second messenger pathway and such modulation can affect similar elements in the same or another signal transduction second messenger pathway.

Subsequences

Also contemplated are uses of polynucleotides, also referred to herein as oligonucleotides, typically having at least 12 bases, preferably at least 15, more preferably at least 20, 30, or 50 bases, which hybridize under at least highly stringent (or ultra-high stringent or ultra-ultra-high stringent conditions) conditions to a polynucleotide sequence described above. The polynucleotides may be used as probes, primers, sense and antisense agents, and the like, according to methods as noted supra.

Subsequences of the polynucleotides of the invention, including polynucleotide fragments and oligonucleotides are useful as nucleic acid probes and primers. An oligonucleotide suitable for use as a probe or primer is at least about 15 nucleotides in length, more often at least about 18 nucleotides, often at least about 21 nucleotides, frequently at least about 30 nucleotides, or about 40 nucleotides, or more in length. A nucleic acid probe is useful in hybridization protocols, e.g., to identify additional polypeptide homologs of the invention, including protocols for microarray experiments. Primers can be annealed to a complementary target DNA strand by nucleic acid hybridization to form a hybrid between the primer and the target DNA strand, and then extended along the target DNA strand by a DNA polymerase enzyme. Primer pairs can be used for amplification of a nucleic acid sequence, e.g., by the polymerase chain reaction (PCR) or other nucleic-acid amplification methods. See Sambrook, supra, and Ausubel, supra.

In addition, the invention includes an isolated or recombinant polypeptide including a subsequence of at least about 15 contiguous amino acids encoded by the recombinant or isolated polynucleotides of the invention. For example, such polypeptides, or domains or fragments thereof, can be used as immunogens, e.g., to produce antibodies specific for the polypeptide sequence, or as probes for detecting a sequence of interest. A subsequence can range in size from about 15 amino acids in length up to and including the full length of the polypeptide.

To be encompassed by the present invention, an expressed polypeptide which comprises such a polypeptide subsequence performs at least one biological function of the intact polypeptide in substantially the same manner, or to a similar extent, as does the intact polypeptide. For example, a polypeptide fragment can comprise a recognizable structural motif or functional domain such as a DNA binding domain that activates transcription, e.g., by binding to a specific DNA promoter region an activation domain, or a domain for protein-protein interactions.

Production of Transgenic Plants

Modification of Traits

The polynucleotides of the invention are favorably employed to produce transgenic plants with various traits, or characteristics, that have been modified in a desirable manner, e.g., to improve the seed characteristics of a plant. For example, alteration of expression levels or patterns (e.g., spatial or temporal expression patterns) of one or more of the transcription factors (or transcription factor homologs) of the invention, as compared with the levels of the same protein found in a wild-type plant, can be used to modify a plant's traits. An illustrative example of trait modification, improved characteristics, by altering expression levels of a particular transcription factor is described further in the Examples and the Sequence Listing.

*Arabidopsis* as a Model System

*Arabidopsis thaliana* is the object of rapidly growing attention as a model for genetics and metabolism in plants. *Arabidopsis* has a small genome, and well-documented studies are available. It is easy to grow in large numbers and mutants defining important genetically controlled mechanisms are either available, or can readily be obtained. Various methods to introduce and express isolated homologous genes are available (see Koncz et al. eds., et al. Methods in *Arabidopsis* Research (1992) et al. World Scientific, New Jersey, N.J., in "Preface"). Because of its small size, short life cycle, obligate autogamy and high fertility, *Arabidopsis* is also a choice organism for the isolation of mutants and studies in morphogenetic and development pathways, and control of these pathways by transcription factors (Koncz supra, p. 72). A number of studies introducing transcription factors into *A. thaliana* have demonstrated the utility of this plant for understanding the mechanisms of gene regulation and trait alteration in plants. (See, for example, Koncz supra, and U.S. Pat. No. 6,417,428).

*Arabidopsis* Genes in Transgenic Plants.

Expression of genes which encode transcription factors modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997) et al. *Genes and Development* 11: 3194-3205, and Peng et al. (1999) *Nature* 400: 256-261. In addition, many others have demonstrated that an *Arabidopsis* transcription factor expressed in an exogenous plant species elicits the same or very similar phenotypic response. See, for example, Fu et al. (2001) *Plant Cell* 13: 1791-1802; Nandi et al. (2000) *Curr. Biol.* 10: 215-218; Coupland (1995) *Nature* 377: 482-483; and Weigel and Nilsson (1995) *Nature* 377: 482-500.

Homologous Genes Introduced Into Transgenic Plants.

Homologous genes that may be derived from any plant, or from any source whether natural, synthetic, semi-synthetic or recombinant, and that share significant sequence identity or similarity to those provided by the present invention, may be introduced into plants, for example, crop plants, to confer desirable or improved traits. Consequently, transgenic plants may be produced that comprise a recombinant expression vector or cassette with a promoter operably linked to one or more sequences homologous to presently disclosed sequences. The promoter may be, for example, a plant or viral promoter.

The invention thus provides for methods for preparing transgenic plants, and for modifying plant traits. These methods include introducing into a plant a recombinant expression vector or cassette comprising a functional promoter operably linked to one or more sequences homologous to presently disclosed sequences. Plants and kits for producing these plants that result from the application of these methods are also encompassed by the present invention.

Transcription Factors of Interest for the Modification of Plant Traits

Currently, the existence of a series of maturity groups for different latitudes represents a major barrier to the introduction of new valuable traits. Any trait (e.g. disease resistance) has to be bred into each of the different maturity groups separately, a laborious and costly exercise. The availability of single strain, which could be grown at any latitude, would therefore greatly increase the potential for introducing new traits to crop species such as soybean and cotton.

For many of the specific effects, traits and utilities listed in Table 4 and Table 6 that may be conferred to plants, one or more transcription factor genes may be used to increase or decrease, advance or delay, or improve or prove deleterious to a given trait. Overexpressing or suppressing one or more genes can impart significant differences in production of plant products, such as different fatty acid ratios.

For example, overexpression of G720 caused a plant to become more freezing tolerant, but knocking out the same transcription factor imparted greater susceptibility to freezing. Thus, suppressing a gene that causes a plant to be more sensitive to cold may improve a plant's tolerance of cold. More than one transcription factor gene may be introduced into a plant, either by transforming the plant with one or more vectors comprising two or more transcription factors, or by selective breeding of plants to yield hybrid crosses that comprise more than one introduced transcription factor.

A listing of specific effects and utilities that the presently disclosed transcription factor genes have on plants, as determined by direct observation and assay analysis, is provided in Table 4. Table 4 shows the polynucleotides identified by SEQ ID NO; Mendel Gene ID No. (GID); and if the polynucleotide was tested in a transgenic assay. The first column shows the polynucleotide SEQ ID NO; the second column shows the GID; the third column shows whether the gene was overexpressed (OE) or knocked out (KO) in plant studies; the fourth column shows the trait(s) resulting from the knock out or overexpression of the polynucleotide in the transgenic plant; the fifth column shows the category of the trait; and the sixth column ("Comment"), includes specific observations made with respect to the polynucleotide of the first column.

TABLE 4

Traits, trait categories, and effects and utilities that transcription factor genes have on plants.

| SEQ ID NO: | GID No. | OE/KO | Trait(s) | Category | Observations |
|---|---|---|---|---|---|
| 1 | G3 | OB | Size | Dev and morph | Small plant |
|  |  | OE | Heat | Abiotic stress | More sensitive to heat in a growth assay |
| 5 | G5 | OE | Size | Dev and morph | Small plant |
| 11 | G8 | OE | Flowering time | Flowering time | Late flowering |
| 13 | G9 | OE | Root | Dev and morph | Increased root mass |
| 21 | G19 | OE | *Erysiphe* | Disease | Increased tolerance to *Erysiphe* |
|  |  |  | Hormone sensitivity | Hormone sensitivity | Repressed by methyl jasmonate and induced by ACC |
| 23 | G20 | OE | Seed sterols | Seed biochemistry | Increase in campesterol |
| 25 | G21 | OE | Size | Dev and morph | Reduced size |
| 27 | G22 | OE | Sodium chloride | Abiotic stress | Increased tolerance to high salt |
| 29 | G24 | OE | Morphology: other | Dev and morph | Reduced size |
|  |  | OE | Necrosis | Dev and morph | Necrotic patches |
| 31 | G25 | OE | Trichome | Dev and morph | Fewer trichomes at seedling stage |
|  |  | OE | *Fusarium* | Disease | Expression induced by *Fusarium* infection |
| 33 | G26 | OE | Sugar sensing | Sugar sensing | Decreased germination and growth on glucose medium |
| 35 | G27 | OE | Morphology: other | Dev and morph | Abnormal development, small |
| 37 | G28 | OE | *Botrytis* | Disease | Increased tolerance to *Botrytis* |
|  |  | OE | *Erysiphe* | Disease | Increased resistance to *Erysiphe* |
|  |  | OE | *Sclerotinia* | Disease | Increased tolerance to *Sclerotinia* |
| 39 | G32 | OE | Leaf | Dev and morph | Curled leaves |
| 41 | G38 | OE | Sugar sensing | Sugar sensing | Reduced germination on glucose medium |
| 49 | G43 | OE | Sugar sensing | Sugar sensing | Decreased germination and growth on glucose medium |
| 53 | G46 | OE | Size | Dev and morph | Increased size |
|  |  | OE | Drought | Abiotic stress | Increased tolerance to drought |
| 55 | G134 | OE | Flower | Dev and morph | Homeotic transformation |
|  |  | OE | Cold | Abiotic stress | Increased sensitivity to cold |
| 57 | G142 | OE | Flowering time | Flowering time | Early flowering |
| 59 | G145 | OE | Flowering time | Flowering time | Early flowering |
|  |  | OE | Inflorescence | Dev and morph | Terminal flowers |

TABLE 4-continued

Traits, trait categories, and effects and utilities that transcription factor genes have on plants.

| SEQ ID NO: | GID No. | OE/KO | Trait(s) | Category | Observations |
|---|---|---|---|---|---|
| 61 | G146 | OE | Abiotic stress | Abiotic stress | Better growth in low nitrogen |
|  |  | OE | Nutrient uptake | Abiotic stress | Altered C:N sensing: reduced anthocyanin production on high sucrose/low nitrogen |
|  |  | OE | Flowering time | Flowering time | Early flowering |
| 65 | G153 | OE | Abiotic stress | Abiotic stress | Tolerant to low nitrogen conditions |
| 67 | G156 | KO | Seed | Dev and morph | Seed color alteration |
| 69 | G157 | OE | Flowering time | Flowering time | Modest overexpression triggers early flowering; greater overexpression delays flowering |
| 71 | G162 | OE | Seed oil content | Seed biochemistry | Increased seed oil content |
|  |  | OE | Seed protein content | Seed biochemistry | Altered seed protein content |
| 77 | G171 | OE | Cold | Abiotic stress | Expression induced by cold and heat |
|  |  | OE | Heat | Abiotic stress |  |
| 87 | G180 | OE | Seed oil content | Seed biochemistry | Decreased seed oil |
|  |  | OE | Flowering time | Flowering time | Early flowering |
| 89 | G184 | OE | Flowering time | Flowering time | Early flowering |
|  |  | OE | Size | Dev and morph | Small plant |
| 91 | G185 | OE | Leaf glucosinolates | Leaf biochemistry | Increased M39481 |
|  |  | OE | Flowering time | Flowering time | Early flowering |
| 95 | G187 | OE | Morphology: other | Dev and morph | Variety of morphological alterations |
| 97 | G188 | KO | Osmotic | Abiotic stress | Better germination under osmotic stress |
|  |  | KO | *Fusarium* | Disease | Increased susceptibility to *Fusarium* |
| 101 | G192 | OE | Seed oil content | Seed biochemistry | Decreased oil content |
|  |  | OE | Flowering time | Flowering time | Late flowering |
| 103 | G194 | OE | Size | Dev and morph | Small plant |
| 105 | G196 | OE | Sodium chloride | Abiotic stress | Increased tolerance to high salt |
| 109 | G198 | OE | Flowering time | Flowering time | Late flowering |
| 111 | G201 | OE | Seed protein content | Seed biochemistry | Increased seed protein content |
|  |  | OE | Seed oil content | Seed biochemistry | Decreased seed oil content |
| 115 | G206 | OE | Seed | Dev and morph | Large seeds |
| 117 | G207 | OE | Sugar sensing | Sugar sensing | Decreased germination on glucose medium |
|  |  | KO | *Botrytis* | Disease | Increased susceptibility to *Botrytis* |
| 119 | G208 | OE | Flowering time | Flowering time | Early flowering |
| 121 | G211 | OE | Leaf insoluble sugars | Leaf biochemistry | Increase in xylose |
| 123 | G212 | OE | Trichome | Dev and morph | Partially to fully glabrous on adaxial surface of leaves |
| 127 | G214 | OE | Leaf fatty acids | Leaf biochemistry | Increased leaf fatty acids |
|  |  | OE | Leaf prenyl lipids | Leaf biochemistry | Increased leaf chlorophyll and carotenoids |
|  |  | OE | Flowering time | Flowering time | Late flowering |
|  |  | OE | Seed prenyl lipids | Seed biochemistry | Increased seed lutein |
| 135 | G222 | OE | Seed oil content | Seed biochemistry | Decreased seed oil content |
|  |  | OE | Seed protein content | Seed biochemistry | Increased seed protein content |
| 137 | G224 | OE | Cold | Abiotic stress | Increased tolerance to cold |
|  |  | OE | Leaf | Dev and morph | Altered leaf shape |
|  |  | OE | Sugar sensing | Sugar sensing | Increased germination and seedling vigor on high glucose |
| 139 | G225 | OE | Root | Dev and morph | Increased root hairs |
|  |  | OE | Trichome | Dev and morph | Glabrous, lack of trichomes |
|  |  | OE | Nutrient uptake | Abiotic stress | Increased tolerance to nitrogen-limited medium |
| 141 | G226 | OE | Nutrient uptake | Abiotic stress | Increased tolerance to nitrogen-limited medium |
|  |  | OE | Seed protein content | Seed biochemistry | Increased seed protein |
|  |  | OE | Root | Dev and morph | Increased root hairs |
|  |  | OE | Trichome | Dev and morph | Glabrous, lack of trichomes |
|  |  | OE | Sodium chloride | Abiotic stress | Increased tolerance to high salt |
| 143 | G227 | OE | Flowering time | Flowering time | Early flowering |
| 147 | G229 | OE | Seed protein content | Seed biochemistry | Decreased seed protein |
|  |  | OE | Seed oil content | Seed biochemistry | Increased seed oil |
|  |  | OE | Biochemistry: other | Biochem: misc | Up-regulation of genes involved in secondary metabolism |
| 151 | G231 | OE | Leaf fatty acids | Leaf biochemistry | Increased leaf unsaturated fatty acids |
|  |  | OE | Seed protein content | Seed biochemistry | Decreased seed protein content |
|  |  | OE | Seed oil content | Seed biochemistry | Increased seed oil content |
| 157 | G234 | OE | Flowering time | Flowering time | Late flowering, small plant |
| 159 | G237 | OE | Leaf insoluble sugars | Leaf biochemistry | Increased leaf insoluble sugars |
|  |  | OE | *Erysiphe* | Disease | Increased tolerance to *Erysiphe* |

TABLE 4-continued

Traits, trait categories, and effects and utilities that transcription factor genes have on plants.

| SEQ ID NO: | GID No. | OE/KO | Trait(s) | Category | Observations |
|---|---|---|---|---|---|
| 161 | G239 | OE | ABA | Abiotic stress | Expression induced by ABA |
| | | OE | Drought | Abiotic stress | Expression induced by drought |
| | | OE | Heat | Abiotic stress | Expression induced by heat |
| | | OE | Osmotic stress | Abiotic stress | Expression induced by osmotic stress |
| 163 | G241 | OE | Seed oil content | Seed biochemistry | Decreased seed oil |
| | | KO | Seed protein content | Seed biochemistry | Altered seed protein content |
| | | OE | Sugar sensing | Sugar sensing | Decreased germination and growth on glucose medium |
| 165 | G242 | OE | Leaf insoluble sugars | Leaf biochemistry | Increased arabinose |
| 169 | G247 | OE | Trichome | Dev and morph | Altered trichome distribution |
| 171 | G248 | OE | *Botrytis* | Disease | Increased susceptibility to *Botrytis* |
| 173 | G249 | OE | Flowering time | Flowering time | Late flowering |
| | | OE | Senescence | Dev and morph | Delayed senescence |
| 179 | G254 | OE | Sugar sensing | Sugar sensing | Decreased germination and growth on glucose medium |
| 181 | G255 | OE | Flowering time | Flowering time | Early flowering |
| 183 | G256 | OE | Cold | Abiotic stress | Better germination and growth in cold |
| 187 | G258 | OE | Size | Dev and morph | Reduced size |
| 191 | G261 | OE | *Botrytis* | Disease | Increased susceptibility to *Botrytis* |
| 193 | G263 | OE | Sugar sensing | Sugar sensing | Decreased root growth on sucrose medium, root specific expression |
| 199 | G274 | OE | Leaf insoluble sugars | Leaf biochemistry | Increased leaf arabinose |
| 203 | G280 | OE | Size | Dev and morph | Reduced size |
| | | OE | Leaf prenyl lipids | Leaf biochemistry | Increased delta and gamma tocopherol |
| 209 | G291 | OE | Seed oil content | Seed biochemistry | Increased seed oil content |
| 215 | G307 | OE | Leaf insoluble sugars | Leaf biochemistry | Altered leaf insoluble sugars |
| 217 | G308 | OE | Sugar sensing | Sugar sensing | No germination on glucose medium |
| 223 | G325 | OE | Osmotic | Abiotic stress | Better germination on high sucrose and high NaCl |
| 231 | G346 | OE | Leaf fatty acids | Leaf biochemistry | Altered leaf fatty acids |
| | | OE | Seed oil content | Seed biochemistry | Decreased seed oil |
| 235 | G351 | OE | Light response | Dev and morph | Altered leaf orientation and light green coloration |
| 237 | G361 | OE | Flowering time | Flowering time | Late flowering |
| 239 | G374 | KO | Embryo lethal | Dev and morph | Embryo lethal |
| 241 | G378 | OE | *Erysiphe* | Disease | Increased resistance |
| 245 | G385 | OE | Size | Dev and morph | Small plant |
| | | OE | Inflorescence | Dev and morph | Short inflorescence stems |
| | | OE | Leaf | Dev and morph | Dark green plant |
| 249 | G390 | OE | Flowering time | Flowering time | Early flowering |
| | | OE | Architecture | Dev and morph | Altered shoot development |
| 251 | G394 | OE | Cold | Abiotic stress | More sensitive to chilling |
| 261 | G409 | OE | *Erysiphe* | Disease | Increased tolerance to *Erysiphe* |
| 267 | G418 | OE | *Pseudomonas* | Disease | Increased tolerance |
| | | OE | Seed protein content | Seed biochemistry | Decreased seed protein content |
| 269 | G419 | OE | Nutrient uptake | Abiotic stress | Increased tolerance to potassium-free medium |
| 271 | G428 | OE | Leaf insoluble sugars | Leaf biochemistry | Increased leaf insoluble sugars |
| | | OE | Leaf | Dev and morph | Altered leaf shape |
| 273 | G431 | OE | Morphology: other | Dev and morph | Developmental defect, sterile |
| 275 | G434 | OE | Flowering time | Flowering time | Late flowering |
| 277 | G435 | OE | Leaf insoluble sugars | Leaf biochemistry | Increased leaf insoluble sugars |
| 283 | G438 | KO | Architecture | Dev and morph | Reduced branching |
| | | KO | Stem | Dev and morph | Reduced lignin |
| | | OE | Leaf | Dev and morph | Increased leaf size |
| | | OE | Leaf | Dev and morph | Altered leaf shape |
| 285 | G447 | OE | Size | Dev and morph | Reduced size |
| | | OE | Morphology: other | Dev and morph | Altered cotyledon shape |
| | | OE | Leaf | Dev and morph | Dark green leaves |
| 287 | G456 | OE | Seed protein content | Seed biochemistry | Decreased seed protein |
| | | OE | Seed oil content | Seed biochemistry | Increased seed oil |
| 291 | G464 | OE | Seed oil content | Seed biochemistry | Increased seed oil |
| | | OE | Heat | Abiotic stress | Better germination and growth in heat |
| | | OE | Leaf | Dev and morph | Altered leaf shape |
| | | OE | Seed protein content | Seed biochemistry | Decreased seed protein content |
| 295 | G470 | OE | Fertility | Dev and morph | Short stamen filaments |
| 301 | G475 | OE | Flowering time | Flowering time | Early flowering |
| 303 | G477 | OE | *Sclerotinia* | Disease | Increased susceptibility to *Sclerotinia* |
| | | OE | Oxidative | Abiotic stress | Increased sensitivity to oxidative stress |
| 305 | G482 | OE | Sodium chloride | Abiotic stress | Tolerant to high salt |
| 307 | G486 | OE | Flowering time | Flowering time | Late flowering |
| 309 | G489 | OE | Osmotic | Abiotic stress | Increased tolerance to osmotic stress |
| 313 | G502 | KO | Osmotic | Abiotic stress | Increased sensitivity to osmotic stress |

TABLE 4-continued

Traits, trait categories, and effects and utilities that transcription factor genes have on plants.

| SEQ ID NO: | GID No. | OE/KO | Trait(s) | Category | Observations |
|---|---|---|---|---|---|
| 317 | G509 | KO | Seed oil content | Seed biochemistry | Altered seed oil content |
| | | KO | Seed protein content | Seed biochemistry | Altered seed protein content |
| 327 | G515 | OE | Morphology: other | Dev and morph | Lethal when overexpressed |
| 331 | G521 | OE | Leaf | Dev and morph | Leaf cell expansion |
| 337 | G525 | OE | *Pseudomonas* | Disease | Increased tolerance to *Pseudomonas* |
| | | OE | Leaf insoluble sugars | Leaf biochemistry | Increased leaf insoluble sugars |
| 339 | G526 | OE | Osmotic | Abiotic stress | Increased sensitivity to osmotic stress |
| 343 | G536 | OE | Sugar sensing | Sugar sensing | Decreased germination and growth on glucose medium |
| 345 | G545 | OE | Sodium chloride | Abiotic stress | Susceptible to high salt |
| | | OE | Nutrient uptake | Abiotic stress | Increased tolerance to phosphate-free medium |
| | | OE | *Erysiphe* | Disease | Increased susceptibility to *Erysiphe* |
| | | OE | *Pseudomonas* | Disease | Increased susceptibility to *Pseudomonas* |
| | | OE | *Fusarium* | Disease | Increased susceptibility to Fusarium |
| 355 | G558 | OE | Defense gene expression | Disease | Increased expression of defense genes |
| 357 | G559 | OE | Architecture | Dev and morph | Loss of apical dominance |
| | | OE | Fertility | Dev and morph | Reduced fertility |
| 359 | G561 | OE | Seed oil content | Seed biochemistry | Altered seed oil content |
| | | OE | Nutrient uptake | Abiotic stress | Increased tolerance to potassium-free medium |
| 361 | G562 | OE | Flowering time | Flowering time | Late flowering |
| 369 | G567 | OE | Seed protein content | Seed biochemistry | Altered seed protein content |
| | | OE | Seed oil content | Seed biochemistry | Altered seed oil content |
| | | OE | Sugar sensing | Sugar sensing | Decreased seedling vigor on high glucose |
| 371 | G569 | OE | Defense gene expression | Disease | Decreased expression of defense genes |
| 375 | G571 | KO | Senescence | Dev and morph | Delayed senescence |
| | | KO | Flowering time | Flowering time | Late flowering |
| 379 | G578 | OE | Morphology: other | Dev and morph | Lethal when overexpressed |
| 381 | G580 | OE | Flower | Dev and morph | Altered development |
| | | OE | Architecture | Dev and morph | Altered inflorescences |
| 385 | G584 | OE | Seed | Dev and morph | Large seeds |
| 387 | G590 | KO | Seed oil content | Seed biochemistry | Increased seed oil content |
| | | OE | Flowering time | Flowering time | Early flowering |
| 389 | G591 | OE | *Erysiphe* | Disease | Increased tolerance to *Erysiphe* |
| | | OE | Flowering time | Flowering time | Late flowering |
| 391 | G592 | OE | Flowering time | Flowering time | Early flowering |
| 393 | G598 | OE | Seed oil content | Seed biochemistry | Increased seed oil |
| | | OE | Leaf insoluble sugars | Leaf biochemistry | Altered insoluble sugars |
| 395 | G605 | OE | Leaf fatty acids | Leaf biochemistry | Altered leaf fatty acid composition |
| 399 | G615 | OE | Architecture | Dev and morph | Altered plant architecture |
| | | OE | Fertility | Dev and morph | Little or no pollen production, poor filament elongation |
| 401 | G616 | OE | *Erysiphe* | Disease | Increased tolerance to *Erysiphe* |
| 403 | G624 | OE | Sodium chloride | Abiotic stress | Increased tolerance to high salt |
| | | | Size | Dev and morph | Increased biomass |
| | | | Nutrient uptake | Abiotic stress | Increased tolerance to low phosphate |
| | | | Flowering time | Flowering time | Late flowering |
| 405 | G627 | OE | Flowering time | Flowering time | Early flowering |
| 407 | G629 | OE | Leaf | Dev and morph | Altered leaf morphology |
| | | OE | Seed oil content | Seed biochemistry | Increased seed protein content |
| 409 | G630 | OE | Seed protein content | Seed biochemistry | Increased seed protein content, embryo specific expression |
| 415 | G634 | OE | Trichome | Dev and morph | Increased trichome density and size |
| 417 | G636 | OE | Senescence | Dev and morph | Premature senescence |
| | | OE | Size | Dev and morph | Reduced size |
| 419 | G638 | OE | Flower | Dev and morph | Altered flower development |
| 435 | G663 | OE | Seed oil content | Seed biochemistry | Decreased seed oil |
| | | OE | Seed protein content | Seed biochemistry | Increased seed protein |
| | | OE | Biochemistry: other | Biochem: misc | Increased anthocyanins in leaf, root, seed |
| 437 | G664 | OE | Cold | Abiotic stress | Better germination and growth in cold |
| 443 | G668 | OE | Seed protein content | Seed biochemistry | Increased seed protein content |
| | | OE | Seed oil content | Seed biochemistry | Decreased seed oil content |
| | | OE | Seed | Dev and morph | Reduced seed color |
| 447 | G670 | OE | Size | Dev and morph | Small plant |

TABLE 4-continued

Traits, trait categories, and effects and utilities that transcription factor genes have on plants.

| SEQ ID NO: | GID No. | OE/KO | Trait(s) | Category | Observations |
|---|---|---|---|---|---|
| 449 | G671 | OE | Stem | Dev and morph | Altered inflorescence stem structure |
|  |  | OE | Flower | Dev and morph | Reduced petal abscission |
|  |  | OE | Leaf | Dev and morph | Altered leaf shape |
|  |  | OE | Size | Dev and morph | Small plant |
|  |  | OE | Fertility | Dev and morph | Reduced fertility |
| 457 | G676 | OE | Trichome | Dev and morph | Reduced trichomes |
| 463 | G680 | OE | Flowering time | Flowering time | Late flowering |
|  |  | OE | Sugar sensing | Sugar sensing | Reduced germination on glucose medium |
| 465 | G681 | OE | Leaf glucosinolates | Leaf biochemistry | Increase in M39480 |
| 467 | G682 | OE | Heat | Abiotic stress | Better germination and growth in heat |
|  |  | OE | Trichome | Dev and morph | Glabrous, lack of trichomes |
| 473 | G718 | OE | Seed protein content | Seed biochemistry | Increased seed protein |
|  |  | OE | Leaf fatty acids | Leaf biochemistry | Altered leaf fatty acid composition |
|  |  | OE | Seed prenyl lipids | Seed biochemistry | Increased seed lutein |
|  |  | OE | Seed oil content | Seed biochemistry | Decreased seed oil |
| 483 | G732 | OE | Seed protein content | Seed biochemistry | One OE line had increased, another decreased seed protein content |
|  |  | OE | Seed oil content | Seed biochemistry | One OE line had increased, another decreased seed oil content |
|  |  | OE | Architecture | Dev and morph | Reduced apical dominance |
|  |  | OE | Flower | Dev and morph | Abnormal flowers |
| 487 | G736 | OE | Flowering time | Flowering time | Late flowering |
|  |  | OE | Leaf | Dev and morph | Altered leaf shape |
| 489 | G738 | OE | Flowering time | Flowering time | Late flowering |
|  |  | OE | Size | Dev and morph | Reduced size |
| 491 | G740 | OE | Morphology: other | Dev and morph | Slow growth |
| 497 | G748 | OE | Stem | Dev and morph | More vascular bundles in stem |
|  |  | OE | Flowering time | Flowering time | Late flowering |
|  |  | OE | Seed prenyl lipids | Seed biochemistry | Increased lutein content |
| 503 | G752 | OE | Flowering time | Flowering time | Late flowering |
| 507 | G760 | OE | Hormone sensitivity | Hormone sensitivity | Hypersensitive to ACC |
|  |  | OE | Size | Dev and morph | Reduced size |
| 519 | G776 | OE | Seed oil composition | Seed biochemistry | Altered seed fatty acid composition |
| 521 | G777 | OE | Seed oil content | Seed biochemistry | Decreased seed oil |
|  |  | OE | Leaf insoluble sugars | Leaf biochemistry | Increased leaf rhamnose |
| 523 | G778 | OE | Seed oil composition | Seed biochemistry | Increased seed 18:1 fatty acid |
| 525 | G779 | OE | Fertility | Dev and morph | Reduced fertility |
|  |  | OE | Flower | Dev and morph | Homeotic transformations |
| 529 | G782 | OE | Sugar sensing | Sugar sensing | Better germination and growth on sucrose medium |
| 531 | G783 | OE | Sugar sensing | Sugar sensing | Better germination and growth on sucrose medium |
| 539 | G789 | OE | *Sclerotinia* | Disease | Increased susceptibility to *Sclerotinia* |
|  |  | OE | Flowering time | Flowering time | Early flowering |
|  |  | OE | Oxidative | Abiotic stress | Increased sensitivity |
| 541 | G791 | OE | Seed oil composition | Seed biochemistry | Decreased seed fatty acid composition |
|  |  | OE | Leaf insoluble sugars | Leaf biochemistry | Altered leaf cell wall polysaccharide composition |
|  |  | OE | Leaf fatty acids | Leaf biochemistry | Altered leaf fatty acid composition |
| 549 | G801 | OE | Sodium chloride | Abiotic stress | Better germination on NaCl |
| 553 | G805 | OE | *Sclerotinia* | Disease | Increased susceptibility to *Sclerotinia* |
| 557 | G831 | OE | Size | Dev and morph | Reduced size |
| 565 | G849 | KO | Seed protein content | Seed biochemistry | Altered seed protein content |
|  |  | KO | Seed oil content | Seed biochemistry | Increased seed oil content |
| 567 | G859 | OE | Flowering time | Flowering time | Late flowering |
| 571 | G861 | OE | Seed oil composition | Seed biochemistry | Increase in 16:1 |
| 573 | G864 | OE | Size | Dev and morph | Small plant |
|  |  | OE | Cold | Abiotic stress | Adult stage chilling sensitivity |
|  |  | OE | Heat | Abiotic stress | Better germination in heat |
| 575 | G865 | OE | *Erysiphe* | Disease | Increased susceptibility to *Erysiphe* |
|  |  | OE | Seed protein content | Seed biochemistry | Increased seed protein |
|  |  | OE | *Botrytis* | Disease | Increased susceptibility to *Botrytis* |
|  |  | OE | Flowering time | Flowering time | Early flowering |
|  |  | OE | Morphology: other | Dev and morph | Altered morpholoy |
| 579 | G867 | OE | Sugar sensing | Sugar sensing | Better seedling vigor on sucrose medium |
|  |  | OE | Sodium chloride | Abiotic stress | Better seedling vigor on high salt |
| 581 | G869 | OE | Leaf insoluble sugars | Leaf biochemistry | Increased fucose |
|  |  | OE | *Erysiphe* | Disease | Increased tolerance to *Erysiphe* |
|  |  | OE | Morphology: other | Dev and morph | Small and spindly plant |
|  |  | OE | Flower | Dev and morph | Abnormal anther development |
|  |  | OE | Seed oil composition | Seed biochemistry | Altered seed fatty acids |
|  |  | OE | Leaf fatty acids | Leaf biochemistry | Altered leaf fatty acids |

TABLE 4-continued

Traits, trait categories, and effects and utilities that transcription factor genes have on plants.

| SEQ ID NO: | GID No. | OE/KO | Trait(s) | Category | Observations |
|---|---|---|---|---|---|
| 583 | G877 | KO | Embryo lethal | Dev and morph | Embryo lethal |
| 585 | G878 | OE | Senescence | Dev and morph | Delayed senescence |
|  |  | OE | Flowering time | Flowering time | Late flowering |
| 587 | G881 | OE | *Botrytis* | Disease | Increased susceptibility to *Botrytis* |
|  |  | OE | *Erysiphe* | Disease | Increased susceptibility to *Erysiphe* |
| 589 | G883 | OE | Seed prenyl lipids | Seed biochemistry | Decreased seed lutein |
| 591 | G884 | OE | Sodium chloride | Abiotic stress | Increased root growth in high salt |
|  |  | OE | Size | Dev and morph | Reduced size |
| 595 | G896 | KO | *Fusarium* | Disease | Increased susceptibility to *Fusarium* |
| 603 | G903 | OE | Leaf | Dev and morph | Altered leaf morphology |
| 605 | G905 | OE | Flowering time | Flowering time | Late flowering |
|  |  | OE | Leaf | Dev and morph | Altered leaf shape |
|  |  | OE | Sugar sensing | Sugar sensing | Increased seedling vigor on high glucose |
| 613 | G911 | OE | Nutrient uptake | Abiotic stress | Increased growth on potassium-free medium |
|  |  | OE | Seed protein content | Seed biochemistry | Increased seed protein content |
|  |  | OE | Seed oil content | Seed biochemistry | Decreased seed oil content |
| 615 | G912 | OE | Freezing | Abiotic stress | Increased freezing tolerance |
|  |  | OE | Morphology: other | Dev and morph | Dark green color |
|  |  | OE | Drought | Abiotic stress | Increased survival in drought conditions |
|  |  | OE | Sugar sensing | Sugar sensing | Reduced cotyledon expansion in glucose |
|  |  | OE | Size | Dev and morph | Small plant |
|  |  | OE | Flowering time | Flowering time | Late flowering |
| 619 | G921 | OE | Osmotic | Abiotic stress | Increased sensitivity to osmotic stress |
|  |  | OE | Leaf | Dev and morph | Serrated leaves |
| 627 | G932 | OE | Leaf | Dev and morph | Altered development, dark green color |
|  |  | OE | Size | Dev and morph | Reduced size |
| 631 | G938 | OE | Seed oil composition | Seed biochemistry | Overexpressors had increased 16:0, 18:0, 20:0, and 18:3 fatty acids, decreased 18:2, 20:1, 22:1 fatty acids |
| 633 | G961 | KO | Seed oil content | Seed biochemistry | Increased seed oil content |
| 635 | G964 | OE | Heat | Abiotic stress | More tolerant to heat in germination assay |
| 637 | G965 | OE | Seed oil composition | Seed biochemistry | Increase in 18:1 fatty acid |
| 639 | G971 | OE | Flowering time | Flowering time | Late flowering |
| 641 | G974 | OE | Seed oil content | Seed biochemistry | Altered seed oil content |
| 643 | G975 | OE | Leaf fatty acids | Leaf biochemistry | Increased wax in leaves |
| 647 | G977 | OE | Size | Dev and morph | Small plant |
|  |  | OE | Morphology: other | Dev and morph | Dark green |
|  |  | OE | Leaf | Dev and morph | Altered leaf shape |
|  |  | OE | Fertility | Dev and morph | Reduced fertility |
| 649 | G979 | KO | Seed | Dev and morph | Altered seed development, ripening, and germination |
| 653 | G987 | KO | Leaf fatty acids | Leaf biochemistry | Reduction in 16:3 fatty acid |
|  |  | KO | Leaf prenyl lipids | Leaf biochemistry | Presence of two xanthophylls, tocopherol not normally found in leaves; reduced chlorophyll a and b |
| 655 | G991 | OE | Size | Dev and morph | Slightly reduced size |
| 657 | G994 | OE | Flowering time | Flowering time | Late flowering |
|  |  | OE | Size | Dev and morph | Small plants |
| 659 | G996 | OE | Sugar sensing | Sugar sensing | Reduced germination on glucose medium |
| 671 | G1012 | OE | Leaf insoluble sugars | Leaf biochemistry | Decreased rhamnose |
| 673 | G1020 | OE | Size | Dev and morph | Very small T1 plants |
| 677 | G1023 | OE | Size | Dev and morph | Reduced size |
| 685 | G1037 | KO | Flowering time | Flowering time | Early flowering |
| 687 | G1038 | OE | Leaf | Dev and morph | Altered leaf shape |
|  |  | OE | Leaf insoluble sugars | Leaf biochemistry | Decreased insoluble sugars |
| 695 | G1048 | OE | *Erysiphe* | Disease | Increased tolerance to *Erysiphe orontii* |
|  |  | OE | Seed protein content | Seed biochemistry | Increased seed protein content |
| 697 | G1050 | OE | Senescence | Dev and morph | Delayed senescence |
| 699 | G1052 | OE | Flowering time | Flowering time | Late flowering |
|  |  | OE | Seed prenyl lipids | Seed biochemistry | Decrease in lutein and increase in xanthophyll 1 |
| 701 | G1053 | OE | Size | Dev and morph | Small plant |
| 713 | G1062 | KO | Light response | Dev and morph | Constitutive photomorphogenesis |
|  |  | KO | Hormone sensitivity | Hormone sensitivity | Altered response to ethylene |
|  |  | KO | Seed | Dev and morph | Altered seed shape |
|  |  | KO | Morphology: other | Dev and morph | Slow growth |

TABLE 4-continued

Traits, trait categories, and effects and utilities that transcription factor genes have on plants.

| SEQ ID NO: | GID No. | OE/KO | Trait(s) | Category | Observations |
|---|---|---|---|---|---|
| 717 | G1067 | OE | Leaf | Dev and morph | Altered leaf shape |
| | | OE | Size | Dev and morph | Small plant |
| | | OE | Fertility | Dev and morph | Reduced fertility |
| 719 | G1068 | OE | Sugar sensing | Sugar sensing | Reduced cotyledon expansion in glucose |
| 721 | G1069 | OE | Osmotic | Abiotic stress | Better germination under osmotic stress |
| | | OE | Hormone sensitivity | Hormone sensitivity | Reduced ABA sensitivity |
| | | OE | Leaf glucosinolates | Leaf biochemistry | Altered composition |
| 723 | G1073 | OE | Size | Dev and morph | Increased plant size |
| | | OE | Leaf | Dev and morph | Serrated leaves |
| | | OE | Flowering time | Flowering time | Flowering slightly delayed |
| 725 | G1075 | OE | Size | Dev and morph | Small plant |
| | | OE | Flower | Dev and morph | Reduced or absent petals, sepals and stamens |
| | | OE | Fertility | Dev and morph | Reduced fertility |
| | | OE | Leaf | Dev and morph | Altered leaf shape |
| 727 | G1076 | OE | Morphology: other | Dev and morph | Lethal when overexpressed |
| 731 | G1089 | KO | Osmotic | Abiotic stress | Better germination under osmotic stress |
| | | OE | Morphology: other | Dev and morph | Developmental defects at seedling stage |
| 737 | G1128 | OE | Leaf | Dev and morph | Dark green leaves |
| | | OE | Senescence | Dev and morph | Premature leaf and flower senescence |
| 739 | G1133 | OE | Leaf prenyl lipids | Leaf biochemistry | Decreased leaf lutein |
| 741 | G1134 | OE | Silique | Dev and morph | Siliques with altered shape |
| | | OE | Hormone sensitivity | Hormone sensitivity | Altered response to the growth hormone ethylene |
| 745 | G1136 | OE | Flowering time | Flowering time | Late flowering |
| | | OE | Nutrient uptake | Abiotic stress | Increased sensitivity to low nitrogen |
| 749 | G1145 | OE | Seed | Seed morphology | Reduced seed size |
| | | OE | Seed | Seed morphology | Altered seed shape |
| 753 | G1181 | OE | Size | Dev and morph | Small T1 plants |
| 759 | G1190 | OE | Seed oil content | Seed biochemistry | Increased seed oil content |
| 763 | G1198 | OE | Seed oil content | Seed biochemistry | Increased seed oil content |
| | | OE | Leaf glucosinolates | Leaf biochemistry | Altered glucosinolate composition |
| 775 | G1228 | OE | Size | Dev and morph | Reduced size |
| 787 | G1242 | OE | Flowering time | Flowering time | Early flowering |
| 793 | G1255 | OE | Seed | Dev and morph | Increased seed size |
| | | OE | Morphology: other | Dev and morph | Reduced apical dominance |
| | | OE | Botrytis | Disease | Increased susceptibility to Botrytis |
| 799 | G1266 | OE | Leaf fatty acids | Leaf biochemistry | Changes in leaf fatty acids |
| | | OE | Erysiphe | Disease | Increased tolerance to Erysiphe |
| | | OE | Size | Dev and morph | Small plant |
| | | OE | Fertility | Dev and morph | Reduced fertility |
| | | OE | Leaf insoluble sugars | Leaf biochemistry | Changes in leaf insoluble sugars |
| 801 | G1267 | OE | Size | Dev and morph | Small plant |
| | | OE | Leaf | Leaf morphology | Dark green leaves |
| | | OE | Leaf | Leaf morphology | Shiny leaves |
| 803 | G1269 | OE | Leaf | Dev and morph | Long petioles, upturned leaves |
| 805 | G1274 | OE | Cold | Abiotic stress | Increased tolerance to cold |
| | | OE | Nutrient uptake | Abiotic stress | Increased tolerance to nitrogen-limited medium |
| | | OE | Morphology: other | Dev and morph | Inflorescence architecture |
| | | OE | Leaf | Dev and morph | Large leaves |
| 807 | G1275 | OE | Size | Dev and morph | Small plant |
| | | OE | Architecture | Dev and morph | Reduced apical dominance |
| 809 | G1277 | OE | Size | Dev and morph | Small plant |
| 817 | G1304 | OE | Morphology: other | Dev and morph | Lethal when overexpressed |
| 819 | G1305 | OE | Flowering time | Flowering time | Early flowering |
| | | OE | Heat | Abiotic stress | Reduced chlorosis at high temperature |
| 825 | G1309 | OE | Size | Dev and morph | Small plant |
| | | OE | Leaf insoluble sugars | Leaf biochemistry | Increased mannose |
| 827 | G1311 | OE | Fertility | Dev and morph | Reduced fertility |
| | | OE | Size | Dev and morph | Small plant |
| 829 | G1313 | OE | Morphology: other | Dev and morph | Increased seedling size |
| 831 | G1314 | OE | Sugar sensing | Sugar sensing | Reduced seedling vigor on high glucose |
| | | OE | Size | Dev and moph | Reduced size |
| 837 | G1317 | OE | Size | Dev and morph | Reduced size |
| 841 | G1322 | OE | Cold | Abiotic stress | Increased seedling vigor in cold conditions |
| | | OE | Leaf glucosinolates | Leaf biochemistry | Increase in M39480 |

TABLE 4-continued

Traits, trait categories, and effects and utilities that transcription factor genes have on plants.

| SEQ ID NO: | GID No. | OE/KO | Trait(s) | Category | Observations |
|---|---|---|---|---|---|
| | | OE | Light response | Dev and morph | Photomorphogenesis in the dark |
| | | OE | Size | Dev and morph | Reduced size |
| 843 | G1323 | OE | Seed oil content | Seed biochemistry | Decreased seed oil |
| | | OE | Seed protein content | Seed biochemistry | Increased seed protein |
| | | OE | Size | Dev and morph | Small T1 plants, dark green |
| 845 | G1324 | OE | Leaf prenyl lipids | Leaf biochemistry | Decreased leaf lutein, increased leaf xanthophyll |
| 849 | G1326 | OE | Flower | Dev and morph | Petals and sepals are smaller |
| | | OE | Size | Dev and morph | Small plant |
| | | OE | Fertility | Dev and morph | Reduced fertility |
| 851 | G1327 | OE | Leaf | Dev and morph | Dark green leaves |
| 853 | G1328 | OE | Seed prenyl lipids | Seed biochemistry | Decreased seed lutein |
| 855 | G1332 | OE | Trichome | Dev and morph | Reduced trichome density |
| | | OE | Size | Dev and morph | Reduced plant size |
| 857 | G1334 | OE | Size | Dev and morph | Small plants |
| | | OE | Leaf | Leaf morphology | Dark green leaves |
| 859 | G1335 | OE | Flowering time | Flowering time | Late flowering |
| | | OE | Dev and morph | Dev and morph | Slow growth |
| 861 | G1337 | OE | Sugar sensing | Sugar sensing | Decreased germination on sucrose medium |
| | | OE | Leaf fatty acids | Leaf biochemistry | Altered leaf fatty acid composition |
| 867 | G1380 | OE | Flowering time | Flowering time | Early flowering |
| 869 | G1382 | OE | Size | Dev and morph | Small plant |
| 877 | G1399 | OE | Leaf fatty acids | Leaf biochemistry | Altered composition |
| 879 | G1412 | OE | Hormone sensitivity | Hormone sensitivity | ABA insensitive |
| | | | Osmotic | Abiotic stress | Increased tolerance to osmotic stress |
| 881 | G1417 | KO | Morphology: other | Dev and morph | Reduced seedling germination and vigor |
| | | KO | Seed oil composition | Seed biochemistry | Increase in 18:2, decrease in 18:3 fatty acids |
| 883 | G1425 | OE | Flower | Dev and morph | Altered flower and inflorescence development |
| 887 | G1435 | OE | Flowering time | Flowering time | Late flowering |
| | | OE | Size | Dev and morph | Increased plant size |
| 891 | G1449 | OE | Seed protein content | Seed biochemistry | Increased seed protein content |
| | | OE | Flower | Dev and morph | Altered flower structure |
| 893 | G1451 | OE | Leaf | Dev and morph | Large leaf size |
| | | KO | Seed oil content | Seed biochemistry | Altered seed oil content |
| | | OE | Morphology: other | Dev and morph | Increased plant size |
| | | OE | Flowering time | Flowering time | Late flowering |
| 895 | G1468 | OE | Flowering time | Flowering time | Late flowering |
| | | | Size | Dev and morph | Increased biomass |
| | | | Leaf | Dev and morph | Grayish and narrow leaves |
| | | | Morphology: other | Dev and morph | Slow growth rate |
| 897 | G1471 | OE | Seed oil content | Seed biochemistry | Increased seed oil content |
| 899 | G1472 | OE | Morphology: other | Dev and morph | No shoot meristem |
| 901 | G1474 | OE | Morphology: other | Dev and morph | Reduced plant size |
| | | OE | Flowering time | Flowering time | Late flowering |
| | | OE | Inflorescence | Dev and morph | Inflorescence architecture |
| 903 | G1476 | OE | Morphology: other | Dev and morph | Faster seedling growth rate |
| 905 | G1482 | KO | Root | Dev and morph | Increased root growth |
| | | OE | Biochemistry: other | Biochem: misc | Increased anthocyanins |
| 911 | G1493 | OE | Sugar sensing | Sugar sensing | Increased seedling vigor on high glucose |
| | | OE | Flowering time | Flowering time | Late flowering |
| | | OE | Leaf | Dev and morph | Altered leaf shape |
| 913 | G1499 | OE | Architecture | Dev and morph | Altered plant architecture |
| | | OE | Flower | Dev and morph | Altered floral organ identity and development |
| | | OE | Morphology: other | Dark green color | Dark green leaves |
| 919 | G1540 | OE | Morphology: other | Dev and morph | Reduced cell differentiation in meristem |
| 921 | G1545 | OE | Flowering time | Flowering time | Early flowering |
| | | OE | Size | Dev and morph | Reduced size |
| 925 | G1560 | OE | Fertility | Dev and morph | Reduced fertility |
| | | OE | Size | Dev and morph | Reduced size |
| | | OE | Flower | Dev and morph | Abnormal flowers |
| 927 | G1634 | OE | Seed protein content | Seed biochemistry | Altered seed protein content |
| 929 | G1645 | OE | Inflorescence | Dev and morph | Altered inflorescence structure |
| | | OE | Leaf | Dev and morph | Altered leaf development |
| | | OE | Heat | Abiotic stress | Reduced germination vigor |
| 937 | G1760 | OE | Flowering time | Flowering time | Early flowering |
| 939 | G1816 | OE | Trichome | Dev and morph | Glabrous |
| | | OE | Root | Dev and morph | Ectopic root hairs, more root hairs |

TABLE 4-continued

Traits, trait categories, and effects and utilities that transcription factor genes have on plants.

| SEQ ID NO: | GID No. | OE/KO | Trait(s) | Category | Observations |
|---|---|---|---|---|---|
| | | OE | Nutrient uptake | Abiotic stress | Improved tolerance to low nitrogen |
| | | OE | Sugar sensing | Sugar sensing | Insensitive to growth retardation effects of high glucose |
| 941 | G1820 | OE | Pigment | Dev and morph | Reduced pigment |
| | | OE | Osmotic | Abiotic stress | Better germination in NaCl |
| | | OE | Seed protein content | Seed biochemistry | Increased seed protein content |
| | | | Seed oil content | Seed biochemistry | Decreased seed oil content |
| | | OE | Hormone sensitivity | Hormone sensitivity | Reduced ABA sensitivity |
| | | OE | Flowering time | Flowering time | Early flowering |
| | | OE | Drought | Abiotic stress | Increased tolerance to drought |
| 943 | G1842 | OE | Flowering time | Flowering time | Early flowering |
| 945 | G1843 | OE | Flowering time | Flowering time | Early flowering |
| 949 | G1947 | KO | Fertility | Dev and morph | Reduced fertility |
| | | KO | Flower | Dev and morph | Extended period of flowering |
| 951 | G2010 | OE | Flowering time | Flowering time | Early flowering |
| 957 | G2347 | OE | Flowering time | Flowering time | Early flowering |
| 959 | G2718 | OE | Trichome | Devel and morph | Reduction in trichome density ranging from mild to glabrous |
| | | OE | Nutrient uptake | Abiotic stress | Tolerant to low nitrogen conditions |
| | | OE | Root | Dev and morph | Ectopic root hairs, more root hairs |
| | | OE | Pigment | Dev and morph | Reduced pigment |

Tables 5A and 5B show the polypeptides identified by SEQ ID NO; Mendel Gene ID (GID) No.; the transcription factor family to which the polypeptide belongs, and conserved domains of the polypeptide. The first column shows the polypeptide SEQ ID NO; the third column shows the transcription factor family to which the polynucleotide belongs; and the fourth column shows the amino acid residue positions of the conserved domain in amino acid (AA) co-ordinates.

TABLE 5A

Gene families and conserved domains

| Polypeptide SEQ ID NO: | GID No. | Family | Conserved Domains in Amino Acid Coordinates |
|---|---|---|---|
| 2 | G3 | AP2 | 28-95 |
| 4 | G4 | AP2 | 121-188 |
| 6 | G5 | AP2 | 149-216 |
| 8 | G6 | AP2 | 22-89 |
| 10 | G7 | AP2 | 58-125 |
| 12 | G8 | AP2 | 151-217, 243-296 |
| 14 | G9 | AP2 | 62-127 |
| 16 | G10 | AP2 | 21-88 |
| 18 | G13 | AP2 | 19-86 |
| 20 | G14 | AP2 | 122-189 |
| 22 | G19 | AP2 | 76-145 |
| 24 | G20 | AP2 | 68-144 |
| 26 | G21 | AP2 | 97-164 |
| 28 | G22 | AP2 | 89-157 |
| 30 | G24 | AP2 | 25-93 |
| 32 | G25 | AP2 | 47-114 |
| 34 | G26 | AP2 | 67-134 |
| 36 | G27 | AP2 | 37-104 |
| 38 | G28 | AP2 | 145-213 |
| 40 | G32 | AP2 | 17-84 |
| 42 | G38 | AP2 | 76-143 |
| 44 | G40 | AP2 | 45-112 |
| 46 | G41 | AP2 | 39-106 |
| 48 | G42 | AP2 | 48-115 |
| 50 | G43 | AP2 | 104-172 |
| 52 | G44 | AP2 | 85-154 |
| 54 | G46 | AP2 | 107-175 |
| 56 | G134 | MADS | 1-57 |

TABLE 5A-continued

Gene families and conserved domains

| Polypeptide SEQ ID NO: | GID No. | Family | Conserved Domains in Amino Acid Coordinates |
|---|---|---|---|
| 58 | G142 | MADS | 2-57 |
| 60 | G145 | MADS | 1-57 |
| 62 | G146 | MADS | 1-57 |
| 64 | G152 | MADS | 2-57 |
| 66 | G153 | MADS | 1-57 |
| 68 | G156 | MADS | 2-57 |
| 70 | G157 | MADS | 2-57 |
| 72 | G162 | MADS | 2-57 |
| 74 | G166 | MADS | 2-56 |
| 76 | G170 | MADS | 2-57 |
| 78 | G171 | MADS | 1-57 |
| 80 | G173 | MADS | 1-57 |
| 82 | G176 | WRKY | 117-173, 234-290 |
| 84 | G177 | WRKY | 166-221, 328-384 |
| 86 | G179 | WRKY | 65-121 |
| 88 | G180 | WRKY | 118-174 |
| 90 | G184 | WRKY | 295-352 |
| 92 | G185 | WRKY | 113-172 |
| 94 | G186 | WRKY | 312-369 |
| 96 | G187 | WRKY | 172-228 |
| 98 | G188 | WRKY | 175-222 |
| 100 | G190 | WRKY | 110-169 |
| 102 | G192 | WRKY | 128-185 |
| 104 | G194 | WRKY | 174-230 |
| 106 | G196 | WRKY | 223-283 |
| 108 | G197 | MYB-(R1)R2R3 | 14-119 |
| 110 | G198 | MYB-(R1)R2R3 | 14-117 |
| 112 | G201 | MYB-(R1)R2R3 | 14-114 |
| 114 | G203 | MYB-(R1)R2R3 | 93-191 |
| 116 | G206 | MYB-(R1)R2R3 | 13-116 |
| 118 | G207 | MYB-(R1)R2R3 | 6-106 |
| 120 | G208 | MYB-(R1)R2R3 | 14-116 |
| 122 | G211 | MYB-(R1)R2R3 | 24-137 |
| 124 | G212 | MYB-(R1)R2R3 | 15-116 |
| 126 | G213 | MYB-(R1)R2R3 | 20-120 |
| 128 | G214 | MYB-related | 22-71 |
| 130 | G215 | MYB-related | 117-184 |
| 132 | G216 | MYB-(R1)R2R3 | 19-151 |
| 134 | G220 | MYB-(R1)R2R3 | 15-116 |

TABLE 5A-continued

Gene families and conserved domains

| Polypeptide SEQ ID NO: | GID No. | Family | Conserved Domains in Amino Acid Coordinates |
|---|---|---|---|
| 136 | G222 | MYB-(R1)R2R3 | 13-119 |
| 138 | G224 | PMR | 7-114 |
| 140 | G225 | MYB-related | 39-76 |
| 142 | G226 | MYB-related | 28-78 |
| 144 | G227 | MYB-(R1)R2R3 | 13-112 |
| 146 | G228 | MYB-related | 59-135 |
| 148 | G229 | MYB-(R1)R2R3 | 14-120 |
| 150 | G230 | MYB-(R1)R2R3 | 13-114 |
| 152 | G231 | MYB-(R1)R2R3 | 14-118 |
| 154 | G232 | MYB-(R1)R2R3 | 14-115 |
| 156 | G233 | MYB-(R1)R2R3 | 14-114 |
| 158 | G234 | MYB-(R1)R2R3 | 14-115 |
| 160 | G237 | MYB-(R1)R2R3 | 11-113 |
| 162 | G239 | MYB-(R1)R2R3 | 21-125 |
| 164 | G241 | MYB-(R1)R2R3 | 14-114 |
| 166 | G242 | MYB-(R1)R2R3 | 6-105 |
| 168 | G245 | MYB-(R1)R2R3 | 14-114 |
| 170 | G247 | MYB-(R1)R2R3 | 15-116 |
| 172 | G248 | MYB-(R1)R2R3 | 264-332 |
| 174 | G249 | MYB-(R1)R2R3 | 19-116 |
| 176 | G251 | MYB-(R1)R2R3 | 9-112 |
| 178 | G252 | MYB-(R1)R2R3 | 14-115 |
| 180 | G254 | MYB-related | 62-106 |
| 182 | G255 | MYB-(R1)R2R3 | 14-115 |
| 184 | G256 | MYB-(R1)R2R3 | 13-115 |
| 186 | G257 | MYB-(R1)R2R3 | 20-120 |
| 188 | G258 | MYB-(R1)R2R3 | 24-124 |
| 190 | G260 | HS | |
| 192 | G261 | HS | |
| 194 | G263 | HS | |
| 196 | G266 | HS | 45-135 |
| 198 | G270 | AKR | 259-424 |
| 200 | G274 | AKR | |
| 202 | G279 | HMG | |
| 204 | G280 | AT-hook | 97-104, 130-137-155-162, 185-192 |
| 206 | G285 | MISC | |
| 208 | G290 | SWI/SNF | 538-784, 919-958, 1086-1169 |
| 210 | G291 | MISC | 132-160 |
| 212 | G295 | bZIP | 287-354 |
| 214 | G301 | | |
| 216 | G307 | SCR | 323-339 |
| 218 | G308 | SCR | 270-274 |
| 220 | G313 | SCR | 11-279 |
| 222 | G315 | SCR | 205-209 |
| 224 | G325 | Z-CO-like | 5-28, 48-71 |
| 226 | G326 | Z-CO-like | 11-94, 354-400 |
| 228 | G335 | Z-Tall-1 | 205-218 |
| 230 | G341 | Z-C3H | 254-374 |
| 232 | G346 | GATA/Zn | 196-221 |
| 234 | G348 | RING/C3HC4 | 28-53 |
| 236 | G351 | Z-C2H2 | 77-97, 118-140 |
| 238 | G361 | Z-C2H2 | 43-63 |
| 240 | G374 | Z-ZPF | 35-67, 286-318 |
| 242 | G378 | RFNG/C3H2C3 | 196-237 |
| 244 | G384 | HB | 14-77 |
| 246 | G385 | HB | 60-123 |
| 248 | G389 | HB | 84-147 |
| 250 | G390 | HB | 18-81 |
| 252 | G394 | HB | 121-182 |
| 254 | G395 | HB | 72-135 |
| 256 | G398 | HB | 128-191 |
| 258 | G399 | HB | |
| 260 | G404 | HB | 65-128 |
| 262 | G409 | HB | 64-124 |
| 264 | G413 | HB | 37-97 |
| 266 | G414 | HB | 61-124 |
| 268 | G418 | HB | 500-560 |
| 270 | G419 | HB | 392-452 |
| 272 | G428 | HB | 229-292 |
| 274 | G431 | HB | 286-335 |
| 276 | G434 | HB | 39-99 |
| 278 | G435 | HB | 4-67 |
| 280 | G436 | HB | 22-85 |
| 282 | G437 | HB | 13-76 |
| 284 | G438 | HB | 22-85 |
| 286 | G447 | ARF | 22-356 |
| 288 | G456 | IAA | 7-14, 71-81, 120-153, 185-221 |
| 290 | G462 | IAA | |
| 292 | G464 | IAA | 20-28, 71-82, 126-142, 187-224 |
| 294 | G467 | IAA | |
| 296 | G470 | ARF | 61-393 |
| 298 | G471 | ARF | 22-354 |
| 300 | G472 | ARF | 12-343 |
| 302 | G475 | SBP | 53-127 |
| 304 | G477 | SBP | 108-233 |
| 306 | G482 | CAAT | 25-116 |
| 308 | G486 | CAAT | 5-66 |
| 310 | G489 | CAAT | 57-156 |
| 312 | G501 | NAC | |
| 314 | G502 | NAC | 10-155 |
| 316 | G503 | NAC | 12-158 |
| 318 | G509 | NAC | 13-169 |
| 320 | G511 | NAC | 8-159 |
| 322 | G512 | NAC | 24-160 |
| 324 | G513 | NAC | 16-161 |
| 326 | G514 | NAC | 19-161 |
| 328 | G515 | NAC | 6-144 |
| 330 | G516 | NAC | 10-131 |
| 332 | G521 | NAC | 7-156 |
| 334 | G523 | NAC | 20-140 |
| 336 | G524 | NAC | 18-157 |
| 338 | G525 | NAC | 23-167 |
| 340 | G526 | NAC | 21-149 |
| 342 | G528 | GF14 | 230-237 |
| 344 | G536 | GF14 | 226-233 |
| 346 | G545 | Z-C2H2 | 82-102, 136-154 |
| 348 | G548 | HS | 12-101 |
| 350 | G553 | bZIP | 94-160 |
| 352 | G554 | bZIP | 82-142 |
| 354 | G555 | bZIP | 38-110 |
| 356 | G558 | bZIP | 45-105 |
| 358 | G559 | bZIP | 203-264 |
| 360 | G561 | bZIP | 248-308 |
| 362 | G562 | bZIP | 253-315 |
| 364 | G563 | bZIP | 186-248 |
| 366 | G564 | bZIP | 22-82 |
| 368 | G566 | bZIP | 227-290 |
| 370 | G567 | bZIP | 210-270 |
| 372 | G569 | bZIP | 90-153 |
| 374 | G570 | bZIP | 370-430 |
| 376 | G571 | bZIP | 160-220, 441-452 |
| 378 | G572 | bZIP | 120-186 |
| 380 | G578 | bZIP | 36-96 |
| 382 | G580 | bZIP | 162-218 |
| 384 | G582 | HLH/MYC | 152-204 |
| 386 | G584 | HLH/MYC | 401-494 |
| 388 | G590 | HLH/MYC | 202-254 |
| 390 | G591 | HLH/MYC | 143-240 |
| 392 | G592 | HLH/MYC | 290-342 |
| 394 | G598 | DBP | 205-263 |
| 396 | G605 | AT-hook | 132-143 |
| 398 | G610 | BPF-1 | 330-410, 530-622 |
| 400 | G615 | TEO | 88-147 |
| 402 | G616 | TEO | 39-95 |
| 404 | G624 | ABI3/VP-1 | 327-406 |
| 406 | G627 | MADS | 1-57 |
| 408 | G629 | bZIP | 92-152 |
| 410 | G630 | bZIP | 74-146 |
| 412 | G631 | bZIP | 212-282 |
| 414 | G632 | TH | 70-160 |
| 416 | G634 | TH | 62-147, 189-245 |
| 418 | G636 | TH | 55-145, 405-498 |
| 420 | G638 | TH | 119-206 |

TABLE 5A-continued

Gene families and conserved domains

| Polypeptide SEQ ID NO: | GID No. | Family | Conserved Domains in Amino Acid Coordinates |
|---|---|---|---|
| 422 | G639 | TH | 304-389 |
| 424 | G640 | TH | |
| 426 | G641 | TH | 23-102 |
| 428 | G654 | Z-LIM | 10-61, 108-159 |
| 430 | G656 | MYB-(R1)R2R3 | 14-114 |
| 432 | G659 | MYB-(R1)R2R3 | 16-116 |
| 434 | G661 | MYB-(R1)R2R3 | 13-116 |
| 436 | G663 | MYB-(R1)R2R3 | 9-111 |
| 438 | G664 | MYB-(R1)R2R3 | 13-116 |
| 440 | G665 | MYB-related | 88-157 |
| 442 | G667 | MYB-(R1)R2R3 | 14-116 |
| 444 | G668 | MYB-(R1)R2R3 | 13-113 |
| 446 | G669 | MYB-(R1)R2R3 | 15-118 |
| 448 | G670 | MYB-(R1)R2R3 | 14-122 |
| 450 | G671 | MYB-(R1)R2R3 | 15-115 |
| 452 | G672 | MYB-related | 92-161 |
| 454 | G673 | MYB-related | 37-95 |
| 456 | G675 | MYB-(R1)R2R3 | 13-116 |
| 458 | G676 | MYB-(R1)R2R3 | 17-119 |
| 460 | G677 | MYB-(R1)R2R3 | 12-116 |
| 462 | G679 | MYB-related | 98-167 |
| 464 | G680 | MYB-related | 24-70 |
| 466 | G681 | MYB-(R1)R2R3 | 14-120 |
| 468 | G682 | MYB-related | 27-63 |
| 470 | G699 | HB | 52-115 |
| 472 | G713 | HB | 23-86 |
| 474 | G718 | SBP | 169-242 |
| 476 | G722 | GARP | 188-236 |
| 478 | G723 | GARP | |
| 480 | G726 | GARP | |
| 482 | G729 | GARP | 224-272 |
| 484 | C732 | bZIP | 31-91 |
| 486 | G735 | bZIP | 153-237 |
| 488 | G736 | Z-Dof | 54-111 |
| 490 | G738 | Z-Dof | 351-393 |
| 492 | G740 | Z-CLDSH | 24-42, 232-268 |
| 494 | G743 | Z-ZPF | 51-82 |
| 496 | G746 | RING/C3HC4 | 139-178 |
| 498 | G748 | Z-Dof | 112-140 |
| 500 | G749 | Z-C3H | |
| 502 | G751 | Z-Dof | 37-82 |
| 504 | G752 | RING/C3H2C3 | 439-479 |
| 506 | G759 | NAC | 17-159 |
| 508 | G760 | NAC | 12-156 |
| 510 | G763 | NAC | 17-157 |
| 512 | G764 | NAC | 27-171 |
| 514 | G765 | NAC | 23-167 |
| 516 | G767 | NAC | 8-158 |
| 518 | G773 | NAC | 17-159 |
| 520 | G776 | NAC | 27-175 |
| 522 | G777 | HLH/MYC | 47-101 |
| 524 | G778 | HLH/MYC | 220-267 |
| 526 | G779 | HLH/MYC | 126-182 |
| 528 | G780 | HLH/MYC | |
| 530 | G782 | HLH/MYC | 1-88 |
| 532 | G783 | HLH/MYC | 20-109 |
| 534 | G784 | HLH/MYC | 139-191 |
| 536 | G786 | HLH/MYC | |
| 538 | G787 | HLH/MYC | 61-124 |
| 540 | G789 | HLH/MYC | 253-313 |
| 542 | G791 | HLH/MYC | 75-143 |
| 544 | G792 | HLH/MYC | 70-138 |
| 546 | G793 | HLH/MYC | 151-206 |
| 548 | G795 | DBP | |
| 550 | G801 | PCF | 32-93 |
| 552 | G802 | PCF | |
| 554 | G805 | PCF | 51-114 |
| 556 | G820 | AKR | |
| 558 | G831 | AKR | 470-591 |
| 560 | G832 | AKR | |
| 562 | G837 | AKR | 548-869 |
| 564 | G838 | AKR | 274-420 |
| 566 | G849 | BPF-1 | 324-413, 504-583 |
| 568 | G859 | MADS | 2-57 |
| 570 | G860 | MADS | 2-57 |
| 572 | G861 | MADS | 2-57 |
| 574 | G864 | AP2 | 119-186 |
| 576 | G865 | AP2 | 36-103 |
| 578 | G866 | WRKY | 43-300 |
| 580 | G867 | AP2 | 59-124 |
| 582 | G869 | AP2 | 109-177 |
| 584 | G877 | WRKY | 272-328, 487-603 |
| 586 | G878 | WRKY | 250-305, 415-475 |
| 588 | G881 | WRKY | 176-233 |
| 590 | G883 | WRKY | 245-302 |
| 592 | G884 | WRKY | 227-285, 407-465 |
| 594 | G886 | BZIPT2 | 1-53, 542-652 |
| 596 | G896 | Z-LSD-like | 18-39 |
| 598 | G897 | Z-CO-like | 8-39, 51-82 |
| 600 | G901 | Z-CO-like | 1-98 |
| 602 | G902 | Z-CO-like | |
| 604 | G903 | Z-C2H2 | 68-92 |
| 606 | G905 | RING/C3H2C3 | 118-159 |
| 608 | G907 | Z-C3H | 124-174 |
| 610 | G908 | Z-C2H2 | |
| 612 | G909 | Z-LIM | |
| 614 | G911 | RING/C3H2C3 | 86-129 |
| 616 | G912 | AP2 | 51-118 |
| 618 | G915 | WRKY | 184-239, 362-418 |
| 620 | G921 | WRKY | 146-203 |
| 622 | G928 | CAAT | 179-239 |
| 624 | G929 | CAAT | 97-158 |
| 626 | G931 | CAAT | 172-232 |
| 628 | G932 | MYB-(R1)R2R3 | 12-118 |
| 630 | G935 | ARF | |
| 632 | G938 | EIL | 96-104 |
| 634 | G961 | NAC | 12-180 |
| 636 | G964 | HB | 126-186 |
| 638 | G965 | HB | 423-486 |
| 640 | G971 | AP2 | 120-186 |
| 642 | G974 | AP2 | 81-140 |
| 644 | G975 | AP2 | 4-71 |
| 646 | G976 | AP2 | 87-153 |
| 648 | G977 | AP2 | 5-72 |
| 650 | G979 | AP2 | 63-139, 165-233 |
| 652 | G986 | WRKY | 146-203 |
| 654 | G987 | SCR | 428-432, 704-708 |
| 656 | G991 | IAA | 7-14, 48-59, 82-115, 128-164 |
| 658 | G994 | MYB-(R1)R2R3 | 14-123 |
| 660 | G996 | MYB-(R1)R2R3 | 14-114 |
| 662 | G997 | MYB-related | 9-63 |
| 664 | G998 | MYB-(R1)R2R3 | 28-131 |
| 666 | G1004 | AP2 | 153-221 |
| 668 | G1005 | AP2 | 25-92 |
| 670 | G1006 | AP2 | 114-182 |
| 672 | G1012 | WRKY | 30-86 |
| 674 | G1020 | AP2 | 28-95 |
| 676 | G1022 | WRKY | 281-340 |
| 678 | G1023 | AP2 | 128-195 |
| 680 | G1025 | SWI/SNF | |
| 682 | G1030 | HMG | |
| 684 | G1034 | bZIP | 97-160 |
| 686 | G1037 | GARP | 11-134, 200-248 |
| 688 | G1038 | GARP | 198-247 |
| 690 | G1039 | GARP | 214-262 |
| 692 | G1043 | WRKY | 120-179 |
| 694 | G1045 | bZIP | 96-156 |
| 696 | G1048 | bZIP | 138-190 |
| 698 | G1050 | bZIP | 372-425 |
| 700 | G1052 | bZIP | 201-261 |
| 702 | G1053 | bZIP | 74-120 |
| 704 | G1055 | bZIP | 192-249 |
| 706 | G1056 | bZIP | 183-246 |
| 708 | G1057 | bZIP | 305-365 |

TABLE 5A-continued

Gene families and conserved domains

| Polypeptide SEQ ID NO: | GID No. | Family | Conserved Domains in Amino Acid Coordinates |
|---|---|---|---|
| 710 | G1058 | bZIP | 292-386 |
| 712 | G1061 | HLH/MYC | 149-200 |
| 714 | G1062 | HLH/MYC | 308-359 |
| 716 | G1065 | DBP | |
| 718 | G1067 | AT-hook | 86-93 |
| 720 | G1068 | AT-hook | 143-150 |
| 722 | G1069 | AT-hook | 67-74 |
| 724 | G1073 | AT-hook | 33-42, 78-175 |
| 726 | G1075 | AT-hook | 78-85 |
| 728 | G1076 | AT-hook | 82-89 |
| 730 | G1087 | BZIPT2 | |
| 732 | G1089 | BZIPT2 | 425-500 |
| 734 | G1090 | AP2 | 19-85 |
| 736 | G1091 | WRKY | 262-319 |
| 738 | G1128 | AT-hook | 181-247 |
| 740 | G1133 | HLH/MYC | 256-326 |
| 742 | G1134 | HLH/MYC | 198-247 |
| 744 | G1135 | HLH/MYC | 363-440 |
| 746 | G1136 | HLH/MYC | 397-474 |
| 748 | G1141 | AP2 | 75-142 |
| 750 | G1145 | bZIP | 227-270 |
| 752 | G1149 | PAZ | 870-880 |
| 754 | G1181 | HS | 24-114 |
| 756 | G1183 | | |
| 758 | G1186 | AKR | 14-611 |
| 760 | G1190 | AKR | |
| 762 | G1197 | GARP | |
| 764 | G1198 | bZIP | 173-223 |
| 766 | G1211 | MISC | 123-179 |
| 768 | G1212 | MISC | 110-131 |
| 770 | G1216 | BPF-1 | 490-543 |
| 772 | G1218 | MISC | 66-250, 323-481, 575-645 |
| 774 | G1222 | | |
| 776 | G1228 | HLH/MYC | 179-233 |
| 778 | G1232 | Z-C4HC3 | |
| 780 | G1233 | Z-C4HC3 | |
| 782 | G1237 | Z-C4HC3 | 197-245 |
| 784 | G1240 | MISC | |
| 786 | G1241 | MISC | |
| 788 | G1242 | SWI/SNF | 2-165 |
| 790 | G1243 | SWI/SNF | 216-609 |
| 792 | G1249 | CAAT | 13-110 |
| 794 | G1255 | Z-CO-like | 18-56 |
| 796 | G1258 | Z-Dof | |
| 798 | G1261 | 7-CO-like | 141-182, 184-207 |
| 800 | G1266 | AP2 | 79-147 |
| 802 | G1267 | WRKY | 70-127 |
| 804 | G1269 | MYB-related | 27-83 |
| 806 | G1274 | WRKY | 111-164 |
| 808 | G1275 | WRKY | 113-169 |
| 810 | G1277 | AP2 | 18-85 |
| 812 | G1278 | bZIP | 230-328 |
| 814 | G1290 | AKR | 270-366 |
| 816 | G1300 | Z-C4HC3 | 197-245 |
| 818 | G1304 | MYB-(R1)R2R3 | 13-118 |
| 820 | G1305 | MYB-(R1)R2R3 | 15-118 |
| 822 | G1307 | MYB-(R1)R2R3 | 14-114 |
| 824 | G1308 | MYB-(R1)R2R3 | 1-128 |
| 826 | G1309 | MYB-(R1)R2R3 | 9-114 |
| 828 | G1311 | MYB-(R1)R2R3 | 11-112 |
| 830 | G1313 | MYB-(R1)R2R3 | 32-135 |
| 832 | G1314 | MYB-(R1)R2R3 | 14-116 |
| 834 | G1315 | MYB-(R1)R2R3 | 14-115 |
| 836 | G1316 | MYB-(R1)R2R3 | 26-126 |
| 838 | G1317 | MYB-(R1)R2R3 | 13-118 |
| 840 | G1319 | MYB-(R1)R2R3 | 14-114 |
| 842 | G1322 | MYB-(R1)R2R3 | 26-130 |
| 844 | G1323 | MYB-(R1)R2R3 | 15-116 |
| 846 | G1324 | MYB-(R1)R2R3 | 20-118 |
| 848 | G1325 | MYB-(R1)R2R3 | 43-147 |
| 850 | G1326 | MYB-(R1)R2R3 | 18-121 |
| 852 | G1327 | MYB-(R1)R2R3 | 14-116 |
| 854 | G1328 | MYB-(R1)R2R3 | 14-119 |
| 856 | G1332 | MYB-(R1)R2R3 | 13-116 |
| 858 | G1334 | CAAT | 18-190 |
| 860 | G1335 | Z-CLDSH | 24-43, 131-144, 185-203 |
| 862 | G1337 | 7-CO-like | 9-75 |
| 864 | G1362 | MYB-related | 115-166 |
| 866 | G1366 | bZIP | 14-74 |
| 868 | G1380 | AP2 | 24-92 |
| 870 | G1382 | WRKY | 210-266, 385-437 |
| 872 | G1391 | GARP | 230-277 |
| 874 | G1395 | S1FA | 1-72 |
| 876 | G1398 | DBP | 162-203 |
| 878 | G1399 | AT-hook | 86-93 |
| 880 | G1412 | NAC | 13-162 |
| 882 | G1417 | WRKY | 239-296 |
| 884 | G1425 | NAC | 20-173 |
| 886 | G1426 | NAC | 3-131 |
| 888 | G1435 | GARP | 146-194 |
| 890 | G1448 | IAA | 43-50, 144-154, 187-220, 254-290 |
| 892 | G1449 | IAA | 48-53, 74-107, 122-152 |
| 894 | G1451 | ARF | 22-357 |
| 896 | G1468 | Z-C2H2 | 95-115, 170-190 |
| 898 | G1471 | Z-C2H2 | 49-70 |
| 900 | G1472 | Z-C2H2 | 83-106 |
| 902 | G1474 | Z-C2H2 | 41-68 |
| 904 | G1476 | Z-C2H2 | 37-57 |
| 906 | G1482 | Z-CO-like | 5-63 |
| 908 | G1483 | Z-CO-like | 17-66 |
| 910 | G1490 | GARP | 193-241 |
| 912 | G1493 | GARP | 242-289 |
| 914 | G1499 | HLH/MYC | 118-181 |
| 916 | G1504 | GATA/Zn | 193-206 |
| 918 | G1508 | GATA/Zn | 38-63 |
| 920 | G1540 | HB | 35-98 |
| 922 | G1545 | HB | 54-117 |
| 924 | G1552 | SBP | 101-177 |
| 926 | G1560 | HS | 62-151 |
| 928 | G1634 | MYB-related | 129-180 |
| 930 | G1645 | MYB-(R1)R2R3 | 90-210 |
| 932 | G1650 | HLH/MYC | 284-334 |
| 934 | G1664 | HLH/MYC | |
| 936 | G1669 | Z-CO-like | |
| 938 | G1760 | MADS | 2-57 |
| 940 | G1816 | MYB-related | 31-81 |
| 942 | G1820 | CAAT | 70-133 |
| 944 | G1842 | MADS | 2-57 |
| 946 | G1843 | MADS | 2-57 |
| 948 | G1844 | MADS | 2-57 |
| 950 | G1947 | HS | 37-120 |
| 952 | G2010 | SBP | 53-127 |
| 954 | G2119 | RING/C3H2C3 | |
| 956 | G2120 | VAR | 0-0 |
| 958 | G2347 | SBP | 60-136 |
| 960 | G2718 | MYB-related | 21-76 |

TABLE 5B

MAF Gene family and conserved domains

| Polypeptide SEQ ID NO: | GID No. | Family | Conserved Domains |
|---|---|---|---|
| 568 | G859 | MADS | 2-57 |
| 944 | G1842 | MADS | 2-57 |
| 946 | G1843 | MADS | 2-57 |
| 948 | G1844 | MADS | 2-57 |
| 1735 | G157 | MADS | 2-57 |
| 1875 | G1759 | MADS | 2-57 |

TABLE 5B-continued

MAF Gene family and conserved domains

| Polypeptide SEQ ID NO: | GID No. | Family | Conserved Domains |
|---|---|---|---|
| 1971 | Soy1 | MADS | 2-57 |
| 1973 | Soy3 | MADS | 2-57 |
| 1945 | G859.3 | MADS | 2-57 |
| 1947 | G859.1 | MADS | 2-57 |
| 1949 | G859.4 | MADS | 2-57 |
| 1951 | G859.5 | MADS | 2-57 |
| 1953 | G1842.2 | MADS | 2-57 |
| 1955 | G1842.7 | MADS | 2-57 |
| 1957 | G1842.8 | MADS | 2-57 |
| 1959 | G1842.6 | MADS | 2-57 |
| 1961 | G1843.1 | MADS | 2-57 |
| 1963 | G1843.2 | MADS | 2-57 |
| 1965 | G1843.3 | MADS | 2-57 |
| 1967 | G1843.4 | MADS | 2-57 |
| 1969 | G1844.2 | MADS | 2-57 |
| 1971 | Soy MADS1 | MADS | 2-57 |
| 1973 | Soy MADS3 | MADS | 2-57 |

For many crops, high yielding winter strains can only be grown in regions where the growing season is sufficiently cold and prolonged to elicit vernalization. A system that could trigger flowering at higher temperatures would greatly expand the acreage over which winter varieties can be cultivated. The finding that G157 (SEQ ID NO:1734) over-expression causes early flowering in *Arabidopsis* Stockholm and Pitztal plants, indicates that the gene can overcome the high level of FRIGIDA and FLC activity present in those late-ecotypes. The effects are similar to those caused by vernalization, which implies that G157 (SEQ ID NO: 1734) and the related MADS-box transcription factors (MAFs; SEQ ID NOs: 567, 1944, 1946, 1948, 1950, 943, 1952, 1954, 1956, 1958, 945, 1960, 1962, 1964, 1966, 947, 1968, 1970, and 1972) might be used in winter strains of crop species. To date, a substantial number of genes have been found to promote flowering. Many, however, including those encoding the transcription factors, APETALA1, LEAFY, and CONSTANS, produce extreme dwarfing and/or shoot termination when over-expressed. Importantly, overexpression of G157 was not observed to have deleterious effects. In particular, 335S::(G157 transgenic *Arabidopsis* plants are healthy and attain a wild-type stature when mature. Irrespective of the mode of (G157 action, and whether its true biological role is as an activator or a repressor of flowering, the results suggest that G1157 can be applied to produce either early or late flowering, according to the level of over-expression of the particular polynucleotide.

Examples of some of the utilities that may be desirable in plants, and that may be provided by transforming the plants with the presently disclosed sequences, are listed in Table 6. Many of the transcription factors listed in Table 6 may be operably linked with a specific promoter that causes the transcription factor to be expressed in response to environmental, tissue-specific or temporal signals. For example, G362 induces ectopic trichomes on flowers but also produces small plants. The former may be desirable to produce insect or herbivore resistance, or increased cotton yield, but the latter may be undesirable in that it may reduce biomass. However, by operably linking G362 with a flower-specific promoter, one may achieve the desirable benefits of the gene without affecting overall biomass to a significant degree. For examples of flower specific promoters, see Kaiser et al. (supra). For examples of other tissue-specific, temporal-specific or inducible promoters, see the above discussion under the heading "Vectors, Promoters, and Expression Systems".

TABLE 6

Genes, traits and utilities that affect plant characteristics

| Trait Category | Phenotype(s) | Transcription factor genes that impact traits | Utility |
|---|---|---|---|
| Abiotic stress | Effect of chilling on plants | | |
| | Increased sensitivity | G394; G864 | Improved germination, growth rate, earlier planting, yield |
| | Increased tolerance Germination in cold | G256; G664; G1274 | |
| | Increased sensitivity | G134 | Earlier planting; improved survival, yield |
| | Increased tolerance | G224; G256; G664; G1274; G1322 | |
| | Freezing tolerance | | |
| | Increased tolerance | G912 | Earlier planting; improved quality, survival, yield |
| | Drought | | |
| | Increased tolerance | G46; G912; G1820 | Improved survival, vigor, appearance, yield |
| | Heat | | |
| | Increased sensitivity | G3; G1645 | Improved germination, growth rate, later planting, yield |
| | Increased tolerance | G464; G682; G864; G964; G1305 | |
| | Osmotic stress | | |
| | Increased sensitivity | G502; G526; G921 | Abiotic stress response manipulation |

TABLE 6-continued

Genes, traits and utilities that affect plant characteristics

| Trait Category | Phenotype(s) | Transcription factor genes that impact traits | Utility |
|---|---|---|---|
| | Increased tolerance | G188; G325; G489; G1069; G1089; G1412; G1820 | Improved germination rate, survival, yield |
| | Salt tolerance | | |
| | Increased sensitivity | G545 | Manipulation of response to high salt conditions |
| | Increased tolerance | G22; G196; G226; G482; G624; G801; G867; G884 | Improved germination rate, survival, yield; extended growth range |
| | Nitrogen stress | | |
| | More sensitive to N limitation | G1136 | Manipulation of response to low nutrient conditions |
| | Less sensitive to N limitation | G153; G225; G226; G1274; G816; G2718 | Improved yield and nutrient stress tolerance, decreased fertilizer usage |
| | Phosphate stress | | |
| | More sensitive to P limitation | | Manipulation of response to low nutrient conditions |
| | Less sensitive to P limitation | G545; G624 | Improved yield and nutrient stress tolerance, decreased fertilizer usage |
| | Potassium stress | | |
| | Increased tolerance to K limitation | G419; G561; G911 | Improved yield and nutrient stress tolerance, decreased fertilizer usage |
| | Oxidative stress | | |
| | Increased sensitivity Increased tolerance | G477; G789 | Improved yield, quality, ultraviolet and chemical stress tolerance |
| Herbicide | Glyphosate | | Generation of glyphosate-resistant plants to improve weed control |
| Hormone sensitivity | Abscisic acid (ABA) sensitivity | | |
| | Reduced sensitivity or insensitive to ABA | G1412; G1069; G1820 | Modification of seed development, improved seed dormancy, cold and dehydration tolerance |
| | Sensitivity to ethylene | | |
| | Hypersensitive to ACC | G760 | Manipulation of fruit ripening |
| | Altered response | G1062; G1134 | Manipulation of fruit ripening |
| | Insensitive to ethylene | | Manipulation of fruit ripening |
| Disease | *Botrytis* | | |
| | Increased susceptibility | G207; G248; G261; G865; G881; G1255 | Manipulation of response to disease organism |
| | Increased resistance or tolerance | G28 | Improved yield, appearance, survival, extended range |
| | *Fusarium* | | |
| | Increased susceptibility | G188; G545; G896 | Manipulation of response to disease organism |
| | Increased resistance or tolerance | | Improved yield, appearance, survival, extended range |
| | *Erysiphe* | | |
| | Increased susceptibility | G545; G865; G881 | Manipulation of response to disease organism |
| | Increased resistance or tolerance | G19; G28; G237; G378; G409; G591; G616; G869; G1048; G1266 | Improved yield, appearance, survival, extended range |
| | *Pseudomonas* | | |
| | Increased susceptibility | G545 | Manipulation of response to disease organism |
| | Increased resistance or tolerance | G418; G525 | Improved yield, appearance, survival, extended range |

TABLE 6-continued

Genes, traits and utilities that affect plant characteristics

| Trait Category | Phenotype(s) | Transcription factor genes that impact traits | Utility |
|---|---|---|---|
| | *Sclerotinia* | | |
| | Increased susceptibility | G477; G789; G805 | Manipulation of response to disease organism |
| | Increased resistance or tolerance | G28 | Improved yield, appearance, survival, extended range |
| Growth regulator | Altered sugar sensing | | Alteration of energy balance, photosynthetic rate, carbohydrate accumulation, biomass production, source-sink relationships, senescence; alteration of storage compound accumulation in seeds |
| | Decreased tolerance to sugars | G26; G38; G43; G207; G241; G254; G263; G308; G536; G567; G680; G912; G996; G1068; G1314; G1337 | |
| | Increased tolerance to sugars | G224; G782; G783; G867; G905; G1493; G1816 | |
| | Altered C/N sensing | G153 | Modification of sensing and respond to changes C and N metabolite levels, regulation of expression and activity of proteins involved in C and N transport and metabolism |
| Flowering time | Early flowering | G142; G145; G146; G157; G180; G184; G185; G208; G227; G255; G390; G475; G590; G592; G627; G789; G865; G1037; G1242; G1305; G1380; G1545; G1760; G1820; G1842; G1843; G2010; G2347 | Faster generation time; synchrony of flowering; additional harvests within a growing season, shortening of breeding programs |
| | Late flowering | G8; G157; G192; G198; G214; G234; G249; G361; G434; G486; G562; G571; G591; G624; G680; G736; G738; G748; G752; G859; G878; G903; G9121 G971; G994; G1052; G1073; G1136; G1335; G1435; G1451; G1468; G1474; G1493 | Increased yield orbiomass, alleviate risk of transgenic pollen escape; synchrony of flowering |
| | Extended period of flowering | G1947 | Increased fertilization, yield, ornamental applications |
| Development and morphology | Altered flower structure | | |
| | Stamen | G470; G615; G869; G1425; G1499; G1560 | Ornamental modification of plant architecture, improved or reduced fertility to mitigate escape of transgenic pollen, improved fruit size, shape, number or yield |
| | Sepal | G1075; G1326 | |
| | Petal | G638; G671; G1075; G1326; G1449; G1499; G1560 | |
| | Pedicel | | |
| | Carpel | | |
| | Homeotic transformation | G134; G638; G779 | |
| | Multiple alterations | G187; G580; G615; G671; G732; G1075; G1425; G1449; G1499; G1560; G1645 | |
| | Enlarged floral organs | | |
| | Siliques | G1134 | |
| | Reduced fertility | G559; G615; G638; G671; G779; G977; G1067; G1075; G1266; G1311; G1326; G1560; G1645; G1947 | |
| | Aerial rosettes | | |
| | Inflorescence architectural change | | Ornamental modification of flower architecture; timing of flowering; altered plant habit for yield or harvestability benefit; |
| | Altered branching pattern | | |
| | Short internodes/bushy | G385; G580; G865; | |

TABLE 6-continued

Genes, traits and utilities that affect plant characteristics

| Trait Category | Phenotype(s) | Transcription factor genes that impact traits | Utility |
|---|---|---|---|
| | inflorescences | G1274; G1425; G1474 | reduction in pollen production |
| | Internode elongation | G1274 | of genetically modified plants; |
| | Terminal flowers | G145 | manipulation of seasonality and |
| | Poorly developed inflorescences | | annual or perennial habit; |
| | Lack of inflorescence | G1499 | manipulation of determinate vs. indeterminate growth |
| | Altered shoot meristem | | Ornamental modification of |
| | development | | plant architecture, manipulation |
| | Stem bifurcations | G390 | of growth and development, |
| | No shoot meristem | G1472 | increase in leaf numbers, |
| | Reduced meristem cell differentiation | G1540 | modulation of branching patterns to provide improved yield or biomass |
| | Altered branching pattern | G438; G1499 | Ornamental modification of plant architecture, improved lodging resistance |
| | Altered phyllotaxy | G638 | Ornamental modification of plant architecture |
| | Apical dominance | | |
| | Reduced apical dominance | G559; G732; G1255; G1275; G1645 | Ornamental modification of plant architecture |
| | Altered trichome density; | | Ornamental modification of |
| | development, or structure | | plant architecture, increased |
| | Reduced or no trichomes | G25; G212; G225; G226; G676; G682; G1332; G1816; G2718 | plant product (e.g., diterpenes, cotton) productivity, insect and herbivore resistance |
| | Ectopic trichomes/altered trichome distribution or development/cell fate | G247 | |
| | Increased trichome number, density and/or size | G634 | |
| | Stem morphology and altered vascular tissue structure | G438; G748 | Modulation of lignin content; improvement of wood, palatability of fruits and vegetables |
| | Root development | | |
| | Increased root growth and proliferation | G9; G1482 | Improved yield, stress tolerance; anchorage |
| | Decreased root growth | | Modification of root architecture and mass |
| | Increased root hairs | G225; G226; G682; G1816; G2718 | Improved yield, stress tolerance; anchorage |
| | Altered seed development, ripening and germination | G979 | Modification of seed germination properties and performance |
| | Cell differentiation and cell proliferation | G1540 | Increase in carpel or fruit development; improve regeneration of shoots from callus in transformation or micro-propagation systems |
| | Rapid growth and/or development | | Promote faster development and reproduction in plants |
| | Slow growth | G447; G740; G1062; G1335; G1468; G1474 | Ornamental applications |
| | Senescence | | |
| | Premature senescence | G636; G1128 | Improvement in response to |
| | Delayed senescence | G249; G571; G878; G1050 | disease, fruit ripening |
| | Lethality when overexpressed | G374; G515; G578; G877; G1076; G1304 | Herbicide target; ablation of specific tissues or organs such as stamen to prevent pollen escape |
| | Necrosis | G24 | Disease resistance |
| Plant size | Increased plant size | G46; G624; G1073; G1435; G1451; G1468 | Improved yield, biomass, appearance |
| | Larger seedlings | G1313 | Increased survival and vigor of seedlings, yield |
| | Dwarfed or more compact plants | G3; G5; G21; G24; G27; G184; G194; G258; G280; G385; G447; | Dwarfism, lodging resistance, manipulation of gibberellin responses |

TABLE 6-continued

Genes, traits and utilities that affect plant characteristics

| Trait Category | Phenotype(s) | Transcription factor genes that impact traits | Utility |
|---|---|---|---|
| | | G636; G670; G671; G738; G760; G831; G864; G869; G884; G932; G977; G991; G994; G1020; G1023; G1053; G1067; G1075; G1181; G1228; G1266; G1267; G1275; G1277; G1309; G1311; G1314; G1317; G1322; G1323; G1326; G1332; G1334; G1382; G1474; G1545; G1560 | |
| Leaf morphology | Dark green leaves | G385; G447; G912; G932; G977; G1128; G1267; G1323; G1327; G1334; G1499 | Increased photosynthesis, biomass, yield; ornamental applications |
| | Change in leaf shape | G32; G224; G428; G464; G629; G671; G736; G903; G905; G921; G932; G977; G1038; G1067; G1073; G1075; G1269; G1468; G1493; G1645 | Ornamental applications |
| | Altered leaf development Altered leaf size | G1645 | Ornamental applications |
| | Increased leaf size and mass | G438; G1274; G1451 | Increased yield, ornamental applications |
| | Gray leaves | G1468 | Ornamental applications |
| | Variegation | | Ornamental applications |
| | Glossy leaves | G975; G1267 | Ornamental applications, manipulation of wax composition, amount, or distribution |
| | Cell expansion | G521 | Ornamental applications; modification of adaptation to environmental changes or damage |
| Seed morphology | Altered seed coloration | G156; G663; G668 | Appearance, ornamental applications |
| | Seed size and shape | | |
| | Increased seed size | G206; G584; G1255 | Yield, appearance |
| | Decreased seed size | G1145 | Appearance |
| | Altered seed shape | G1062; G1145 | Appearance |
| Leaf biochemistry | Increased leaf wax | G975; G1267 | Insect, pathogen resistance |
| | Leaf prenyl lipids | | Improved antioxidant and |
| | Reduced chlorophyll | | vitamin E content, nutritional |
| | Increase in tocopherols | G280; G987 | content; prevention of ARMD; |
| | Increased lutein content | G214 | modified photosynthetic |
| | Decreased lutein content | G1133; G1324; G1328 | capability |
| | Increase in chlorophyll or carotenoids | G214; G987; G1324 | |
| | Decrease in chlorophyll or carotenoids | G987 | |
| | Leaf insoluble sugars | | Alteration of plant cell wall |
| | Increased leaf insoluble sugars including xylose, fucose, rhamnose, galactose, arabinose or mannose | G211; G237; G242; G274; G307; G428; G435; G525; G598; G777; G869; G1309 | composition affecting food digestibility, plant tensile strength, wood quality, pathogen resistance and pulp production. |
| | Decreased leaf insoluble sugars, including rhamnose, arabinose or mannose | G307; G428; G1012 | Alteration of plant cell wall composition affecting food digestibility, plant tensile strength, wood quality, pathogen resistance and pulp production. |
| | Increased leaf anthocyanins | G663 | Increased photosynthesis, biomass, yield; ornamental applications |

TABLE 6-continued

Genes, traits and utilities that affect plant characteristics

| Trait Category | Phenotype(s) | Transcription factor genes that impact traits | Utility |
| --- | --- | --- | --- |
| | Leaf fatty acids | | Modification of nutritional |
| | Reduction in leaf fatty acids | G718; G1266; G1347 | content; heat stability of |
| | Increase in leaf fatty acids | G214; G231 | essential oils |
| | Altered leaf glucosinolate content | G185; G681; G1069; G1198; G1322 | Modification of toxic glucosinolate content in animal feeds; anti-cancer activity |
| Seed biochemistry | Seed oil content | | |
| | Increased oil content | G162; G229; G231; G291; G456; G464; G561; G590; G598; G732; G849; G961; G1190; G1198 | Improved oil yield |
| | Decreased oil content | G180; G192; G201; G222; G241; G663; G668; G718; G732; G777; G911; G1323; G1820 | Reduced caloric content |
| | Altered oil content | G509; G567; G732; G974; G1451; G1471 | Modification of seed caloric content and nutritional value |
| | Seed protein content | | |
| | Increased protein content | G201; G222; G226; G241; G629; G630; G663; G668; G718; G732; G865; G911; G1048; G1323; G1449; G1820 | Improved protein yield, nutritional value |
| | Decreased protein content | G229; G231; G418; G456; G464; G732; G1634 | Reduced caloric content |
| | Altered protein content | G162; G509; G567; G732; G849 | Modification of seed caloric content and nutritional value |
| | Altered seed prenyl lipid content | G214; G718; G748; G883; G1052 | Improved antioxidant and vitamin E content; prevention of ARMD |
| | Seed glucosinolate | | Modification of toxic |
| | Altered profile | | glucosinolate content in animal feeds; anti-cancer activity |
| | Increased seed anthocyanins | | Ornamental applications |
| | Increased seed sterols | G20 | Alteration of human steroid precursors content, some of which have cholesterol-lowering activity |
| | Increased seed fatty acid composition | G778; G861; G869; G938; G965; G1399; G1417 | Modification of seed caloric content and nutritional value |
| | Decreased seed fatty acid composition | G776; G791; G938; G987; G1417 | Modification of seed caloric content and nutritional value |
| | Up-regulation of genes involved in secondary metabolism | G229 | Alteration of tolerance to insect herbivores, UV, oxidative stress, and pathogen attack; increased production of valuable alkaloid-base medicines |
| Root Biochemistry | Increased root anthocyanins | G603 | Ornamental applications, improved anti-cancer activity |
| Light response/shade avoidance | Altered cotyledon, hypocotyl, petiole development; altered leaf orientation; constitutive photomorphogenesis; photomorphogenesis in low light | G351; G1062; G1322 | Potential for increased planting densities and yield enhancement |
| Pigment | Increased anthocyanin level | G663; G1482 | Enhanced health benefits, improved ornamental appearance, increased stress resistance, attraction of pollinating and seed-dispersing animals |

Abbreviations: N = nitrogen P = phosphate ABA = abscisic acid C/N = carbon/nitrogen balance Detailed Description of Genes, Traits and Utilities that Affect Plant Characteristics The following descriptions of traits and utilities associated with the present transcription factors offer a more comprehensive description than that provided in Table 6.

Abiotic Stress, General Considerations

Plant transcription factors can modulate gene expression, and, in turn, be modulated by the environmental experience of a plant. Significant alterations in a plant's environment invariably result in a change in the plant's transcription factor gene expression pattern. Altered transcription factor expression patterns generally result in phenotypic changes in the plant. Transcription factor gene product(s) in transgenic plants then differ(s) in amounts or proportions from that found in wild-type or non-transformed plants, and those transcription factors likely represent polypeptides that are used to alter the response to the environmental change. By way of example, it is well accepted in the art that analytical methods based on altered expression patterns may be used to screen for phenotypic changes in a plant far more effectively than can be achieved using traditional methods.

Abiotic stress: adult stage chilling. Enhanced chilling tolerance may extend the effective growth range of chilling sensitive crop species by allowing earlier planting or later harvest a gene that enhances growth under such conditions could also enhance yields, extend the effective growth range of chilling sensitive crop species, and reduce fertilizer and herbicide usage. Chilling tolerance could also serve as a model for understanding how plants adapt to water deficit. Both chilling and water stress share similar signal transduction pathways and tolerance/adaptation mechanisms. For example, acclimation to chilling temperatures can be induced by water stress or treatment with abscisic acid. Genes induced by low temperature include dehydrins (or LEA proteins). Dehydrins are also induced by salinity, abscisic acid, water stress, and during the late stages of embryogenesis.

Another large impact of chilling occurs during post-harvest storage. For example, some fruits and vegetables do not store well at low temperatures (for example, bananas, avocados, melons, and tomatoes). The normal ripening process of the tomato is impaired if it is exposed to cool temperatures. Transcription factor genes conferring resistance to chilling temperatures, including G256, G664, G1274 and their equivalogs, may thus enhance tolerance during post-harvest storage.

Improved chilling tolerance may be conferred by increased expression of glycerol-3-phosphate acetyltransferase in chloroplasts (see, for example, Wolter et al. (1992) et al. *EMBO J.* 4685-4692.

Chilling tolerance could also serve as a model for understanding how plants adapt to water deficit. Both chilling and water stress share similar sensory transduction pathways and tolerance/adaptation mechanisms. For example, acclimation to chilling temperatures can be induced by water stress or treatment with abscisic acid. Genes induced by low temperature include dehydrins (or LEA proteins). Dehydrins are also induced by salinity, abscisic acid, water stress or during the late stages of embryogenesis. Thus, genes that protect the plant against chilling could also have a role in protection against water deficit.

Abiotic stress: cold germination. Several of the presently disclosed transcription factor genes confer better germination and growth in cold conditions. For example, the improved germination in cold conditions seen with G224, G256, G664, G1274, and G1322, indicates a role in regulation of cold responses by these genes and their equivalogs. These genes might be engineered to manipulate the response to low temperature stress. Genes that would allow germination and seedling vigor in the cold would have highly significant utility in allowing seeds to be planted earlier in the season with a high rate of survival. Transcription factor genes that confer better survival in cooler climates allow a grower to move up planting time in the spring and extend the growing season further into autumn for higher crop yields. Germination of seeds and survival at temperatures significantly below that of the mean temperature required for germination of seeds and survival of non-transformed plants would increase the potential range of a crop plant into regions in which it would otherwise fail to thrive.

Abiotic stress: freezing tolerance and osmotic stress. Presently disclosed transcription factor genes, including G188, G325, G489, G1069, G1089, G1412, G1820 and their equivalogs, that may increase germination rate and/or growth under adverse osmotic conditions, could impact survival and yield of seeds and plants. Osmotic stresses may be regulated by specific molecular control mechanisms that include genes controlling water and ion movements, functional and structural stress-induced proteins, signal perception and transduction, and free radical scavenging, and many others (Wang et al. (2001) *Acta Hort*. (1SHS) 560: 285-292). Instigators of osmotic stress include freezing, drought and high salinity, each of which are discussed in more detail below.

In many ways, freezing, high salt and drought have similar effects on plants, not the least of which is the induction of common polypeptides that respond to these different stresses. For example, freezing is similar to water deficit in that freezing reduces the amount of water available to a plant. Exposure to freezing temperatures may lead to cellular dehydration as water leaves cells and forms ice crystals in intercellular spaces (Buchanan, supra). As with high salt concentration and freezing, the problems for plants caused by low water availability include mechanical stresses caused by the withdrawal of cellular water. Thus, the incorporation of transcription factors that modify a plant's response to osmotic stress or improve tolerance to (e.g., by G912 or its equivalogs) into, for example, a crop or ornamental plant, may be useful in reducing damage or loss. Specific effects caused by freezing, high salt and drought are addressed below.

Abiotic stress: drought and low humidity tolerance. Exposure to dehydration invokes similar survival strategies in plants as does freezing stress (see, for example, Yelenosky (1989) *Plant Physiol* 89: 444-451) and drought stress induces freezing tolerance (see, for example, Siminovitch et al. (1982) *Plant Physiol* 69: 250-255; and Guy et al. (1992) *Planta* 188: 265-270). In addition to the induction of cold-acclimation proteins, strategies that allow plants to survive in low water conditions may include, for example, reduced surface area, or surface oil or wax production. A number of presently disclosed transcription factor genes, e.g., G46, G912, and G1820, increase a plant's tolerance to low water conditions and, along with their equivalogs, would provide the benefits of improved survival, increased yield and an extended geographic and temporal planting range.

Abiotic stress: heat stress tolerance. The germination of many crops is also sensitive to high temperatures. Presently disclosed transcription factor genes that provide increased heat tolerance, including G464, G682, G864, G964, G1305 and their equivalogs, would be generally useful in producing plants that germinate and grow in hot conditions, may find particular use for crops that are planted late in the season, or extend the range of a plant by allowing growth in relatively hot climates.

Abiotic stress: salt. The genes in Table 6 that provide tolerance to salt may be used to engineer salt tolerant crops and trees that can flourish in soils with high saline content or under drought conditions. In particular, increased salt tolerance during the germination stage of a plant enhances survival and yield. Presently disclosed transcription factor genes, including G22, G196, G226, G482, G624, G801, G867, G884, and their equivalogs that provide increased salt tolerance during germination, the seedling stage, and throughout a plant's life cycle, would find particular value for imparting survival and yield in areas where a particular crop would not normally prosper.

Nutrient uptake and utilization: nitrogen and phosphorus. Presently disclosed transcription factor genes introduced into plants provide a means to improve uptake of essential nutrients, including nitrogenous compounds, phosphates, potassium, and trace minerals. The enhanced performance of, for example, G153, G225, G226, G682, G1274, G1816, G2718 and other overexpressing lines under low nitrogen, and G545 and G624 under low phosphorous conditions indicate that these genes and their equivalogs can be used to engineer crops that could thrive under conditions of reduced nutrient availability. Phosphorus, in particular, tends to be a limiting nutrient in soils and is generally added as a component in fertilizers. Young plants have a rapid intake of phosphate and sufficient phosphate is important for yield of root crops such as carrot, potato and parsnip.

The effect of these modifications is to increase the seedling germination and range of ornamental and crop plants. The utilities of presently disclosed transcription factor genes conferring tolerance to conditions of low nutrients also include cost savings to the grower by reducing the amounts of fertilizer needed, environmental benefits of reduced fertilizer runoff into watersheds; and improved yield and stress tolerance. In addition, by providing improved nitrogen uptake capability, these genes can be used to alter seed protein amounts and/or composition in such a way that could impact yield as well as the nutritional value and production of various food products.

A number of the transcription factor-overexpressing lines make less anthocyanin on high sucrose plus glutamine indicates that these genes can be used to modify carbon and nitrogen status, and hence assimilate partitioning (assimilate partitioning refers to the manner in which an essential element, such as nitrogen, is distributed among different pools inside a plant, generally in a reduced form, for the purpose of transport to various tissues).

Increased tolerance of plants to oxidative stress. In plants, as in all living things, abiotic and biotic stresses induce the formation of oxygen radicals, including superoxide and peroxide radicals. This has the effect of accelerating senescence, particularly in leaves, with the resulting loss of yield and adverse effect on appearance. Generally, plants that have the highest level of defense mechanisms, such as, for example, polyunsaturated moieties of membrane lipids, are most likely to thrive under conditions that introduce oxidative stress (e.g., high light, ozone, water deficit, particularly in combination). Introduction of the presently disclosed transcription factor genes, including G477, G789 and their equivalogs, that increase the level of oxidative stress defense mechanisms would provide beneficial effects on the yield and appearance of plants. One specific oxidizing agent, ozone, has been shown to cause significant foliar injury, which impacts yield and appearance of crop and ornamental plants. In addition to reduced foliar injury that would be found in ozone resistant plant created by transforming plants with some of the presently disclosed transcription factor genes, the latter have also been shown to have increased chlorophyll fluorescence (Yu-Sen Changet al. (2001) Bot. Bull. Acad. Sin. 42: 265-272).

Decreased herbicide sensitivity. Presently disclosed transcription factor genes that confer resistance or tolerance to herbicides (e.g., glyphosate) will find use in providing means to increase herbicide applications without detriment to desirable plants. This would allow for the increased use of a particular herbicide in a local environment, with the effect of increased detriment to undesirable species and less harm to transgenic, desirable cultivars.

Knockouts of a number of the presently disclosed transcription factor genes, including G374 and G877, have been shown to be lethal to developing embryos. Thus, these genes and their equivalogs are potentially useful as herbicide targets.

Hormone sensitivity. ABA plays regulatory roles in a host of physiological processes in all higher as well as in lower plants (Davies et al. (1991) Abscisic Acid: Physiology and Biochemistry. Bios Scientific Publishers, Oxford, UK; Zeevaart et al. (1988) Ann Rev Plant Physiol. Plant Mol. Biol. 49: 439-473; Shimizu-Sato et al. (2001) Plant Physiol 127: 1405-1413). ABA mediates stress tolerance responses in higher plants, is a key signal compound that regulates stomatal aperture and, in concert with other plant signaling compounds, is implicated in mediating responses to pathogens and wounding or oxidative damage (for example, see Larkindale et al. (2002) Plant Physiol. 128: 682-695). In seeds, ABA promotes seed development, embryo maturation, synthesis of storage products (proteins and lipids), desiccation tolerance, and is involved in maintenance of dormancy (inhibition of germination), and apoptosis (Zeevaart et al. (1988) Ann Rev Plant Physiol. Plant Mol. Biol. 49: 439-473; Davies (1991), supra; Thomas (1993) Plant Cell 5: 1401-1410; and Bethke et al. (1999) Plant Cell 11: 1033-1046). ABA also affects plant architecture, including root growth and morphology and root-to-shoot ratios. ABA action and metabolism is modulated not only by environmental signals but also by endogenous signals generated by metabolic feedback, transport, hormonal cross-talk and developmental stage. Manipulation of ABA levels, and hence by extension the sensitivity to ABA, has been described as a very promising means to improve productivity, performance and architecture in plants Zeevaart (1999) in: Biochemistry and Molecular Biology of Plant Hormones, Hooykaas et al. eds, Elsevier Science pp 189-207; and Cutler et al. (1999) Trends Plant Sci. 4: 472-478).

A number of the presently disclosed transcription factor genes affect plant abscisic acid (ABA) sensitivity, including G1069, G1412, and G1820. Thus, by affecting ABA sensitivity, these introduced transcription factor genes and their equivalogs would affect cold, drought, oxidative and other stress sensitivities, plant architecture, and yield.

Several other of the present transcription factor genes have been used to manipulate ethylene signal transduction and response pathways. These genes, including G760, G1062, G1134 and their equivalogs, may thus be used to manipulate the processes influenced by ethylene, such as seed germination or fruit ripening, and to improve seed or fruit quality.

Diseases pathogens and pests. A number of the presently disclosed transcription factor genes have been shown to or are likely to affect a plants response to various plant diseases, pathogens and pests. The offending organisms include fungal pathogens *Fusarium oxysporum, Botrytis cinerea, Sclerotinia sclerotiorum*, and *Erysiphe orontii*. Bacterial pathogens to which resistance may be conferred include *Pseudomonas syringae*. Other problem organisms may potentially include nematodes, mollicutes, parasites, or herbivorous arthropods. In each case, one or more transformed transcription factor genes may provide some benefit to the plant to help prevent or overcome infestation, or be used to manipulate any of the various plant responses to disease. These mechanisms by which the transcription factors work could include increasing surface waxes or oils, surface thickness, or the activation of signal transduction pathways that regulate plant defense in response to attacks by herbivorous pests (including, for example, protease inhibitors). Another means to combat fungal and other pathogens is by accelerating local cell death or senescence, mechanisms used to impair the spread of pathogenic microorganisms throughout a plant. For instance, the best known example of accelerated cell death is the resistance gene-mediated hypersensitive response, which causes localized cell death at an infection site and initiates a systemic defense response. Because many defenses, signaling molecules, and signal transduction pathways are common to defense against different pathogens and pests, such as fungal, bacterial, oomycete, nematode, and insect, transcription factors that are implicated in defense responses against the fungal pathogens tested may also function in defense against other pathogens and pests. These transcription factors include, for example, G28 (improved resistance or tolerance to *Botrytis*), G19, G28, G237, G378, G409, G591, G616, G869, G1048, G1266 (improved resistance or tolerance to *Erysiphe*), G418, G525 (improved resistance or tolerance to *Pseudomonas*), G28 (improved resistance or tolerance to *Sclerotinia*), and their equivalogs.

Growth regulator: sugar sensing. In addition to their important role as an energy source and structural component of the plant cell, sugars are central regulatory molecules that control several aspects of plant physiology, metabolism and development (Hsieh et al. (1998) *Proc. Natl. Acad. Sci.* 95: 1396513970). It is thought that this control is achieved by regulating gene expression and, in higher plants, sugars have been shown to repress or activate plant genes involved in many essential processes such as photosynthesis, glyoxylate metabolism, respiration, starch and sucrose synthesis and degradation, pathogen response, wounding response, cell cycle regulation, pigmentation, flowering and senescence. The mechanisms by which sugars control gene expression are not understood.

Because sugars are important signaling molecules, the ability to control either the concentration of a signaling sugar or how the plant perceives or responds to a signaling sugar could be used to control plant development, physiology or metabolism. For example, the flux of sucrose (a disaccharide sugar used for systemically transporting carbon and energy in most plants) has been shown to affect gene expression and alter storage compound accumulation in seeds. Manipulation of the sucrose signaling pathway in seeds may therefore cause seeds to have more protein, oil or carbohydrate, depending on the type of manipulation. Similarly, in tubers, sucrose is converted to starch which is used as an energy store. It is thought that sugar signaling pathways may partially determine the levels of starch synthesized in the tubers. The manipulation of sugar signaling in tubers could lead to tubers with a higher starch content.

Thus, the presently disclosed transcription factor genes that manipulate the sugar signal transduction pathway, including G26, G38, G43, G207, G224, G241, G254, G263, G308, G536, G567, G680, G782, G783, G867, G905, G912, G996, G1068, G1314, G1347, and G1493, along with their equivalogs, may lead to altered gene expression to produce plants with desirable traits. In particular, manipulation of sugar signal transduction pathways could be used to alter source-sink relationships in seeds, tubers, roots and other storage organs leading to increase in yield.

Growth regulator: C/N sensing. Nitrogen and carbon metabolism are tightly linked in almost every biochemical pathway in the plant. Carbon metabolites regulate genes involved in N acquisition and metabolism, and are known to affect germination and the expression of photosynthetic genes (Coruzzi et al. (2001) *Plant Physiol.* 125: 61-64) and hence growth. Early studies on nitrate reductase (NR) in 1976 showed that NR activity could be affected by Glc/Suc (Crawford (1995) *Plant Cell* 7: 859-886; Daniel-Vedele et al. (1996) *CR Acad Sci Paris* 319: 961-968). Those observations were supported by later experiments that showed sugars induce NR mRNA in dark-adapted, green seedlings (Cheng C L, et al. (1992) *Proc Natl Acad Sci USA* 89: 1861-1864). C and N may have antagonistic relationships as signaling molecules; light induction of NR activity and mRNA levels can be mimicked by C metabolites and N-metabolites cause repression of NR induction in tobacco (Vincentz et al. (1992) *Plant J* 3: 315-324). Gene regulation by C/N status has been demonstrated for a number of N-metabolic genes (Stitt (1999) *Curr. Opin. Plant. Biol.* 2: 178-186); Coruzzi et al. (2001) supra). Thus, transcription factor genes that affect C/N sensing such as G153 or its equivalogs can be used to alter or improve germination and growth under nitrogen-limiting conditions.

Flowering Time: Early, Late and Inducible Flowering.

Early flowering. Presently disclosed transcription factor genes that accelerate flowering, which include G142, G145, G146, G153, G157, G180, G184, G185, G208, G227, G255, G390, G475, G590, G592, G627, G789, G865, G1037, G1242, G1305, G1380, G1545, G1760, G1820, G1842, G1843, G1844, G2010, G2347, and their functional equivalogs, could have valuable applications in such programs, since they allow much faster generation times. In a number of species, for example, broccoli, cauliflower, where the reproductive parts of the plants constitute the crop and the vegetative tissues are discarded, it would be advantageous to accelerate time to flowering. Accelerating flowering could shorten crop and tree breeding programs. Additionally, in some instances, a faster generation time would allow additional harvests of a crop to be made within a given growing season. A number of *Arabidopsis* genes have already been shown to accelerate flowering when constitutively expressed. These include LEAFY, APETALA1 and CONSTANS (Mandel et al. (1995) *Nature* 377: 522-524; Weigel and Nilsson (1995) *Nature* 377:et al. 495-500; Simon et al. (1996) *Nature* 384: 59-62).

With the advent of transformation systems for tree species such as oil palm and *Eucalyptus*, forest biotechnology is a growing area of interest. Acceleration of flowering, again, might reduce generation times and make breeding programs feasible which would otherwise be impossible, such as with plants with multi-year cycles (such as biennials, e.g. carrot, or fruit trees, such as citrus) that can be very slow to develop and begin flowering. That this is a real possibility has already been demonstrated in aspen, a tree species that usually takes 8-20 years to flower. Transgenic aspen that over-express the *Arabidopsis* LFY gene flower after only 5 months. The flowers produced by these young aspen plants, however, were sterile; the challenge of producing fertile early flowering trees therefore still remains (Weigel, D. and Nilsson, O., 1995, Nature 377, 495-500).

Breeding programs for the development of new varieties can be limited by the seed-to-seed cycle.

Inducible flowering. By regulating the expression of potential flowering using inducible promoters, flowering could be triggered by application of an inducer chemical. This would allow flowering to be synchronized across a crop and facilitate more efficient harvesting (e.g., strawberry). Such inducible systems could also be used to tune the flowering of crop varieties to different latitudes. At present, species such as soybean and cotton are available as a series of maturity groups that are suitable for different latitudes on the basis of their flowering time (which is governed by day-length). A system in which flowering could be chemically controlled would allow a single high-yielding northern maturity group to be grown at any latitude. In southern regions such plants could be grown for longer periods before flowering was induced, thereby increasing yields. In more northern areas, the induction would be used to ensure that the crop flowers prior to the first winter frosts. Currently, the existence of a series of maturity groups for different latitudes represents a major barrier to the introduction of new valuable traits. Any trait (e.g. disease resistance) has to be bred into each of the different maturity groups separately; a laborious and costly exercise. The availability of single strain, which could be grown at any latitude, would therefore greatly increase the potential for introducing new traits to crop species such as soybean and cotton.

Late flowering. In a sizeable number of species, for example, root crops, where the vegetative parts of the plants constitute the crop (e.g., onions, lettuce) and the reproductive tissues are discarded, it is advantageous to identify and incorporate transcription factor genes that delay or prevent flowering in order to prevent resources being diverted into reproductive development. For example, G8, G157, G192, G198, G214, G234, G249, G361, G434, G486, G562, G571, G591, G624, G680, G736, G738, G748, G752, G859, G878, G903, G9121 G971, G994, 61052, G1073, G1136, G1335, G1435, G1451, G1468, G1474, G1493, and equivalogs, delay flowering time in transgenic plants. Extending vegetative development with presently disclosed transcription factor genes could thus bring about large increases in yields. Prevention of flowering can help maximize vegetative yields and prevent escape of genetically modified organism (GMO) pollen.

Presently disclosed transcription factors that extend flowering time, including G1947, have utility in engineering plants with longer-lasting flowers for the horticulture industry, and for extending the time in which the plant is fertile.

A number of the presently disclosed transcription factors may extend flowering time, and delay flower abscission, which would have utility in engineering plants with longer-lasting flowers for the horticulture industry. This would provide a significant benefit to the ornamental industry, for both cut flowers and woody plant varieties (of, for example, maize), as well as have the potential to lengthen the fertile period of a plant, which could positively impact yield and breeding programs.

General development and morphology: flower structure and inflorescence: architecture, altered flower organs, reduced fertility, multiple alterations, aerial rosettes, branching, internode distance, terminal flowers and phase change. Presently disclosed transgenic transcription factors such as G134, G187, G470, G580, G615, G638, G671, G732, G779, G869, G1075, G1134, G1326, G1425, G1449, G1499, G1645, and their equivalogs, may be used to create plants with larger flowers or arrangements of flowers that are distinct from wild-type or non-transformed cultivars. This would likely have the most value for the ornamental horticulture industry, where larger flowers or interesting floral configurations are generally preferred and command the highest prices.

Flower structure may have advantageous or deleterious effects on fertility, and could be used, for example, to decrease fertility by the absence, reduction or screening of reproductive components. In fact, plants that overexpress a sizable number of the presently disclosed transcription factor genes e.g., G559, G615, G638, G671, G779, G977, G1067, G1075, G1266, G1311, G1326, G1645, G1947 and their functional equivalogs, possess reduced fertility; flowers are infertile and fail to yield seed. These could be desirable traits, as low fertility could be exploited to prevent or minimize the escape of the pollen of genetically modified organisms (GMOs) into the environment.

The morphological phenotype shown by plants overexpressing some of the present transcription factors indicate that these genes and their equivalogs may be used to alter inflorescence architecture. In particular, a reduction in pedicel length and a change in the position at which flowers and fruits are held, might influence harvesting or pollination efficiency. Additionally, such changes may produce attractive novel forms for the ornamental markets.

One interesting application for manipulation of flower structure, for example, by introduced transcription factors could be in the increased production of edible flowers or flower parts, including saffron, which is derived from the stigmas of Crocus sativus.

Genes that later silique conformation in brassicates may be used to modify fruit ripening processes in brassicates and other plants, which may positively affect seed or fruit quality.

A number of the presently disclosed transcription factors may affect the timing of phase changes in plants. Since the timing or phase changes generally affects a plant's eventual size, these genes may prove beneficial by providing means for improving yield and biomass.

General development and morphology: shoot meristem and branching patterns. Several of the presently disclosed transcription factor genes, including G390, when introduced into plants, have been shown to cause stem bifurcations in developing shoots in which the shoot meristems split to form two or three separate shoots. These transcription factors and their functional equivalogs may thus be used to manipulate branching. This would provide a unique appearance, which may be desirable in ornamental applications, and may be used to modify lateral branching for use in the forestry industry. A reduction in the formation of lateral branches (e.g., with G1499 or equivalogs) could reduce knot formation. Conversely, increasing the number of lateral branches (e.g., with G438 or equivalogs) could provide utility when a plant is used as a view- or windscreen.

General development and morphology: apical dominance: The modified expression of presently disclosed transcription factors (e.g., G559, G732, G1255, G1275, G1645, and their equivalogs) that reduce apical dominance could be used in ornamental horticulture, for example, to modify plant architecture, for example, to produce a shorter, more bushy stature than wild type. The latter form would have ornamental utility as well as provide increased resistance to lodging.

General development and morphology: trichome density, development or structure. Several of the presently disclosed transcription factor genes have been used to modify trichome number, density, trichome cell fate, amount of trichome products produced by plants, or produce ectopic trichome formation. These may include G25, G212, G225, G226, G247, G634, G676, G682, G1332 G1816, G2718, and their equivalogs. In most cases where the metabolic pathways are impossible to engineer, increasing trichome density or size on leaves may be the only way to increase plant productivity. Thus, by increasing trichome density, size or type, these trichome-affecting genes and their functional equivalogs would have profound utilities in molecular farming practices by making use of trichomes as a manufacturing system for complex secondary metabolites.

Trichome glands on the surface of many higher plants produce and secrete exudates that give protection from the elements and pests such as insects, microbes and herbivores. These exudates may physically immobilize insects and spores, may be insecticidal or ant-microbial or they may act as allergens or irritants to protect against herbivores. By modifying trichome location, density or activity with presently disclosed transcription factors that modify these plant characteristics, plants that are better protected and higher yielding may be the result.

A potential application for these trichome-affecting genes and their equivalogs also exists in cotton: cotton fibers are modified unicellular trichomes that develop from the outer ovule epidermis. In fact, only about 30% of these epidermal cells develop into trichomes, but all have the potential to develop a trichome fate. Trichome-affecting genes can trigger an increased number of these cells to develop as trichomes and thereby increase the yield of cotton fibers. Since the mallow family is closely related to the Brassica family, genes involved in trichome formation will likely have homologs in cotton or function in cotton.

If the effects on trichome patterning reflect a general change in heterochronic processes, trichome-affecting transcription factors or their equivalogs can be used to modify the way meristems and/or cells develop during different phases of the plant life cycle. In particular, altering the timing of phase changes could afford positive effects on yield and biomass production.

General development and morphology: stem morphology and altered vascular tissue structure. Plants transformed with transcription factor genes that modify stem morphology or lignin content may be used to affect overall plant architecture and the distribution of lignified fiber cells within the stem.

Modulating lignin content might allow the quality of wood used for furniture or construction to be improved. Lignin is energy rich; increasing lignin composition could therefore be valuable in raising the energy content of wood used for fuel. Conversely, the pulp and paper industries seek wood with a reduced lignin content. Currently, lignin must be removed in a costly process that involves the use of many polluting chemicals. Consequently, lignin is a serious barrier to efficient pulp and paper production (Tzfira et al. (1998) *TIBTECH* 16: 439-446; Robinson (1999) *Nature Biotechnology* 17: 27-30). In addition to forest biotechnology applications, changing lignin content by selectively expressing or repressing transcription factors in fruits and vegetables might increase their palatability.

Transcription factors that modify stem structure, including G438, G748 and their equivalogs, may also be used to achieve reduction of higher-order shoot development, resulting in significant plant architecture modification. Overexpression of the genes that encode these transcription factors in woody plants might result in trees that lack side branches, and have fewer knots in the wood. Altering branching patterns could also have applications amongst ornamental and agricultural crops. For example, applications might exist in any species where secondary shoots currently have to be removed manually, or where changes in branching pattern could increase yield or facilitate more efficient harvesting.

General development and morphology: altered root development. By modifying the structure or development of roots by transforming into a plant one or more of the presently disclosed transcription factor genes, including G9, G225, G226, G1482, and their equivalogs, plants may be produced that have the capacity to thrive in otherwise unproductive soils. For example, grape roots extending further into rocky soils would provide greater anchorage, greater coverage with increased branching, or would remain viable in water-logged soils, thus increasing the effective planting range of the crop and/or increasing yield and survival. It may be advantageous to manipulate a plant to produce short roots, as when a soil in which the plant will be growing is occasionally flooded, or when pathogenic fungi or disease-causing nematodes are prevalent.

In addition, presently disclosed transcription factors including G225; G226; G682; G1816; G2718 and their equivalogs may be used to increase root hair density and thus increase tolerance to abiotic stresses, thereby improving yield and quality.

General development and morphology: seed development, ripening and germination rate. A number of the presently disclosed transcription factor genes (e.g., G979) have been shown to modify seed development and germination rate, including when the seeds are in conditions normally unfavorable for germination (e.g., cold, heat or salt stress, or in the presence of ABA), and may, along with functional equivalogs, thus be used to modify and improve germination rates under adverse conditions.

General development and morphology: cell differentiation and cell proliferation. Several of the disclosed transcription factors regulate cell proliferation and/or differentiation, including G1540 and its functional equivalogs. Control of these processes could have valuable applications in plant transformation, cell culture or micro-propagation systems, as well as in control of the proliferation of particular useful tissues or cell types. Transcription factors that induce the proliferation of undifferentiated cells can be operably linked with an inducible promoter to promote the formation of callus that can be used for transformation or production of cell suspension cultures. Transcription factors that prevent cells from differentiating, such as G1540 or its equivalogs, could be used to confer stem cell identity to cultured cells. Transcription factors that promote differentiation of shoots could be used in transformation or micro-propagation systems, where regeneration of shoots from callus is currently problematic. In addition, transcription factors that regulate the differentiation of specific tissues could be used to increase the proportion of these tissues in a plant. Genes that promote the differentiation of carpel tissue could be introduced into commercial species to induce formation of increased numbers of carpels or fruits. A particular application might exist in saffron, one of the world's most expensive spices. Saffron filaments, or threads, are actually the dried stigmas of the saffron flower, *Crocus sativus Linneaus*. Each flower contains only three stigmas, and more than 75,000 of these flowers are needed to produce just one pound of saffron filaments. An increase in carpel number would increase the quantity of stigmatic tissue and improve yield.

General development and morphology: cell expansion. Plant growth results from a combination of cell division and cell expansion. Transcription factors such as G521 or its equivalogs may be useful in regulation of cell expansion. Altered regulation of cell expansion could affect stem length, an important agronomic characteristic. For instance, short cultivars of wheat contributed to the Green Revolution, because plants that put fewer resources into stem elongation allocate more resources into developing seed and produce higher yield. These plants are also less vulnerable to wind and rain damage. These cultivars were found to be altered in their sensitivity to gibberellins, hormones that regulate stem elongation through control of both cell expansion and cell division. Altered cell expansion in leaves could also produce novel and ornamental plant forms.

General development and morphology: phase change and floral reversion. Transcription factors that regulate phase change can modulate the developmental programs of plants and regulate developmental plasticity of the shoot meristem. In particular, these genes might be used to manipulate seasonality and influence whether plants display an annual or perennial habit.

General development and morphology: rapid growth and/or development. A number of the presently disclosed transcription factor genes have been shown to have significant effects on plant growth rate and development. These observations have included, for example, more rapid or delayed growth and development of reproductive organs. Thus, by causing more rapid development, genes that induce rapid growth or development and their functional equivalogs would prove useful for regions with short growing seasons; other transcription factors that delay development may be useful for regions with longer growing seasons. Accelerating plant growth would also improve early yield or increase biomass at an earlier stage, when such is desirable (for example, in producing forestry products or vegetable sprouts for consumption). Transcription factors that promote faster development such as G807 and its functional equivalogs may also be used to modify the reproductive cycle of plants.

General development and morphology: slow growth rate. A number of the presently disclosed transcription factor genes, including G447, G740, G1062, G1335, G1468, and G1474, have been shown to have significant effects on retarding plant growth rate and development. These observations have included, for example, delayed growth and development of reproductive organs. Slow growing plants may be highly desirable to ornamental horticulturists, both for providing house plants that display little change in their appearance over time, or outdoor plants for which wild-type or rapid growth is undesirable (e.g., ornamental palm trees). Slow growth may also provide for a prolonged fruiting period, thus extending the harvesting season, particularly in regions with long growing seasons. Slow growth could also provide a prolonged period in which pollen is available for improved self- or cross-fertilization, or cross-fertilization of cultivars that normally flower over non-overlapping time periods. The latter aspect may be particularly useful to plants comprising two or more distinct grafted cultivars (e.g., fruit trees) with normally non-overlapping flowering periods.

General development and morphology: senescence. Presently disclosed transcription factor genes may be used to alter senescence responses in plants. Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. In an experimental setting, tobacco plants engineered to inhibit leaf senescence had a longer photosynthetic lifespan, and produced a 50% increase in dry weight and seed yield (Gan and Amasino (1995) *Science* 270: 1986-1988). Delayed flower senescence caused by overexpression of transcription factors (e.g., G249, G571, G878, G1050 or their equivalogs) may generate plants that retain their blossoms longer and this may be of potential interest to the ornamental horticulture industry, and delayed foliar and fruit senescence could improve post-harvest shelf-life of produce.

Premature senescence caused by, for example, G636, G1128 and their equivalogs may be used to improve a plant's response to disease and hasten fruit ripening.

Growth rate and development: lethality and necrosis. Overexpression of transcription factors, for example, G24, G374, G515; G578, G877, G1076, G1304 and their equivalogs that have a role in regulating cell death may be used to induce lethality in specific tissues or necrosis in response to pathogen attack. For example, if a transcription factor gene inducing lethality or necrosis was specifically active in gametes or reproductive organs, its expression in these tissues would lead to ablation and subsequent male or female sterility. Alternatively, under pathogen-regulated expression, a necrosis-inducing transcription factor can restrict the spread of a pathogen infection through a plant.

Plant size: large plants. Plants overexpressing G46, G624, G1073, G1435, G1451, and G1468, for example, have been shown to be larger than controls. For some ornamental plants, the ability to provide larger varieties with these genes or their equivalogs may be highly desirable. For many plants, including fruit-bearing trees, trees that are used for lumber production, or trees and shrubs that serve as view or wind screens, increased stature provides improved benefits in the forms of greater yield or improved screening. Crop species may also produce higher yields on larger cultivars, particularly those in which the vegetative portion of the plant is edible.

Plant size: large seedlings. Presently disclosed transcription factor genes, that produce large seedlings can be used to produce crops that become established faster. Large seedlings are generally hardier, less vulnerable to stress, and better able to out-compete weed species. Seedlings transformed with presently disclosed transcription factors, including G1313, for example, have been shown to possess larger cotyledons and were more developmentally advanced than control plants. Rapid seedling development made possible by manipulating expression of these genes or their equivalogs is likely to reduce loss due to diseases particularly prevalent at the seedling stage (e.g., damping off) and is thus important for survivability of plants germinating in the field or in controlled environments.

Plant size: dwarfed plants. Presently disclosed transcription factor genes, including G24 and many others and their equivalogs, for example, that can be used to decrease plant stature are likely to produce plants that are more resistant to damage by wind and rain, have improved lodging resistance, or more resistant to heat or low humidity or water deficit. Dwarf plants are also of significant interest to the ornamental horticulture industry, and particularly for home garden applications for which space availability may be limited.

Plant size: fruit size and number. Introduction of presently disclosed transcription factor genes that affect fruit size will have desirable impacts on fruit size and number, which may comprise increases in yield for fruit crops, or reduced fruit yield, such as when vegetative growth is preferred (e.g., with bushy ornamentals, or where fruit is undesirable, as with ornamental olive trees).

Leaf morphology: dark leaves. Color-affecting components in leaves include chlorophylls (generally green), anthocyanins (generally red to blue) and carotenoids (generally yellow to red). Transcription factor genes that increase these pigments in leaves, including G385, G447, G912, G932, G977, G1128, G1267, G1323, G1327, G1334, G1499, and their equivalogs, may positively affect a plant's value to the ornamental horticulture industry. Variegated varieties, in particular, would show improved contrast. Other uses that result from overexpression of transcription factor genes include improvements in the nutritional value of foodstuffs. For example, lutein is an important nutraceutical; lutein-rich diets have been shown to help prevent age-related macular degeneration (ARMD), the leading cause of blindness in elderly people. Consumption of dark green leafy vegetables has been shown in clinical studies to reduce the risk of ARMD.

Enhanced chlorophyll and carotenoid levels could also improve yield in crop plants. Lutein, like other xanthophylls such as zeaxanthin and violaxanthin, is an essential component in the protection of the plant against the damaging effects of excessive light. Specifically, lutein contributes, directly or indirectly, to the rapid rise of non-photochemical quenching in plants exposed to high light. Crop plants engineered to contain higher levels of lutein could therefore have improved photo-protection, leading to less oxidative damage and better growth under high light (e.g., during long summer days, or at higher altitudes or lower latitudes than those at which a non-transformed plant would survive). Additionally, elevated chlorophyll levels increases photosynthetic capacity.

Leaf morphology: changes in leaf shape. Presently disclosed transcription factors produce marked and diverse effects on leaf development and shape. The transcription factors include G32; G224; G428; G464; G629; G671; G736; G903; G905; G921; G932; G977; G1038; G1067; G1073; G1075; G1269; G1493; G1645, G1468, and their equivalogs. At early stages of growth, transgenic seedlings have developed narrow, upward pointing leaves with long petioles, possibly indicating a disruption in circadian-clock controlled processes or nyctinastic movements. Other transcription factor genes can be used to alter leaf shape in a significant manner from wild type, some of which may find use in ornamental applications.

Leaf morphology: altered leaf size. Large leaves, such as those produced in plants overexpressing G438, G1274, G1451 and their functional equivalogs, generally increase plant biomass. This provides benefit for crops where the vegetative portion of the plant is the marketable portion.

Leaf morphology: light green, gray and variegated leaves. Transcription factor genes that provide an altered appearance, including G1468 and its equivalogs, may positively affect a plant's value to the ornamental horticulture industry.

Leaf morphology: glossy leaves. Transcription factor genes such as G1267 and its equivalogs that induce the formation of glossy leaves generally do so by elevating levels of epidermal wax. Thus, the genes could be used to engineer changes in the composition and amount of leaf surface components, including waxes. The ability to manipulate wax composition, amount, or distribution could modify plant tolerance to drought and low humidity, or resistance to insects or pathogens. Additionally, wax may be a valuable commodity in some species, and altering its accumulation and/or composition could enhance yield.

Seed morphology: altered seed coloration. Presently disclosed transcription factor genes, including G156, and G668 have been used to modify seed color, which, along with the equivalogs of these genes, could provide added appeal to seeds or seed products.

Seed morphology: altered seed size and shape. The introduction of presently disclosed transcription factor genes into plants that increase (e.g., G206,G584,G1255) or decrease (e.g., G1145). the size of seeds may have a significant impact on yield and appearance, particularly when the product is the seed itself (e.g., in the case of grains, legumes, nuts, etc.). Seed size, in addition to seed coat integrity, thickness and permeability, seed water content and a number of other components including antioxidants and oligosaccharides, also affects affect seed longevity in storage, with larger seeds often being more desirable for prolonged storage.

Transcription factor genes that alter seed shape, including G1062, G1145 and their equivalogs may have both ornamental applications and improve or broaden the appeal of seed products.

Leaf biochemistry: increased leaf wax. Overexpression of transcription factors genes, including G975 and its equivalogs, which results in increased leaf wax could be used to manipulate wax composition, amount, or distribution. These transcription factors can improve yield in those plants and crops from which wax is a valuable product. The genes may also be used to modify plant tolerance to drought and/or low humidity or resistance to insects, as well as plant appearance (glossy leaves). The effect of increased wax deposition on leaves of a plant like may improve water use efficiency. Manipulation of these genes may reduce the wax coating on sunflower seeds; this wax fouls the oil extraction system during sunflower seed processing for oil. For the latter purpose or any other where wax reduction is valuable, antisense or cosuppression of the transcription factor genes in a tissue-specific manner would be valuable.

Leaf biochemistry: leaf prenyl lipids, including tocopherol. Prenyl lipids play a role in anchoring proteins in membranes or membranous organelles. Thus modifying the prenyl lipid content of seeds and leaves could affect membrane integrity and function. One important group of prenyl lipids, the tocopherols, have both anti-oxidant and vitamin E activity. A number of presently disclosed transcription factor genes, including G214, G280, G987, G1133, G1324, and G1328 have been shown to modify the prenyl lipid content of leaves in plants, and these genes and their equivalogs may thus be used to alter prenyl lipid content of leaves.

Leaf biochemistry: altered leaf insoluble sugars. Overexpression of a number of presently disclosed transcription factors, including G211, G237, G242, G274, G307,G428, G435, G525, G598, G777, G869, G1012, and G1309, resulted in plants with altered leaf insoluble sugar content. This transcription factor and its equivalogs that alter plant cell wall composition have several potential applications including altering food digestibility, plant tensile strength, wood quality, pathogen resistance and in pulp production. In particular, hemicellulose is not desirable in paper pulps because of its lack of strength compared with cellulose. Thus modulating the amounts of cellulose vs. hemicellulose in the plant cell wall is desirable for the paper/lumber industry. Increasing the insoluble carbohydrate content in various fruits, vegetables, and other edible consumer products will result in enhanced fiber content. Increased fiber content would not only provide health benefits in food products, but might also increase digestibility of forage crops. In addition, the hemicellulose and pectin content of fruits and berries affects the quality of jam and catsup made from them. Changes in hemicellulose and pectin content could result in a superior consumer product.

Leaf biochemistry: increased leaf anthocyanin. Several presently disclosed transcription factor genes, including G663 and its equivalogs, may be used to alter anthocyanin production in numerous plant species. Expression of presently disclosed transcription factor genes that increase flavonoid production in plants, including anthocyanins and condensed tannins, may be used to alter in pigment production for horticultural purposes, and possibly increasing stress resistance. A number of flavonoids have been shown to have antimicrobial activity and could be used to engineer pathogen resistance. Several flavonoid compounds have health promoting effects such as inhibition of tumor growth, prevention of bone loss and prevention of the oxidation of lipids. Increased levels of condensed tannins, in forage legumes would be an important agronomic trait because they prevent pasture bloat by collapsing protein foams within the rumen. For a review on the utilities of flavonoids and their derivatives, refer to Dixon et al. (1999) *Trends Plant Sci.* 4: 394-400.

Leaf and seed biochemistry altered fatty acid content. A number of the presently disclosed transcription factor genes have been shown to alter the fatty acid composition in plants, and seeds and leaves in particular. This modification suggests several utilities, including improving the nutritional value of seeds or whole plants. Dietary fatty acids ratios have been shown to have an effect on, for example, bone integrity and remodeling (see, for example, Weiler (2000) *Pediatr. Res.* 47:5 692-697). The ratio of dietary fatty acids may alter the precursor pools of long-chain polyunsaturated fatty acids that serve as precursors for prostaglandin synthesis. In mammalian connective tissue, prostaglandins serve as important signals regulating the balance between resorption and formation in bone and cartilage. Thus dietary fatty acid ratios altered in seeds may affect the etiology and outcome of bone loss.

Transcription factors that reduce leaf fatty acids, for example, 16:3 fatty acids, may be used to control thylakoid membrane development, including proplastid to chloroplast development. The genes that encode these transcription factors (e.g., G718, G1266, and G1347) might thus be useful for controlling the transition from proplastid to chromoplast in fruits and vegetables. It may also be desirable to change the expression of these genes to prevent cotyledon greening in *Brassica napus* or *B. campestris* to avoid green oil due to early frost.

Transcription factor genes that increase leaf fatty acid production, including G214 and G231, could potentially be used to manipulate seed composition, which is very important for the nutritional value and production of various food products. A number of transcription factor genes are involved in mediating an aspect of the regulatory response to temperature. These genes may be used to alter the expression of desaturases that lead to production of 18:3 and 16:3 fatty acids, the balance of which affects membrane fluidity and mitigates damage to cell membranes and photosynthetic structures at high and low temperatures.

Leaf and seed biochemistry: glucosinolates. A number of glucosinolates have been shown to have anti-cancer activity; thus, increasing the levels or composition of these compounds by introducing several of the presently disclosed transcription factors, including G185, G681, G1069; G1198, and G1322, can have a beneficial effect on human diet.

Glucosinolates are undesirable components of the oilseeds used in animal feed since they produce toxic effects. Low-glucosinolate varieties of canola, for example, have been developed to combat this problem. Glucosinolates form part of a plant's natural defense against insects. Modification of glucosinolate composition or quantity by introducing transcription factors that affect these characteristics can therefore afford increased protection from herbivores. Furthermore, in edible crops, tissue specific promoters can be used to ensure that these compounds accumulate specifically in tissues, such as the epidermis, which are not taken for consumption.

Leaf and seed biochemistry: production of seed and leaf phytosterols: Presently disclosed transcription factor genes that modify levels of phytosterols in plants may have at least two utilities. First, phytosterols are an important source of precursors for the manufacture of human steroid hormones. Thus, regulation of transcription factor expression or activity could lead to elevated levels of important human steroid precursors for steroid semi-synthesis. For example, transcription factors that cause elevated levels of campesterol in leaves, or sitosterols and stigmasterols in seed crops, would be useful for this purpose. Phytosterols and their hydrogenated derivatives phytostanols also have proven cholesterol-lowering properties, and transcription factor genes that modify the expression of these compounds in plants would thus provide health benefits.

Seed biochemistry: modified seed oil and fatty acid content. The composition of seeds, particularly with respect to seed oil amounts and/or composition, is very important for the nutritional and caloric value and production of various food and feed products. Several of the presently disclosed transcription factor genes in seed lipid saturation that alter seed oil content could be used to improve the heat stability of oils or to improve the nutritional quality of seed oil, by, for example, reducing the number of calories in seed by decreasing oil or fatty acid content (e.g., G180, G192, G201, G222, G241, G663, G668, G718, G732, G777, G911, G1323, and G1820), increasing the number of calories in animal feeds by increasing oil or fatty acid content (e.g. G162, G229, G231, G291, G456, G464, G561, G590, G598, G732, G849, G961, G6190, and G1198), or altering seed oil content (G509, G567, G732, G974, G1451, and G1471).

Seed biochemistry: modified seed protein content. As with seed oils, the composition of seeds, particularly with respect to protein amounts and/or composition, is very important for the nutritional value and production of various food and feed products. A number of the presently disclosed transcription factor genes modify the protein concentrations in seeds, including G201, G222, G226, G241, G629, G630, G663, G668, G718, G732, G865, G911, G1048, G1323, G1449, and G1820, which increase seed protein, G229, G231, G418, G456, G464, G732, and G1634, which decrease seed protein, and G162, G509, G567, G732, and G849, which alter seed protein content, would provide nutritional benefits, and may be used to prolong storage, increase seed pest or disease resistance, or modify germination rates.

Seed biochemistry: seed prenyl lipids. Prenyl lipids play a role in anchoring proteins in membranes or membranous organelles. Thus, presently disclosed transcription factor genes and their equivalogs that modify the prenyl lipid content of seeds and leaves could affect membrane integrity and function. A number of presently disclosed transcription factor genes, including G214, G718, G748, G883, and G1052, have been shown to modify the tocopherol composition of plants. α-Tocopherol is better known as vitamin E. Tocopherols such as α- and γ-tocopherol both have antioxidant activity.

Seed biochemistry: increased seed anthocyanin. Several presently disclosed transcription factor genes, including G663 and its equivalogs, may be used to alter anthocyanin production in the seeds of plants. As with leaf anthocyanins, expression of presently disclosed transcription factor genes that increase flavonoid (anthocyanins and condensed tannins) production in seeds, including G663 and its equivalogs, may be used to alter in pigment production for horticultural purposes, and possibly increasing stress resistance, antimicrobial activity and health promoting effects such as inhibition of tumor growth, prevention of bone loss and prevention of the oxidation of lipids.

Root biochemistry: increased root anthocyanin. Presently disclosed transcription factor genes, including G663, may be used to alter anthocyanin production in the root of plants. As described above for seed anthocyanins, expression of presently disclosed transcription factor genes that increase flavonoid (anthocyanins and condensed tannins) production in seeds, including G663 and its equivalogs, may be used to alter in pigment production for horticultural purposes, and possibly increasing stress resistance, antimicrobial activity and health promoting effects such as inhibition of tumor growth, prevention of bone loss and prevention of the oxidation of lipids.

Light response/shade avoidance: altered cotyledon, hypocotyl, petiole development, altered leaf orientation, constitutive photomorphogenesis, photomorphogenesis in low light. Presently disclosed transcription factor genes, including G351, G1062, and G1322, that modify a plant's response to light may be useful for modifying plant growth or development, for example, photomorphogenesis in poor light, or accelerating flowering time in response to various light intensities, quality or duration to which a non-transformed plant would not similarly respond. Examples of such responses that have been demonstrated include leaf number and arrangement, and early flower bud appearances. Elimination of shading responses may lead to increased planting densities with subsequent yield enhancement. As these genes may also alter plant architecture, they may find use in the ornamental horticulture industry.

Pigment: increased anthocyanin level in various plant organs and tissues. In addition to seed, leaves and roots, as mentioned above, several presently disclosed transcription factor genes (i.e., G663 and equivalogs) can be used to alter anthocyanin levels in one or more tissues, depending on the organ in which these genes are expressed. The potential utilities of these genes include alterations in pigment production for horticultural purposes, and possibly increasing stress resistance, antimicrobial activity and health promoting effects such as inhibition of tumor growth, prevention of bone loss and prevention of the oxidation of lipids.

Miscellaneous biochemistry: diterpenes in leaves and other plant parts. Depending on the plant species, varying amounts of diverse secondary biochemicals (often lipophilic terpenes) are produced and exuded or volatilized by trichomes. These exotic secondary biochemicals, which are relatively easy to extract because they are on the surface of the leaf, have been widely used in such products as flavors and aromas, drugs, pesticides and cosmetics. Thus, the overexpression of genes that are used to produce diterpenes in plants may be accomplished by introducing transcription factor genes that induce said overexpression. One class of secondary metabolites, the diterpenes, can effect several biological systems such as tumor progression, prostaglandin synthesis and tissue inflammation. In addition, diterpenes can act as insect pheromones, termite allomones, and can exhibit neurotoxic, cytotoxic and antimitotic activities. As a result of this functional diversity, diterpenes have been the target of research several pharmaceutical ventures. In most cases where the metabolic pathways are impossible to engineer, increasing trichome density or size on leaves may be the only way to increase plant productivity.

Miscellaneous Biochemistry: Production of Miscellaneous Secondary Metabolites.

Microarray data suggests that flux through the aromatic amino acid biosynthetic pathways and primary and secondary metabolite biosynthetic pathways are up-regulated. Gene coding for enzymes involved in alkaloid biosynthesis include indole-3-glycerol phosphatase and strictosidine synthase are induced in G229 overexpressors. Genes for enzymes involved in aromatic amino acid biosynthesis are also up-regulated including tryptophan synthase and tyrosine transaminase. Phenylalanine ammonia lyase, chalcone synthase and trans-cinnamate mono-oxygenase are also induced and are involved in phenylpropenoid biosynthesis.

Antisense and Co-suppression

In addition to expression of the nucleic acids of the invention as gene replacement or plant phenotype modification nucleic acids, the nucleic acids are also useful for sense and anti-sense suppression of expression, e.g., to down-regulate expression of a nucleic acid of the invention, e.g., as a further mechanism for modulating plant phenotype. That is, the nucleic acids of the invention, or subsequences or anti-sense sequences thereof, can be used to block expression of naturally occurring homologous nucleic acids. A variety of sense and anti-sense technologies are known in the art, e.g., as set forth in Lichtenstein and Nellen (1997) *Antisense Technology: A Practical Approach* IRL Press at Oxford University Press, Oxford, U.K. Antisense regulation is also described in Crowley et al. (1985) *Cell* 43: 633-641; Rosenberg et al. (1985) Nature 313: 703-706; Preiss et al. (1985) *Nature* 313: 27-32; Melton (1985) *Proc. Natl. Acad. Sci.* 82: 144-148; Izant and Weintraub (1985) *Science* 229: 345-352; and Kim and Wold (1985) *Cell* 42: 129-138. Additional methods for antisense regulation are known in the art. Antisense regulation has been used to reduce or inhibit expression of plant genes in, for example in European Patent Publication No. 271988. Antisense RNA may be used to reduce gene expression to produce a visible or biochemical phenotypic change in a plant (Smith et al. (1988) *Nature*, 334: 724-726; Smith et al. (1990) *Plant Mol. Biol.* 14: 369-379). In general, sense or anti-sense sequences are introduced into a cell, where they are optionally amplified, e.g., by transcription. Such sequences include both simple oligonucleotide sequences and catalytic sequences such as ribozymes.

For example, a reduction or elimination of expression (i.e., a "knock-out") of a transcription factor or transcription factor homolog polypeptide in a transgenic plant, e.g., to modify a plant trait, can be obtained by introducing an antisense construct corresponding to the polypeptide of interest as a cDNA. For antisense suppression, the transcription factor or homolog cDNA is arranged in reverse orientation (with respect to the coding sequence) relative to the promoter sequence in the expression vector. The introduced sequence need not be the full length cDNA or gene, and need not be identical to the cDNA or gene found in the plant type to be transformed. Typically, the antisense sequence need only be capable of hybridizing to the target gene or RNA of interest. Thus, where the introduced sequence is of shorter length, a higher degree of homology to the endogenous transcription factor sequence will be needed for effective antisense suppression. While antisense sequences of various lengths can be utilized, preferably, the introduced antisense sequence in the vector will be at least 30 nucleotides in length, and improved antisense suppression will typically be observed as the length of the antisense sequence increases. Preferably, the length of the antisense sequence in the vector will be greater than 100 nucleotides. Transcription of an antisense construct as described results in the production of RNA molecules that are the reverse complement of mRNA molecules transcribed from the endogenous transcription factor gene in the plant cell.

Suppression of endogenous transcription factor gene expression can also be achieved using a ribozyme. Ribozymes are RNA molecules that possess highly specific endoribonuclease activity. The production and use of ribozymes are disclosed in U.S. Pat. No. 4,987,071 and U.S. Pat. No. 5,543,508. Synthetic ribozyme sequences including antisense RNAs can be used to confer RNA cleaving activity on the antisense RNA, such that endogenous mRNA molecules that hybridize to the antisense RNA are cleaved, which in turn leads to an enhanced antisense inhibition of endogenous gene expression.

Vectors in which RNA encoded by a transcription factor or transcription factor homolog cDNA is over-expressed can also be used to obtain co-suppression of a corresponding endogenous gene, e.g., in the manner described in U.S. Pat. No. 5,231,020 to Jorgensen. Such co-suppression (also termed sense suppression) does not require that the entire transcription factor cDNA be introduced into the plant cells, nor does it require that the introduced sequence be exactly identical to the endogenous transcription factor gene of interest. However, as with antisense suppression, the suppressive efficiency will be enhanced as specificity of hybridization is increased, e.g., as the introduced sequence is lengthened, and/or as the sequence similarity between the introduced sequence and the endogenous transcription factor gene is increased.

Vectors expressing an untranslatable form of the transcription factor mRNA, e.g., sequences comprising one or more stop codon, or nonsense mutation) can also be used to suppress expression of an endogenous transcription factor, thereby reducing or eliminating its activity and modifying one or more traits. Methods for producing such constructs are described in U.S. Pat. No. 5,583,021. Preferably, such constructs are made by introducing a premature stop codon into the transcription factor gene. Alternatively, a plant trait can be modified by gene silencing using double-strand RNA (Sharp (1999) *Genes and Development* 13: 139-141). Another method for abolishing the expression of a gene is by insertion mutagenesis using the T-DNA of *Agrobacterium tumefaciens*. After generating the insertion mutants, the mutants can be screened to identify those containing the insertion in a transcription factor or transcription factor homolog gene. Plants containing a single transgene insertion event at the desired gene can be crossed to generate homozygous plants for the mutation. Such methods are well known to those of skill in the art (See for example Koncz et al. (1992) *Methods in Arabidopsis Research*, World Scientific Publishing Co. Pte. Ltd., River Edge, N.J.).

Alternatively, a plant phenotype can be altered by eliminating an endogenous gene, such as a transcription factor or transcription factor homolog, e.g., by homologous recombination (Kempin et al. (1997) *Nature* 389: 802-803).

A plant trait can also be modified by using the Cre-lox system (for example, as described in U.S. Pat. No. 5,658,772). A plant genome can be modified to include first and second lox sites that are then contacted with a Cre recombinase. If the lox sites are in the same orientation, the intervening DNA sequence between the two sites is excised. If the lox sites are in the opposite orientation, the intervening sequence is inverted.

The polynucleotides and polypeptides of this invention can also be expressed in a plant in the absence of an expression cassette by manipulating the activity or expression level of the endogenous gene by other means, such as, for example, by ectopically expressing a gene by T-DNA activation tagging (Ichikawa et al. (1997) *Nature* 390 698-701; Kakimoto et al. (1996) Science 274: 982-985) method entails transforming a plant with a gene tag containing multiple transcriptional enhancers and once the tag has inserted into the genome, expression of a flanking gene coding sequence becomes deregulated. In another example, the transcriptional machinery in a plant can be modified so as to increase transcription levels of a polynucleotide of the invention (See, e.g., PCT Publications WO 96/06166 and WO 98/53057 which describe the modification of the DNA-binding specificity of zinc finger proteins by changing particular amino acids in the DNA-binding motif).

The transgenic plant can also include the machinery necessary for expressing or altering the activity of a polypeptide encoded by an endogenous gene, for example, by altering the phosphorylation state of the polypeptide to maintain it in an activated state.

Transgenic plants (or plant cells, or plant explants, or plant tissues) incorporating the polynucleotides of the invention and/or expressing the polypeptides of the invention can be produced by a variety of well established techniques as described above. Following construction of a vector, most typically an expression cassette, including a polynucleotide, e.g., encoding a transcription factor or transcription factor homolog, of the invention, standard techniques can be used to introduce the polynucleotide into a plant, a plant cell, a plant explant or a plant tissue of interest. Optionally, the plant cell, explant or tissue can be regenerated to produce a transgenic plant.

The plant can be any higher plant, including gymnosperms, monocotyledonous and dicotyledenous plants. Suitable protocols are available for Leguminosae (alfalfa, soybean, clover, etc.), Umbelliferae (carrot, celery, parsnip), Cruciferae (cabbage, radish, rapeseed, broccoli, etc.), Curcurbitaceae (melons and cucumber), Gramineae (wheat, corn, rice, barley, millet, etc.), Solanaceae (potato, tomato, tobacco, peppers, etc.), and various other crops. See protocols described in Ammirato et al., Eds., (1984) *Handbook of Plant Cell Culture—Crop Species*, Macmillan Publ. Co., New York, N.Y.; Shimamoto et al. (1989) *Nature* 338: 274-276; Fromm et al. (1990) *Bio/Technol.* 8: 833-839; and Vasil et al. (1990) *Bio/Technol.* 8: 429-434.

Transformation and regeneration of both monocotyledonous and dicotyledonous plant cells is now routine, and the selection of the most appropriate transformation technique will be determined by the practitioner. The choice of method will vary with the type of plant to be transformed; those skilled in the art will recognize the suitability of particular methods for given plant types. Suitable methods can include, but are not limited to: electroporation of plant protoplasts; liposome-mediated transformation; polyethylene glycol (PEG) mediated transformation; transformation using viruses; micro-injection of plant cells; micro-projectile bombardment of plant cells; vacuum infiltration; and *Agrobacterium tumefaciens* mediated transformation. Transformation means introducing a nucleotide sequence into a plant in a manner to cause stable or transient expression of the sequence.

Successful examples of the modification of plant characteristics by transformation with cloned sequences which serve to illustrate the current knowledge in this field of technology, and which are herein incorporated by reference, include: U.S. Pat. Nos. 5,571,706; 5,677,175; 5,510,471; 5,750,386; 5,597,945; 5,589,615; 5,750,871; 5,268,526; 5,780,708; 5,538,880; 5,773,269; 5,736,369 and 5,610,042.

Following transformation, plants are preferably selected using a dominant selectable marker incorporated into the transformation vector. Typically, such a marker will confer antibiotic or herbicide resistance on the transformed plants, and selection of transformants can be accomplished by exposing the plants to appropriate concentrations of the antibiotic or herbicide.

After transformed plants are selected and grown to maturity, those plants showing a modified trait are identified. The modified trait can be any of those traits described above. Additionally, to confirm that the modified trait is due to changes in expression levels or activity of the polypeptide or polynucleotide of the invention can be determined by analyzing mRNA expression using Northern blots, RT-PCR or microarrays, or protein expression using immunoblots or Western blots or gel shift assays.

Integrated Systems—Sequence Identity

Additionally, the present invention may be an integrated system, computer or computer readable medium that comprises an instruction set for determining the identity of one or more sequences in a database. In addition, the instruction set can be used to generate or identify sequences that meet any specified criteria. Furthermore, the instruction set may be used to associate or link certain functional benefits, such improved characteristics, with one or more identified sequence.

For example, the instruction set can include, e.g., a sequence comparison or other alignment program, e.g., an available program such as, for example, the Wisconsin Package Version 10.0, such as BLAST, FASTA, PILEUP, FINDPATTERNS or the like (GCG, Madison, Wis.). Public sequence databases such as GenBank, EMBL, Swiss-Prot and PIR or private sequence databases such as PHYTOSEQ sequence database (Incyte Genomics, Palo Alto, Calif.) can be searched.

Alignment of sequences for comparison can be conducted by the local homology algorithm of Smith and Waterman (1981) *Adv. Appl. Math.* 2: 482-489, by the homology alignment algorithm of Needleman and Wunsch (1970) *J. Mol. Biol.* 48: 443-453, by the search for similarity method of Pearson and Lipman (1988) *Proc. Natl. Acad. Sci.* 85: 2444-2448, by computerized implementations of these algorithms. After alignment, sequence comparisons between two (or more) polynucleotides or polypeptides are typically performed by comparing sequences of the two sequences over a comparison window to identify and compare local regions of sequence similarity. The comparison window can be a segment of at least about 20 contiguous positions, usually about 50 to about 200, more usually about 100 to about 150 contiguous positions. A description of the method is provided in Ausubel et al. supra.

A variety of methods for determining sequence relationships can be used, including manual alignment and computer assisted sequence alignment and analysis. This later approach is a preferred approach in the present invention, due to the increased throughput afforded by computer assisted methods. As noted above, a variety of computer programs for performing sequence alignment are available, or can be produced by one of skill.

One example algorithm that is suitable for determining percent sequence identity and sequence similarity is the BLAST algorithm, which is described in Altschul et al. (1990) *J. Mol. Biol.* 215: 403-410. Software for performing BLAST analyses is publicly available, e.g., through the National Library of Medicine's National Center for Biotechnology Information (ncbi.nlm.nih; see at world wide web (www) National Institutes of Health US government (gov) website). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al. supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=-4, and a comparison of both strands. For amino acid sequences, the BLASTP program uses as defaults a wordlength (W) of 3, an expectation (E) of 10, and the BLOSUM62 scoring matrix (see Henikoff and Henikoff (1992) *Proc. Natl. Acad. Sci.* 89: 10915-10919). Unless otherwise indicated, "sequence identity" here refers to the % sequence identity generated from a tblastx using the NCBI version of the algorithm at the default settings using gapped alignments with the filter "off" (see, for example, NIH NLM NCBI website at ncbi.nlm.nih, supra).

In addition to calculating percent sequence identity, the BLAST algorithm also performs a statistical analysis of the similarity between two sequences (see, e.g. Karlin and Altschul (1993) *Proc. Natl. Acad. Sci.* 90: 5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence (and, therefore, in this context, homologous) if the smallest sum probability in a comparison of the test nucleic acid to the reference nucleic acid is less than about 0.1, or less than about 0.01, and or even less than about 0.001. An additional example of a useful sequence alignment algorithm is PILEUP. PILEUP creates a multiple sequence alignment from a group of related sequences using progressive, pairwise alignments. The program can align, e.g., up to 300 sequences of a maximum length of 5,000 letters.

The integrated system, or computer typically includes a user input interface allowing a user to selectively view one or more sequence records corresponding to the one or more character strings, as well as an instruction set which aligns the one or more character strings with each other or with an additional character string to identify one or more region of sequence similarity. The system may include a link of one or more character strings with a particular phenotype or gene function. Typically, the system includes a user readable output element that displays an alignment produced by the alignment instruction set.

The methods of this invention can be implemented in a localized or distributed computing environment. In a distributed environment, the methods may implemented on a single computer comprising multiple processors or on a multiplicity of computers. The computers can be linked, e.g. through a common bus, but more preferably the computer(s) are nodes on a network. The network can be a generalized or a dedicated local or wide-area network and, in certain preferred embodiments, the computers may be components of an intra-net or an internet.

Thus, the invention provides methods for identifying a sequence similar or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an inter or intra net) and a query is made against the sequence database using the relevant sequences herein and associated plant phenotypes or gene functions.

Any sequence herein can be entered into the database, before or after querying the database. This provides for both expansion of the database and, if done before the querying step, for insertion of control sequences into the database. The control sequences can be detected by the query to ensure the general integrity of both the database and the query. As noted, the query can be performed using a web browser based interface. For example, the database can be a centralized public database such as those noted herein, and the querying can be done from a remote terminal or computer across an internet or intranet.

Any sequence herein can be used to identify a similar, homologous, paralogous, or orthologous sequence in another plant. This provides means for identifying endogenous sequences in other plants that may be useful to alter a trait of progeny plants, which results from crossing two plants of different strain. For example, sequences that encode an ortholog of any of the sequences herein that naturally occur in a plant with a desired trait can be identified using the sequences disclosed herein. The plant is then crossed with a second plant of the same species but which does not have the desired trait to produce progeny which can then be used in further crossing experiments to produce the desired trait in the second plant. Therefore the resulting progeny plant contains no transgenes; expression of the endogenous sequence may also be regulated by treatment with a particular chemical or other means, such as EMR. Some examples of such compounds well known in the art include: ethylene; cytokinins; phenolic compounds, which stimulate the transcription of the genes needed for infection; specific monosaccharides and acidic environments which potentiate vir gene induction; acidic polysaccharides which induce one or more chromosomal genes; and opines; other mechanisms include light or dark treatment (for a review of examples of such treatments, see, Winans (1992) *Microbiol. Rev.* 56: 12-31; Eyal et al. (1992) *Plant Mol. Biol.* 19: 589-599; Chrispeels et al. (2000) *Plant Mol. Biol.* 42: 279-290; Piazza et al. (2002) *Plant Physiol.* 128: 1077-1086).

Table 7 lists sequences discovered to be orthologous to a number of representative transcription factors of the present invention. The column headings include the transcription factors listed by SEQ ID NO; corresponding Gene ID (GID) numbers; the species from which the orthologs to the transcription factors are derived; the type of sequence (i.e., DNA or protein) discovered to be orthologous to the transcription factors; and the SEQ ID NO of the orthologs, the latter corresponding to the ortholog SEQ ID NOs listed in the Sequence Listing.

TABLE 7

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 961 | Glycine max | DNA | G8 | 11 |
| 962 | Glycine max | DNA | G8 | 11 |
| 963 | Glycine max | DNA | G8 | 11 |
| 964 | Glycine max | DNA | G8 | 11 |
| 965 | Oryza sativa | DNA | G8 | 11 |
| 966 | Oryza sativa | DNA | G8 | 11 |
| 967 | Zea mays | DNA | G8 | 11 |
| 968 | Zea mays | DNA | G8 | 11 |
| 969 | Zea mays | DNA | G8 | 11 |
| 970 | Glycine max | DNA | G19 | 21 |
| 971 | Glycine max | DNA | G19 | 21 |
| 972 | Glycine max | DNA | G19 | 21 |
| 973 | Glycine max | DNA | G19 | 21 |
| 974 | Oryza sativa | DNA | G19 | 21 |
| 975 | Oryza sativa | DNA | G19 | 21 |
| 976 | Oryza sativa | DNA | G19 | 21 |
| 977 | Zea mays | DNA | G19 | 21 |
| 978 | Zea mays | DNA | G19 | 21 |
| 979 | Glycine max | DNA | G22 | 27 |
| 980 | Glycine max | DNA | G22 | 27 |
| 981 | Glycine max | DNA | G24 | 29 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 982 | *Glycine max* | DNA | G24 | 29 |
| 983 | *Glycine max* | DNA | G24 | 29 |
| 984 | *Glycine max* | DNA | G24 | 29 |
| 985 | *Glycine max* | DNA | G24 | 29 |
| 986 | *Glycine max* | DNA | G24 | 29 |
| 987 | *Glycine max* | DNA | G24 | 29 |
| 988 | *Oryza sativa* | DNA | G24 | 29 |
| 989 | *Oryza sativa* | PRT | G24 | 29 |
| 990 | *Oryza sativa* | PRT | G24 | 29 |
| 991 | *Oryza sativa* | PRT | G24 | 29 |
| 992 | *Zea mays* | DNA | G24 | 29 |
| 993 | *Glycine max* | DNA | G28 | 37 |
| 994 | *Glycine max* | DNA | G28 | 37 |
| 995 | *Glycine max* | DNA | G28 | 37 |
| 996 | *Glycine max* | DNA | G28 | 37 |
| 997 | *Glycine max* | DNA | G28 | 37 |
| 998 | *Glycine max* | DNA | G28 | 37 |
| 999 | *Glycine max* | DNA | G28 | 37 |
| 1000 | *Glycine max* | DNA | G28 | 37 |
| 1001 | *Oryza sativa* | PRT | G28 | 37 |
| 1002 | *Oryza sativa* | PRT | G28 | 37 |
| 1003 | *Zea mays* | DNA | G28 | 37 |
| 1004 | *Glycine max* | DNA | G46 | 53 |
| 1005 | *Glycine max* | DNA | G46 | 53 |
| 1006 | *Glycine max* | DNA | G46 | 53 |
| 1007 | *Glycine max* | DNA | G46 | 53 |
| 1008 | *Glycine max* | DNA | G46 | 53 |
| 1009 | *Glycine max* | DNA | G46 | 53 |
| 1010 | *Glycine max* | DNA | G46 | 53 |
| 1011 | *Glycine max* | DNA | G46 | 53 |
| 1012 | *Oryza sativa* | PRT | G46 | 53 |
| 1013 | *Zea mays* | DNA | G46 | 53 |
| 1014 | *Glycine max* | DNA | G157 | 69 |
|  | *Glycine max* | DNA | G1842 | 943 |
|  | *Glycine max* | DNA | G1843 | 945 |
|  | *Glycine max* | DNA | G859 | 567 |
| 1015 | *Glycine max* | DNA | G180 | 87 |
| 1016 | *Glycine max* | DNA | G180 | 87 |
| 1017 | *Oryza sativa* | DNA | G180 | 87 |
| 1018 | *Oryza sativa* | PRT | G180 | 87 |
| 1019 | *Zea mays* | DNA | G180 | 87 |
| 1020 | *Glycine max* | DNA | G188 | 97 |
| 1021 | *Oryza sativa* | PRT | G188 | 97 |
| 1022 | *Oryza sativa* | PRT | G188 | 97 |
| 1023 | *Zea mays* | DNA | G188 | 97 |
| 1024 | *Glycine max* | DNA | G192 | 101 |
| 1025 | *Oryza sativa* | PRT | G192 | 101 |
| 1026 | *Glycine max* | DNA | G196 | 105 |
| 1027 | *Oryza sativa* | PRT | G196 | 105 |
| 1028 | *Oryza sativa* | PRT | G196 | 105 |
| 1029 | *Oryza sativa* | PRT | G196 | 105 |
| 1030 | *Zea mays* | DNA | G196 | 105 |
| 1031 | *Zea mays* | DNA | G196 | 105 |
| 1032 | *Glycine max* | DNA | G211 | 121 |
| 1033 | *Oryza sativa* | DNA | G211 | 121 |
| 1034 | *Oryza sativa* | PRT | G211 | 121 |
| 1035 | *Glycine max* | DNA | G214 | 127 |
|  | *Glycine max* | DNA | G680 | 463 |
| 1036 | *Glycine max* | DNA | G214 | 127 |
|  | *Glycine max* | DNA | G680 | 463 |
| 1037 | *Glycine max* | DNA | G214 | 127 |
|  | *Glycine max* | DNA | G680 | 463 |
| 1038 | *Glycine max* | DNA | G214 | 127 |
|  | *Glycine max* | DNA | G680 | 463 |
| 1039 | *Oryza sativa* | DNA | G214 | 127 |
|  | *Oryza sativa* | DNA | G680 | 463 |
| 1040 | *Oryza sativa* | DNA | G214 | 127 |
|  | *Oryza sativa* | DNA | G680 | 463 |
| 1041 | *Zea mays* | DNA | G214 | 127 |
|  | *Zea mays* | DNA | G680 | 463 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 1042 | Zea mays | DNA | G214 | 127 |
|  | Zea mays | DNA | G680 | 463 |
| 1043 | Zea mays | DNA | G214 | 127 |
|  | Zea mays | DNA | G680 | 463 |
| 1044 | Glycine max | DNA | G226 | 141 |
|  | Glycine max | DNA | G682 | 467 |
|  | Glycine max | DNA | G1816 | 939 |
|  | Glycine max | DNA | G2718 | 959 |
| 1045 | Glycine max | DNA | G226 | 141 |
|  | Glycine max | DNA | G1816 | 939 |
|  | Glycine max | DNA | G2718 | 959 |
| 1046 | Glycine max | DNA | G226 | 141 |
|  | Glycine max | DNA | G682 | 467 |
|  | Glycine max | DNA | G1816 | 939 |
|  | Glycine max | DNA | G2718 | 959 |
| 1047 | Glycine max | DNA | G226 | 141 |
|  | Glycine max | DNA | G682 | 467 |
|  | Glycine max | DNA | G1816 | 939 |
|  | Glycine max | DNA | G2718 | 959 |
| 1048 | Glycine max | DNA | G226 | 141 |
|  | Glycine max | DNA | G682 | 467 |
|  | Glycine max | DNA | G1816 | 939 |
|  | Glycine max | DNA | G2718 | 959 |
| 1049 | Oryza sativa | DNA | G226 | 141 |
|  | Oryza sativa | DNA | G682 | 467 |
|  | Oryza sativa | DNA | G1816 | 939 |
|  | Oryza sativa | DNA | G2718 | 959 |
| 1050 | Oryza sativa | PRT | G226 | 141 |
|  | Oryza sativa | PRT | G682 | 467 |
|  | Oryza sativa | PRT | G1816 | 939 |
|  | Oryza sativa | PRT | G2718 | 959 |
| 1051 | Oryza sativa | PRT | G226 | 141 |
|  | Oryza sativa | PRT | G682 | 467 |
|  | Oryza sativa | PRT | G1816 | 939 |
|  | Oryza sativa | PRT | G2718 | 959 |
| 1052 | Zea mays | DNA | G226 | 141 |
|  | Zea mays | DNA | G682 | 467 |
|  | Zea mays | DNA | G1816 | 939 |
|  | Zea mays | DNA | G2718 | 959 |
| 1053 | Zea mays | DNA | G226 | 141 |
|  | Zea mays | DNA | G682 | 467 |
|  | Zea mays | DNA | G1816 | 939 |
|  | Zea mays | DNA | G2718 | 959 |
| 1054 | Glycine max | DNA | G241 | 163 |
| 1055 | Glycine max | DNA | G241 | 163 |
| 1056 | Glycine max | DNA | G241 | 163 |
| 1057 | Oryza sativa | DNA | G241 | 163 |
| 1058 | Zea mays | DNA | G241 | 163 |
| 1059 | Zea mays | DNA | G241 | 163 |
| 1060 | Zea mays | DNA | G241 | 163 |
| 1061 | Zea mays | DNA | G241 | 163 |
| 1062 | Zea mays | DNA | G241 | 163 |
| 1063 | Glycine max | DNA | G254 | 179 |
| 1064 | Glycine max | DNA | G256 | 183 |
| 1065 | Glycine max | DNA | G256 | 183 |
| 1066 | Glycine max | DNA | G256 | 183 |
| 1067 | Glycine max | DNA | G256 | 183 |
| 1068 | Glycine max | DNA | G256 | 183 |
| 1069 | Glycine max | DNA | G256 | 183 |
| 1070 | Glycine max | DNA | G256 | 183 |
| 1071 | Oryza sativa | DNA | G256 | 183 |
| 1072 | Oryza sativa | PRT | G256 | 183 |
| 1073 | Oryza sativa | PRT | G256 | 183 |
| 1074 | Oryza sativa | PRT | G256 | 183 |
| 1075 | Oryza sativa | PRT | G256 | 183 |
| 1076 | Oryza sativa | PRT | G256 | 183 |
| 1077 | Zea mays | DNA | G256 | 183 |
| 1078 | Zea mays | DNA | G256 | 183 |
| 1079 | Zea mays | DNA | G256 | 183 |
| 1080 | Zea mays | DNA | G256 | 183 |
| 1081 | Zea mays | DNA | G256 | 183 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 1082 | Zea mays | DNA | G256 | 183 |
| 1083 | Glycine max | DNA | G325 | 223 |
| 1084 | Zea mays | DNA | G325 | 223 |
| 1085 | Glycine max | DNA | G361 | 237 |
| 1086 | Glycine max | DNA | G361 | 237 |
| 1087 | Glycine max | DNA | G361 | 237 |
| 1088 | Glycine max | DNA | G361 | 237 |
| 1089 | Glycine max | DNA | G361 | 237 |
| 1090 | Oryza sativa | DNA | G361 | 237 |
| 1091 | Oryza sativa | PRT | G361 | 237 |
| 1092 | Oryza sativa | PRT | G361 | 237 |
| 1093 | Oryza sativa | PRT | G361 | 237 |
| 1094 | Oryza sativa | PRT | G361 | 237 |
| 1095 | Oryza sativa | PRT | G361 | 237 |
| 1096 | Zea mays | DNA | G361 | 237 |
| 1097 | Zea mays | DNA | G361 | 237 |
| 1098 | Glycine max | DNA | G390 | 249 |
|  | Glycine max | DNA | G438 | 283 |
| 1099 | Glycine max | DNA | G390 | 249 |
|  | Glycine max | DNA | G438 | 283 |
| 1100 | Glycine max | DNA | G390 | 249 |
|  | Glycine max | DNA | G438 | 283 |
| 1101 | Glycine max | DNA | G390 | 249 |
|  | Glycine max | DNA | G438 | 283 |
| 1102 | Glycine max | DNA | G390 | 249 |
|  | Glycine max | DNA | G438 | 283 |
| 1103 | Glycine max | DNA | G390 | 249 |
|  | Glycine max | DNA | G438 | 283 |
| 1104 | Glycine max | DNA | G390 | 249 |
|  | Glycine max | DNA | G438 | 283 |
| 1105 | Glycine max | DNA | G390 | 249 |
| 1106 | Glycine max | DNA | G390 | 249 |
|  | Glycine max | DNA | G438 | 283 |
| 1107 | Glycine max | DNA | G390 | 249 |
|  | Glycine max | DNA | G438 | 283 |
| 1108 | Oryza sativa | DNA | G390 | 249 |
| 1109 | Oryza sativa | PRT | G390 | 249 |
|  | Oryza sativa | PRT | G438 | 283 |
| 1110 | Oryza sativa | PRT | G390 | 249 |
|  | Oryza sativa | PRT | G438 | 283 |
| 1111 | Oryza sativa | PRT | G390 | 249 |
|  | Oryza sativa | PRT | G438 | 283 |
| 1112 | Oryza sativa | PRT | G390 | 249 |
|  | Oryza sativa | PRT | G438 | 283 |
| 1113 | Oryza sativa | DNA | G390 | 249 |
|  | Oryza sativa | DNA | G438 | 283 |
| 1114 | Zea mays | DNA | G390 | 249 |
|  | Zea mays | DNA | G438 | 283 |
| 1115 | Zea mays | DNA | G390 | 249 |
|  | Zea mays | DNA | G438 | 283 |
| 1116 | Zea mays | DNA | G390 | 249 |
|  | Zea mays | DNA | G438 | 283 |
| 1117 | Zea mays | DNA | G390 | 249 |
| 1118 | Zea mays | DNA | G390 | 249 |
|  | Zea mays | DNA | G438 | 283 |
| 1119 | Zea mays | DNA | G390 | 249 |
|  | Zea mays | DNA | G438 | 283 |
| 1120 | Zea mays | DNA | G390 | 249 |
|  | Zea mays | DNA | G438 | 283 |
| 1121 | Zea mays | DNA | G390 | 249 |
|  | Zea mays | DNA | G438 | 283 |
| 1122 | Zea mays | DNA | G390 | 249 |
|  | Zea mays | DNA | G438 | 283 |
| 1123 | Zea mays | DNA | G390 | 249 |
|  | Zea mays | DNA | G438 | 283 |
| 1124 | Glycine max | DNA | G409 | 261 |
| 1125 | Glycine max | DNA | G409 | 261 |
| 1126 | Glycine max | DNA | G409 | 261 |
| 1127 | Glycine max | DNA | G409 | 261 |
| 1128 | Glycine max | DNA | G409 | 261 |
| 1129 | Glycine max | DNA | G409 | 261 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 1130 | *Glycine max* | DNA | G409 | 261 |
| 1131 | *Glycine max* | DNA | G409 | 261 |
| 1132 | *Oryza sativa* | DNA | G409 | 261 |
| 1133 | *Oryza sativa* | DNA | G409 | 261 |
| 1134 | *Oryza sativa* | DNA | G409 | 261 |
| 1135 | *Zea mays* | DNA | G409 | 261 |
| 1136 | *Zea mays* | DNA | G409 | 261 |
| 1137 | *Zea mays* | DNA | G409 | 261 |
| 1138 | *Zea mays* | DNA | G409 | 261 |
| 1139 | *Zea mays* | DNA | G409 | 261 |
| 1140 | *Zea mays* | DNA | G409 | 261 |
| 1141 | *Zea mays* | DNA | G409 | 261 |
| 1142 | *Glycine max* | DNA | G438 | 283 |
| 1143 | *Oryza sativa* | DNA | G438 | 283 |
| 1144 | *Oryza sativa* | DNA | G438 | 283 |
| 1145 | *Oryza sativa* | DNA | G438 | 283 |
| 1146 | *Oryza sativa* | DNA | G438 | 283 |
| 1147 | *Oryza sativa* | DNA | G438 | 283 |
| 1148 | *Zea mays* | DNA | G438 | 283 |
| 1149 | *Oryza sativa* | DNA | G464 | 291 |
| 1150 | *Oryza sativa* | PRT | G464 | 291 |
| 1151 | *Zea mays* | DNA | G464 | 291 |
| 1152 | *Glycine max* | DNA | G470 | 295 |
| 1153 | *Oryza sativa* | DNA | G470 | 295 |
| 1154 | *Oryza sativa* | DNA | G470 | 295 |
| 1155 | *Glycine max* | DNA | G475 | 301 |
| 1156 | *Glycine max* | DNA | G482 | 305 |
| 1157 | *Glycine max* | DNA | G482 | 305 |
| 1158 | *Glycine max* | DNA | G482 | 305 |
| 1159 | *Glycine max* | DNA | G482 | 305 |
| 1160 | *Glycine max* | DNA | G482 | 305 |
| 1161 | *Glycine max* | DNA | G482 | 305 |
| 1162 | *Glycine max* | DNA | G482 | 305 |
| 1163 | *Glycine max* | DNA | G482 | 305 |
| 1164 | *Glycine max* | DNA | G482 | 305 |
| 1165 | *Oryza sativa* | PRT | G482 | 305 |
| 1166 | *Oryza sativa* | PRT | G482 | 305 |
| 1167 | *Oryza sativa* | PRT | G482 | 305 |
| 1168 | *Oryza sativa* | PRT | G482 | 305 |
| 1169 | *Oryza sativa* | PRT | G482 | 305 |
| 1170 | *Oryza sativa* | DNA | G482 | 305 |
| 1171 | *Zea mays* | DNA | G482 | 305 |
| 1172 | *Zea mays* | DNA | G482 | 305 |
| 1173 | *Zea mays* | DNA | G482 | 305 |
| 1174 | *Zea mays* | DNA | G482 | 305 |
| 1175 | *Zea mays* | DNA | G482 | 305 |
| 1176 | *Zea mays* | DNA | G482 | 305 |
| 1177 | *Zea mays* | DNA | G482 | 305 |
| 1178 | *Zea mays* | DNA | G482 | 305 |
| 1179 | *Zea mays* | DNA | G482 | 305 |
| 1180 | *Glycine max* | DNA | G489 | 309 |
| 1181 | *Glycine max* | DNA | G489 | 309 |
| 1182 | *Glycine max* | DNA | G489 | 309 |
| 1183 | *Glycine max* | DNA | G489 | 309 |
| 1184 | *Glycine max* | DNA | G489 | 309 |
| 1185 | *Glycine max* | DNA | G489 | 309 |
| 1186 | *Glycine max* | DNA | G489 | 309 |
| 1187 | *Oryza sativa* | DNA | G489 | 309 |
| 1188 | *Oryza sativa* | DNA | G489 | 309 |
| 1189 | *Oryza sativa* | PRT | G489 | 309 |
| 1190 | *Oryza sativa* | PRT | G489 | 309 |
| 1191 | *Oryza sativa* | PRT | G489 | 309 |
| 1192 | *Zea mays* | DNA | G489 | 309 |
| 1193 | *Glycine max* | DNA | G509 | 317 |
| 1194 | *Glycine max* | DNA | G509 | 317 |
| 1195 | *Glycine max* | DNA | G509 | 317 |
| 1196 | *Oryza sativa* | DNA | G509 | 317 |
| 1197 | *Oryza sativa* | PRT | G509 | 317 |
| 1198 | *Oryza sativa* | PRT | G509 | 317 |
| 1199 | *Oryza sativa* | PRT | G509 | 317 |
| 1200 | *Oryza sativa* | DNA | G509 | 317 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 1201 | Zea mays | DNA | G509 | 317 |
| 1202 | Zea mays | DNA | G509 | 317 |
| 1203 | Zea mays | DNA | G509 | 317 |
| 1204 | Zea mays | DNA | G509 | 317 |
| 1205 | Glycine max | DNA | G545 | 345 |
| 1206 | Glycine max | DNA | G545 | 345 |
| 1207 | Glycine max | DNA | G545 | 345 |
| 1208 | Glycine max | DNA | G545 | 345 |
| 1209 | Glycine max | DNA | G545 | 345 |
| 1210 | Glycine max | DNA | G545 | 345 |
| 1211 | Glycine max | DNA | G545 | 345 |
| 1212 | Oryza sativa | DNA | G545 | 345 |
| 1213 | Oryza sativa | PRT | G545 | 345 |
| 1214 | Oryza sativa | PRT | G545 | 345 |
| 1215 | Oryza sativa | PRT | G545 | 345 |
| 1216 | Oryza sativa | PRT | G545 | 345 |
| 1217 | Zea mays | DNA | G545 | 345 |
| 1218 | Zea mays | DNA | G545 | 345 |
| 1219 | Zea mays | DNA | G545 | 345 |
| 1220 | Zea mays | DNA | G561 | 359 |
| 1221 | Glycine max | DNA | G562 | 361 |
| 1222 | Glycine max | DNA | G562 | 361 |
| 1223 | Glycine max | DNA | G562 | 361 |
| 1224 | Glycine max | DNA | G562 | 361 |
| 1225 | Glycine max | DNA | G562 | 361 |
| 1226 | Oryza sativa | PRT | G562 | 361 |
| 1227 | Oryza sativa | PRT | G562 | 361 |
| 1228 | Zea mays | DNA | G562 | 361 |
| 1229 | Zea mays | DNA | G562 | 361 |
| 1230 | Zea mays | DNA | G562 | 361 |
| 1231 | Glycine max | DNA | G567 | 369 |
| 1232 | Oryza sativa | DNA | G567 | 369 |
| 1233 | Oryza sativa | PRT | G567 | 369 |
| 1234 | Glycine max | DNA | G584 | 385 |
| 1235 | Glycine max | DNA | G584 | 385 |
| 1236 | Glycine max | DNA | G584 | 385 |
| 1237 | Glycine max | DNA | G584 | 385 |
| 1238 | Glycine max | DNA | G584 | 385 |
| 1239 | Oryza sativa | PRT | G584 | 385 |
| 1240 | Zea mays | DNA | G584 | 385 |
| 1241 | Zea mays | DNA | G584 | 385 |
| 1242 | Zea mays | DNA | G584 | 385 |
| 1243 | Glycine max | DNA | G590 | 387 |
| 1244 | Glycine max | DNA | G590 | 387 |
| 1245 | Glycine max | DNA | G590 | 387 |
| 1246 | Oryza sativa | PRT | G590 | 387 |
| 1247 | Oryza sativa | PRT | G590 | 387 |
| 1248 | Oryza sativa | DNA | G590 | 387 |
| 1249 | Zea mays | DNA | G590 | 387 |
| 1250 | Glycine max | DNA | G592 | 391 |
| 1251 | Glycine max | DNA | G592 | 391 |
| 1252 | Glycine max | DNA | G592 | 391 |
| 1253 | Glycine max | DNA | G592 | 391 |
| 1254 | Glycine max | DNA | G592 | 391 |
| 1255 | Oryza sativa | DNA | G592 | 391 |
| 1256 | Oryza sativa | DNA | G592 | 391 |
| 1257 | Oryza sativa | DNA | G592 | 391 |
| 1258 | Oryza sativa | PRT | G592 | 391 |
| 1259 | Oryza sativa | PRT | G592 | 391 |
| 1260 | Oryza sativa | DNA | G592 | 391 |
| 1261 | Zea mays | DNA | G592 | 391 |
| 1262 | Zea mays | DNA | G592 | 391 |
| 1263 | Zea mays | DNA | G592 | 391 |
| 1264 | Zea mays | DNA | G592 | 391 |
| 1265 | Glycine max | DNA | G627 | 405 |
| 1266 | Glycine max | DNA | G627 | 405 |
| 1267 | Oryza sativa | DNA | G627 | 405 |
| 1268 | Oryza sativa | DNA | G634 | 415 |
| 1269 | Oryza sativa | PRT | G634 | 415 |
| 1270 | Oryza sativa | DNA | G634 | 415 |
| 1271 | Oryza sativa | DNA | G634 | 415 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 1272 | Zea mays | DNA | G634 | 415 |
| 1273 | Zea mays | DNA | G634 | 415 |
| 1274 | Zea mays | DNA | G634 | 415 |
| 1275 | Glycine max | DNA | G636 | 417 |
| 1276 | Glycine max | DNA | G636 | 417 |
| 1277 | Glycine max | DNA | G636 | 417 |
| 1278 | Glycine max | DNA | G636 | 417 |
| 1279 | Glycine max | DNA | G636 | 417 |
| 1280 | Glycine max | DNA | G636 | 417 |
| 1281 | Glycine max | DNA | G636 | 417 |
| 1282 | Glycine max | DNA | G636 | 417 |
| 1283 | Oryza sativa | DNA | G636 | 417 |
| 1284 | Oryza sativa | DNA | G636 | 417 |
| 1285 | Oryza sativa | DNA | G636 | 417 |
| 1286 | Oryza sativa | DNA | G636 | 417 |
| 1287 | Zea mays | DNA | G636 | 417 |
| 1288 | Zea mays | DNA | G636 | 417 |
| 1289 | Zea mays | DNA | G636 | 417 |
| 1290 | Zea mays | DNA | G636 | 417 |
| 1291 | Glycine max | DNA | G638 | 419 |
| 1292 | Glycine max | DNA | G638 | 419 |
| 1293 | Glycine max | DNA | G638 | 419 |
| 1294 | Glycine max | DNA | G638 | 419 |
| 1295 | Glycine max | DNA | G663 | 435 |
| 1296 | Glycine max | DNA | G664 | 437 |
| 1297 | Glycine max | DNA | G664 | 437 |
| 1298 | Glycine max | DNA | G664 | 437 |
| 1299 | Glycine max | DNA | G664 | 437 |
| 1300 | Glycine max | DNA | G664 | 437 |
| 1301 | Glycine max | DNA | G664 | 437 |
| 1302 | Glycine max | DNA | G664 | 437 |
| 1303 | Oryza sativa | DNA | G664 | 437 |
| 1304 | Oryza sativa | DNA | G664 | 437 |
| 1305 | Oryza sativa | DNA | G664 | 437 |
| 1306 | Oryza sativa | DNA | G664 | 437 |
| 1307 | Oryza sativa | PRT | G664 | 437 |
| 1308 | Oryza sativa | PRT | G664 | 437 |
| 1309 | Oryza sativa | PRT | G664 | 437 |
| 1310 | Oryza sativa | PRT | G664 | 437 |
| 1311 | Zea mays | DNA | G664 | 437 |
| 1312 | Zea mays | DNA | G664 | 437 |
| 1313 | Zea mays | DNA | G664 | 437 |
| 1314 | Zea mays | DNA | G664 | 437 |
| 1315 | Zea mays | DNA | G664 | 437 |
| 1316 | Zea mays | DNA | G664 | 437 |
| 1317 | Zea mays | DNA | G664 | 437 |
| 1318 | Zea mays | DNA | G664 | 437 |
| 1319 | Oryza sativa | DNA | G680 | 463 |
| 1320 | Zea mays | DNA | G680 | 463 |
| 1321 | Glycine max | DNA | G736 | 487 |
| 1322 | Glycine max | DNA | G736 | 487 |
| 1323 | Oryza sativa | PRT | G736 | 487 |
| 1324 | Glycine max | DNA | G748 | 497 |
| 1325 | Glycine max | DNA | G748 | 497 |
| 1326 | Glycine max | DNA | G748 | 497 |
| 1327 | Oryza sativa | DNA | G748 | 497 |
| 1328 | Oryza sativa | DNA | G748 | 497 |
| 1329 | Oryza sativa | PRT | G748 | 497 |
| 1330 | Oryza sativa | PRT | G748 | 497 |
| 1331 | Oryza sativa | PRT | G748 | 497 |
| 1332 | Oryza sativa | PRT | G748 | 497 |
| 1333 | Zea mays | DNA | G748 | 497 |
| 1334 | Glycine max | DNA | G789 | 539 |
| 1335 | Glycine max | DNA | G789 | 539 |
| 1336 | Oryza sativa | DNA | G789 | 539 |
| 1337 | Oryza sativa | DNA | G789 | 539 |
| 1338 | Oryza sativa | PRT | G789 | 539 |
| 1339 | Oryza sativa | PRT | G789 | 539 |
| 1340 | Oryza sativa | PRT | G789 | 539 |
| 1341 | Zea mays | DNA | G789 | 539 |
| 1342 | Glycine max | DNA | G801 | 549 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 1343 | *Glycine max* | DNA | G801 | 549 |
| 1344 | *Zea mays* | DNA | G801 | 549 |
| 1345 | *Glycine max* | DNA | G849 | 565 |
| 1346 | *Glycine max* | DNA | G849 | 565 |
| 1347 | *Glycine max* | DNA | G849 | 565 |
| 1348 | *Glycine max* | DNA | G849 | 565 |
| 1349 | *Glycine max* | DNA | G849 | 565 |
| 1350 | *Glycine max* | DNA | G849 | 565 |
| 1351 | *Zea mays* | DNA | G849 | 565 |
| 1352 | *Zea mays* | DNA | G849 | 565 |
| 1353 | *Zea mays* | DNA | G849 | 565 |
| 1354 | *Glycine max* | DNA | G864 | 573 |
| 1355 | *Glycine max* | DNA | G864 | 573 |
| 1356 | *Glycine max* | DNA | G864 | 573 |
| 1357 | *Glycine max* | DNA | G864 | 573 |
| 1358 | *Glycine max* | DNA | G864 | 573 |
| 1359 | *Glycine max* | DNA | G864 | 573 |
| 1360 | *Oryza sativa* | DNA | G864 | 573 |
| 1361 | *Oryza sativa* | PRT | G864 | 573 |
| 1362 | *Oryza sativa* | PRT | G864 | 573 |
| 1363 | *Zea mays* | DNA | G864 | 573 |
| 1364 | *Zea mays* | DNA | G864 | 573 |
| 1365 | *Zea mays* | DNA | G864 | 573 |
| 1366 | *Glycine max* | DNA | G867 | 579 |
| 1367 | *Glycine max* | DNA | G867 | 579 |
| 1368 | *Glycine max* | DNA | G867 | 579 |
| 1369 | *Glycine max* | DNA | G867 | 579 |
| 1370 | *Glycine max* | DNA | G867 | 579 |
| 1371 | *Glycine max* | DNA | G867 | 579 |
| 1372 | *Oryza sativa* | DNA | G867 | 579 |
| 1373 | *Oryza sativa* | PRT | G867 | 579 |
| 1374 | *Oryza sativa* | PRT | G867 | 579 |
| 1375 | *Oryza sativa* | PRT | G867 | 579 |
| 1376 | *Oryza sativa* | DNA | G867 | 579 |
| 1377 | *Zea mays* | DNA | G867 | 579 |
| 1378 | *Zea mays* | DNA | G867 | 579 |
| 1379 | *Zea mays* | DNA | G867 | 579 |
| 1380 | *Zea mays* | DNA | G867 | 579 |
| 1381 | *Glycine max* | DNA | G869 | 581 |
| 1382 | *Glycine max* | DNA | G869 | 581 |
| 1383 | *Oryza sativa* | DNA | G869 | 581 |
| 1384 | *Oryza sativa* | PRT | G869 | 581 |
| 1385 | *Zea mays* | DNA | G869 | 581 |
| 1386 | *Glycine max* | DNA | G877 | 583 |
| 1387 | *Oryza sativa* | DNA | G877 | 583 |
| 1388 | *Oryza sativa* | DNA | G877 | 583 |
| 1389 | *Oryza sativa* | PRT | G877 | 583 |
| 1390 | *Oryza sativa* | PRT | G877 | 583 |
| 1391 | *Oryza sativa* | PRT | G877 | 583 |
| 1392 | *Zea mays* | DNA | G877 | 583 |
| 1393 | *Zea mays* | DNA | G877 | 583 |
| 1394 | *Zea mays* | DNA | G877 | 583 |
| 1395 | *Glycine max* | DNA | G881 | 587 |
| 1396 | *Oryza sativa* | PRT | G881 | 587 |
| 1397 | *Oryza sativa* | DNA | G881 | 587 |
| 1398 | *Oryza sativa* | DNA | G881 | 587 |
| 1399 | *Zea mays* | DNA | G881 | 587 |
| 1400 | *Zea mays* | DNA | G881 | 587 |
| 1401 | *Zea mays* | DNA | G881 | 587 |
| 1402 | *Zea mays* | DNA | G881 | 587 |
| 1403 | *Glycine max* | DNA | G912 | 615 |
| 1404 | *Glycine max* | DNA | G912 | 615 |
| 1405 | *Glycine max* | DNA | G912 | 615 |
| 1406 | *Glycine max* | DNA | G912 | 615 |
| 1407 | *Glycine max* | DNA | G912 | 615 |
| 1408 | *Glycine max* | DNA | G912 | 615 |
| 1409 | *Glycine max* | DNA | G912 | 615 |
| 1410 | *Oryza sativa* | DNA | G912 | 615 |
| 1411 | *Oryza sativa* | PRT | G912 | 615 |
| 1412 | *Oryza sativa* | PRT | G912 | 615 |
| 1413 | *Oryza sativa* | PRT | G912 | 615 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 1414 | *Oryza sativa* | PRT | G912 | 615 |
| 1415 | *Oryza sativa* | DNA | G912 | 615 |
| 1416 | *Zea mays* | DNA | G912 | 615 |
| 1417 | *Zea mays* | DNA | G912 | 615 |
| 1418 | *Zea mays* | DNA | G912 | 615 |
| 1419 | *Zea mays* | DNA | G912 | 615 |
| 1420 | *Zea mays* | DNA | G912 | 615 |
| 1421 | *Glycine max* | DNA | G961 | 633 |
| 1422 | *Glycine max* | DNA | G961 | 633 |
| 1423 | *Oryza sativa* | DNA | G961 | 633 |
| 1424 | *Oryza sativa* | PRT | G961 | 633 |
| 1425 | *Zea mays* | DNA | G961 | 633 |
| 1426 | *Zea mays* | DNA | G961 | 633 |
| 1427 | *Zea mays* | DNA | G961 | 633 |
| 1428 | *Glycine max* | DNA | G974 | 641 |
| 1429 | *Glycine max* | DNA | G974 | 641 |
| 1430 | *Glycine max* | DNA | G974 | 641 |
| 1431 | *Glycine max* | DNA | G974 | 641 |
| 1432 | *Glycine max* | DNA | G974 | 641 |
| 1433 | *Glycine max* | DNA | G974 | 641 |
| 1434 | *Oryza sativa* | DNA | G974 | 641 |
| 1435 | *Oryza sativa* | PRT | G974 | 641 |
| 1436 | *Oryza sativa* | PRT | G974 | 641 |
| 1437 | *Oryza sativa* | PRT | G974 | 641 |
| 1438 | *Zea mays* | DNA | G974 | 641 |
| 1439 | *Zea mays* | DNA | G974 | 641 |
| 1440 | *Zea mays* | DNA | G974 | 641 |
| 1441 | *Zea mays* | DNA | G974 | 641 |
| 1442 | *Glycine max* | DNA | G975 | 643 |
| 1443 | *Glycine max* | DNA | G975 | 643 |
| 1444 | *Glycine max* | DNA | G975 | 643 |
| 1445 | *Glycine max* | DNA | G975 | 643 |
| 1446 | *Glycine max* | DNA | G975 | 643 |
| 1447 | *Oryza sativa* | DNA | G975 | 643 |
| 1448 | *Oryza sativa* | PRT | G975 | 643 |
| 1449 | *Oryza sativa* | DNA | G975 | 643 |
| 1450 | *Zea mays* | DNA | G975 | 643 |
| 1451 | *Zea mays* | DNA | G975 | 643 |
| 1452 | *Glycine max* | DNA | G979 | 649 |
| 1453 | *Glycine max* | DNA | G979 | 649 |
| 1454 | *Glycine max* | DNA | G979 | 649 |
| 1455 | *Oryza sativa* | DNA | G979 | 649 |
| 1456 | *Oryza sativa* | PRT | G979 | 649 |
| 1457 | *Oryza sativa* | PRT | G979 | 649 |
| 1458 | *Oryza sativa* | PRT | G979 | 649 |
| 1459 | *Oryza sativa* | PRT | G979 | 649 |
| 1460 | *Oryza sativa* | PRT | G979 | 649 |
| 1461 | *Zea mays* | DNA | G979 | 649 |
| 1462 | *Zea mays* | DNA | G979 | 649 |
| 1463 | *Zea mays* | DNA | G979 | 649 |
| 1464 | *Glycine max* | DNA | G987 | 653 |
| 1465 | *Glycine max* | DNA | G987 | 653 |
| 1466 | *Glycine max* | DNA | G987 | 653 |
| 1467 | *Glycine max* | DNA | G987 | 653 |
| 1468 | *Glycine max* | DNA | G987 | 653 |
| 1469 | *Glycine max* | DNA | G987 | 653 |
| 1470 | *Oryza sativa* | DNA | G987 | 653 |
| 1471 | *Oryza sativa* | DNA | G987 | 653 |
| 1472 | *Oryza sativa* | PRT | G987 | 653 |
| 1473 | *Zea mays* | DNA | G987 | 653 |
| 1474 | *Glycine max* | DNA | G1052 | 699 |
| 1475 | *Glycine max* | DNA | G1052 | 699 |
| 1476 | *Glycine max* | DNA | G1052 | 699 |
| 1477 | *Glycine max* | DNA | G1052 | 699 |
| 1478 | *Glycine max* | DNA | G1052 | 699 |
| 1479 | *Glycine max* | DNA | G1052 | 699 |
| 1480 | *Glycine max* | DNA | G1052 | 699 |
| 1481 | *Oryza sativa* | DNA | G1052 | 699 |
| 1482 | *Oryza sativa* | DNA | G1052 | 699 |
| 1483 | *Oryza sativa* | PRT | G1052 | 699 |
| 1484 | *Oryza sativa* | PRT | G1052 | 699 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 1485 | *Zea mays* | DNA | G1052 | 699 |
| 1486 | *Zea mays* | DNA | G1052 | 699 |
| 1487 | *Zea mays* | DNA | G1052 | 699 |
| 1488 | *Zea mays* | DNA | G1052 | 699 |
| 1489 | *Zea mays* | DNA | G1052 | 699 |
| 1490 | *Zea mays* | DNA | G1052 | 699 |
| 1491 | *Zea mays* | DNA | G1052 | 699 |
| 1492 | *Zea mays* | DNA | G1052 | 699 |
| 1493 | *Zea mays* | DNA | G1052 | 699 |
| 1494 | *Glycine max* | DNA | G1062 | 713 |
| 1495 | *Glycine max* | DNA | G1062 | 713 |
| 1496 | *Glycine max* | DNA | G1062 | 713 |
| 1497 | *Glycine max* | DNA | G1062 | 713 |
| 1498 | *Oryza sativa* | DNA | G1062 | 713 |
| 1499 | *Oryza sativa* | DNA | G1062 | 713 |
| 1500 | *Oryza sativa* | PRT | G1062 | 713 |
| 1501 | *Zea mays* | DNA | G1062 | 713 |
| 1502 | *Zea mays* | DNA | G1062 | 713 |
| 1503 | *Zea mays* | DNA | G1062 | 713 |
| 1504 | *Zea mays* | DNA | G1062 | 713 |
| 1505 | *Zea mays* | DNA | G1062 | 713 |
| 1506 | *Glycine max* | DNA | G1069 | 721 |
| 1507 | *Glycine max* | DNA | G1069 | 721 |
| 1508 | *Oryza sativa* | PRT | G1069 | 721 |
| 1509 | *Zea mays* | DNA | G1069 | 721 |
| 1510 | *Oryza sativa* | PRT | G1073 | 723 |
| 1511 | *Oryza sativa* | PRT | G1073 | 723 |
| 1512 | *Glycine max* | DNA | G1075 | 725 |
| 1513 | *Glycine max* | DNA | G1075 | 725 |
| 1514 | *Glycine max* | DNA | G1075 | 725 |
| 1515 | *Glycine max* | DNA | G1075 | 725 |
| 1516 | *Glycine max* | DNA | G1075 | 725 |
| 1517 | *Oryza sativa* | DNA | G1075 | 725 |
| 1518 | *Oryza sativa* | DNA | G1075 | 725 |
| 1519 | *Oryza sativa* | DNA | G1075 | 725 |
| 1520 | *Oryza sativa* | PRT | G1089 | 731 |
| 1521 | *Oryza sativa* | DNA | G1089 | 731 |
| 1522 | *Zea mays* | DNA | G1089 | 731 |
| 1523 | *Zea mays* | DNA | G1089 | 731 |
| 1524 | *Zea mays* | DNA | G1089 | 731 |
| 1525 | *Zea mays* | DNA | G1089 | 731 |
| 1526 | *Zea mays* | DNA | G1089 | 731 |
| 1527 | *Glycine max* | DNA | G1134 | 741 |
| 1528 | *Glycine max* | DNA | G1134 | 741 |
| 1529 | *Oryza sativa* | DNA | G1134 | 741 |
| 1530 | *Glycine max* | DNA | G1145 | 749 |
| 1531 | *Glycine max* | DNA | G1145 | 749 |
| 1532 | *Glycine max* | DNA | G1145 | 749 |
| 1533 | *Glycine max* | DNA | G1145 | 749 |
| 1534 | *Glycine max* | DNA | G1145 | 749 |
| 1535 | *Glycine max* | DNA | G1145 | 749 |
| 1536 | *Glycine max* | DNA | G1145 | 749 |
| 1537 | *Glycine max* | DNA | G1145 | 749 |
| 1538 | *Oryza sativa* | PRT | G1145 | 749 |
| 1539 | *Oryza sativa* | PRT | G1145 | 749 |
| 1540 | *Oryza sativa* | PRT | G1145 | 749 |
| 1541 | *Oryza sativa* | PRT | G1145 | 749 |
| 1542 | *Oryza sativa* | PRT | G1145 | 749 |
| 1543 | *Oryza sativa* | PRT | G1145 | 749 |
| 1544 | *Oryza sativa* | DNA | G1145 | 749 |
| 1545 | *Zea mays* | DNA | G1145 | 749 |
| 1546 | *Zea mays* | DNA | G1145 | 749 |
| 1547 | *Zea mays* | DNA | G1145 | 749 |
| 1548 | *Zea mays* | DNA | G1145 | 749 |
| 1549 | *Zea mays* | DNA | G1145 | 749 |
| 1550 | *Glycine max* | DNA | G1198 | 763 |
| 1551 | *Glycine max* | DNA | G1198 | 763 |
| 1552 | *Glycine max* | DNA | G1198 | 763 |
| 1553 | *Glycine max* | DNA | G1198 | 763 |
| 1554 | *Glycine max* | DNA | G1198 | 763 |
| 1555 | *Glycine max* | DNA | G1198 | 763 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 1556 | *Glycine max* | DNA | G1198 | 763 |
| 1557 | *Glycine max* | DNA | G1198 | 763 |
| 1558 | *Oryza sativa* | DNA | G1198 | 763 |
| 1559 | *Oryza sativa* | DNA | G1198 | 763 |
| 1560 | *Oryza sativa* | DNA | G1198 | 763 |
| 1561 | *Oryza sativa* | DNA | G1198 | 763 |
| 1562 | *Oryza sativa* | DNA | G1198 | 763 |
| 1563 | *Oryza sativa* | PRT | G1198 | 763 |
| 1564 | *Oryza sativa* | PRT | G1198 | 763 |
| 1565 | *Oryza sativa* | PRT | G1198 | 763 |
| 1566 | *Oryza sativa* | PRT | G1198 | 763 |
| 1567 | *Oryza sativa* | PRT | G1198 | 763 |
| 1568 | *Oryza sativa* | PRT | G1198 | 763 |
| 1569 | *Oryza sativa* | PRT | G1198 | 763 |
| 1570 | *Zea mays* | DNA | G1198 | 763 |
| 1571 | *Zea mays* | DNA | G1198 | 763 |
| 1572 | *Zea mays* | DNA | G1198 | 763 |
| 1573 | *Zea mays* | DNA | G1198 | 763 |
| 1574 | *Zea mays* | DNA | G1198 | 763 |
| 1575 | *Zea mays* | DNA | G1198 | 763 |
| 1576 | *Zea mays* | DNA | G1198 | 763 |
| 1577 | *Zea mays* | DNA | G1198 | 763 |
| 1578 | *Zea mays* | DNA | G1198 | 763 |
| 1579 | *Zea mays* | DNA | G1198 | 763 |
| 1580 | *Glycine max* | DNA | G1242 | 787 |
| 1581 | *Oryza sativa* | DNA | G1242 | 787 |
| 1582 | *Oryza sativa* | PRT | G1242 | 787 |
| 1583 | *Oryza sativa* | PRT | G1242 | 787 |
| 1584 | *Zea mays* | DNA | G1242 | 787 |
| 1585 | *Zea mays* | DNA | G1242 | 787 |
| 1586 | *Glycine max* | DNA | G1255 | 793 |
| 1587 | *Glycine max* | DNA | G1255 | 793 |
| 1588 | *Glycine max* | DNA | G1255 | 793 |
| 1589 | *Glycine max* | DNA | G1255 | 793 |
| 1590 | *Glycine max* | DNA | G1255 | 793 |
| 1591 | *Glycine max* | DNA | G1255 | 793 |
| 1592 | *Glycine max* | DNA | G1255 | 793 |
| 1593 | *Oryza sativa* | DNA | G1255 | 793 |
| 1594 | *Oryza sativa* | PRT | G1255 | 793 |
| 1595 | *Oryza sativa* | DNA | G1255 | 793 |
| 1596 | *Oryza sativa* | DNA | G1255 | 793 |
| 1597 | *Oryza sativa* | DNA | G1255 | 793 |
| 1598 | *Zea mays* | DNA | G1255 | 793 |
| 1599 | *Zea mays* | DNA | G1255 | 793 |
| 1600 | *Zea mays* | DNA | G1255 | 793 |
| 1601 | *Zea mays* | DNA | G1255 | 793 |
| 1602 | *Zea mays* | DNA | G1255 | 793 |
| 1603 | *Zea mays* | DNA | G1255 | 793 |
| 1604 | *Glycine max* | DNA | G1266 | 799 |
| 1605 | *Glycine max* | DNA | G1266 | 799 |
| 1606 | *Glycine max* | DNA | G1266 | 799 |
| 1607 | *Glycine max* | DNA | G1266 | 799 |
| 1608 | *Oryza sativa* | DNA | G1266 | 799 |
| 1609 | *Glycine max* | DNA | G1274 | 805 |
| 1610 | *Glycine max* | DNA | G1274 | 805 |
| 1611 | *Oryza sativa* | PRT | G1274 | 805 |
| 1612 | *Oryza sativa* | PRT | G1274 | 805 |
| 1613 | *Zea mays* | DNA | G1274 | 805 |
| 1614 | *Zea mays* | DNA | G1274 | 805 |
| 1615 | *Zea mays* | DNA | G1274 | 805 |
| 1616 | *Zea mays* | DNA | G1274 | 805 |
| 1617 | *Oryza sativa* | DNA | G1275 | 807 |
| 1618 | *Oryza sativa* | PRT | G1275 | 807 |
| 1619 | *Oryza sativa* | PRT | G1275 | 807 |
| 1620 | *Oryza sativa* | PRT | G1275 | 807 |
| 1621 | *Zea mays* | DNA | G1275 | 807 |
| 1622 | *Zea mays* | DNA | G1275 | 807 |
| 1623 | *Zea mays* | DNA | G1275 | 807 |
| 1624 | *Glycine max* | DNA | G1313 | 829 |
| 1625 | *Oryza sativa* | DNA | G1313 | 829 |
| 1626 | *Oryza sativa* | PRT | G1313 | 829 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 1627 | *Oryza sativa* | PRT | G1313 | 829 |
| 1628 | *Zea mays* | DNA | G1313 | 829 |
| 1629 | *Zea mays* | DNA | G1313 | 829 |
| 1630 | *Zea mays* | DNA | G1313 | 829 |
| 1631 | *Glycine max* | DNA | G1322 | 841 |
| 1632 | *Glycine max* | DNA | G1322 | 841 |
| 1633 | *Glycine max* | DNA | G1322 | 841 |
| 1634 | *Oryza sativa* | DNA | G1322 | 841 |
| 1635 | *Oryza sativa* | PRT | G1322 | 841 |
| 1636 | *Oryza sativa* | PRT | G1322 | 841 |
| 1637 | *Zea mays* | DNA | G1323 | 843 |
| 1638 | *Zea mays* | DNA | G1323 | 843 |
| 1639 | *Glycine max* | DNA | G1417 | 881 |
| 1640 | *Oryza sativa* | PRT | G1417 | 881 |
| 1641 | *Oryza sativa* | PRT | G1417 | 881 |
| 1642 | *Glycine max* | DNA | G1449 | 891 |
| 1643 | *Glycine max* | DNA | G1449 | 891 |
| 1644 | *Oryza sativa* | DNA | G1449 | 891 |
| 1645 | *Oryza sativa* | DNA | G1449 | 891 |
| 1646 | *Zea mays* | DNA | G1449 | 891 |
| 1647 | *Zea mays* | DNA | G1449 | 891 |
| 1648 | *Zea mays* | DNA | G1449 | 891 |
| 1649 | *Zea mays* | DNA | G1449 | 891 |
| 1650 | *Glycine max* | DNA | G1451 | 893 |
| 1651 | *Glycine max* | DNA | G1451 | 893 |
| 1652 | *Oryza sativa* | DNA | G1451 | 893 |
| 1653 | *Oryza sativa* | DNA | G1451 | 893 |
| 1654 | *Oryza sativa* | DNA | G1451 | 893 |
| 1655 | *Oryza sativa* | PRT | G1451 | 893 |
| 1656 | *Oryza sativa* | PRT | G1451 | 893 |
| 1657 | *Oryza sativa* | PRT | G1451 | 893 |
| 1658 | *Oryza sativa* | PRT | G1451 | 893 |
| 1659 | *Zea mays* | DNA | G1451 | 893 |
| 1660 | *Zea mays* | DNA | G1451 | 893 |
| 1661 | *Zea mays* | DNA | G1451 | 893 |
| 1662 | *Zea mays* | DNA | G1451 | 893 |
| 1663 | *Glycine max* | DNA | G1482 | 905 |
| 1664 | *Glycine max* | DNA | G1482 | 905 |
| 1665 | *Glycine max* | DNA | G1482 | 905 |
| 1666 | *Glycine max* | DNA | G1482 | 905 |
| 1667 | *Glycine max* | DNA | G1482 | 905 |
| 1668 | *Oryza sativa* | DNA | G1482 | 905 |
| 1669 | *Oryza sativa* | DNA | G1482 | 905 |
| 1670 | *Oryza sativa* | DNA | G1482 | 905 |
| 1671 | *Oryza sativa* | DNA | G1482 | 905 |
| 1672 | *Oryza sativa* | PRT | G1482 | 905 |
| 1673 | *Oryza sativa* | PRT | G1482 | 905 |
| 1674 | *Zea mays* | DNA | G1482 | 905 |
| 1675 | *Zea mays* | DNA | G1482 | 905 |
| 1676 | *Zea mays* | DNA | G1482 | 905 |
| 1677 | *Zea mays* | DNA | G1482 | 905 |
| 1678 | *Zea mays* | DNA | G1482 | 905 |
| 1679 | *Zea mays* | DNA | G1482 | 905 |
| 1680 | *Oryza sativa* | PRT | G1499 | 913 |
| 1681 | *Glycine max* | DNA | G1540 | 919 |
| 1682 | *Oryza sativa* | PRT | G1540 | 919 |
| 1683 | *Glycine max* | DNA | G1560 | 925 |
| 1684 | *Glycine max* | DNA | G1560 | 925 |
| 1685 | *Oryza sativa* | DNA | G1560 | 925 |
| 1686 | *Oryza sativa* | PRT | G1560 | 925 |
| 1687 | *Oryza sativa* | PRT | G1560 | 925 |
| 1688 | *Oryza sativa* | PRT | G1560 | 925 |
| 1689 | *Oryza sativa* | PRT | G1560 | 925 |
| 1690 | *Zea mays* | DNA | G1560 | 925 |
| 1691 | *Zea mays* | DNA | G1560 | 925 |
| 1692 | *Zea mays* | DNA | G1560 | 925 |
| 1693 | *Zea mays* | DNA | G1560 | 925 |
| 1694 | *Zea mays* | DNA | G1560 | 925 |
| 1695 | *Zea mays* | DNA | G1560 | 925 |
| 1696 | *Oryza sativa* | PRT | G1645 | 929 |
| 1697 | *Zea mays* | DNA | G1645 | 929 |

TABLE 7-continued

Orthologs of Representative *Arabidopsis* Transcription Factor Genes

| SEQ ID NO: of Ortholog or Nucleotide Encoding Ortholog | Species from Which Ortholog is Derived | Sequence type used for determination (DNA or Protein) | GID NO of Orthologous Arabidopsis Transcription Factor | SEQ ID NO: of Nucleotide Encoding Orthologous *Arabidopsis* Transcription Factor |
|---|---|---|---|---|
| 1698 | *Zea mays* | DNA | G1645 | 929 |
| 1699 | *Zea mays* | DNA | G1645 | 929 |
| 1700 | *Glycine max* | DNA | G1760 | 937 |
| 1701 | *Glycine max* | DNA | G1760 | 937 |
| 1702 | *Oryza sativa* | PRT | G1760 | 937 |
| 1703 | *Oryza sativa* | PRT | G1760 | 937 |
| 1704 | *Zea mays* | DNA | G1760 | 937 |
| 1705 | *Zea mays* | DNA | G1760 | 937 |
| 1706 | *Zea mays* | DNA | G1760 | 937 |
| 1707 | *Oryza sativa* | DNA | G1816 | 939 |
| 1708 | *Glycine max* | DNA | G2010 | 951 |
|  | *Glycine max* | DNA | G2347 | 957 |
| 1709 | *Oryza sativa* | DNA | G2010 | 951 |
|  | *Oryza sativa* | DNA | G2347 | 957 |
| 1710 | *Zea mays* | DNA | G2010 | 951 |
| 1711 | *Zea mays* | DNA | G2010 | 951 |
|  | *Zea mays* | DNA | G2347 | 957 |
| 1970 | *Glycine max* | DNA | G859 | 567 |
|  | *Glycine max* | DNA | G1842 | 943 |
|  | *Glycine max* | DNA | G1843 | 945 |
|  | *Glycine max* | DNA | G1844 | 947 |
| 1971 | *Glycine max* | PRT | G859 | 568 |
|  | *Glycine max* | PRT | G1842 | 944 |
|  | *Glycine max* | PRT | G1843 | 946 |
|  | *Glycine max* | PRT | G1844 | 948 |
| 1972 | *Glycine max* | DNA | G859 | 567 |
|  | *Glycine max* | DNA | G1842 | 943 |
|  | *Glycine max* | DNA | G1843 | 945 |
|  | *Glycine max* | DNA | G1844 | 947 |
| 1973 | *Glycine max* | PRT | G859 | 568 |
|  | *Glycine max* | PRT | G1842 | 944 |
|  | *Glycine max* | PRT | G1843 | 946 |
|  | *Glycine max* | PRT | G1844 | 948 |

Table 8 lists a summary of homologous sequences identified using BLAST (tblastx program). The first column shows the polynucleotide sequence identifier (SEQ ID NO:), the second column shows the corresponding cDNA identifier (Gene ID or GID), the third column shows the orthologous or homologous polynucleotide GenBank Accession Number (Test Sequence ID), the fourth column shows the calculated probability value that the sequence identity is due to chance (Smallest Sum Probability), the fifth column shows the plant species from which the test sequence was isolated (Test Sequence Species), and the sixth column shows the orthologous or homologous test sequence GenBank annotation (Test Sequence GenBank Annotation).

Table 9 listed sequences discover to be paralogous to a number of transcription factors of the present invention. The column headings include, from left to right, the *Arabidopsis* SEQ ID NO; corresponding *Arabidopsis* Gene ID (GID) numbers; the GID numbers of the paralogs discovered in a database search; and the SEQ ID NOs of the paralogs.

TABLE 9

*Arabidopsis* Transcription Factors and Paralogs

| SEQ ID NO: | GID NO. | Paralog SEQ ID NO: | Paralog GID No. |
|---|---|---|---|
| 30 | G24 | 1717 | G12 |
|  |  | 810 | G1277 |
|  |  | 1859 | G1379 |
| 38 | G28 | 670 | G1006 |
| 54 | G46 | 666 | G1004 |
|  |  | 1863 | G1419 |
|  |  | 1719 | G29 |
|  |  | 50 | G43 |
| 70 | G157 | 1875 | G1759 |
|  |  | 944 | G1842 |
|  |  | 946 | G1843 |
|  |  | 948 | G1844 |
|  |  | 568 | G859 |
| 106 | G196 | 1739 | G182 |
| 128 | G214 | 464 | G680 |
| 142 | G226 | 940 | G1816 |

TABLE 9-continued

*Arabidopsis* Transcription Factors and Paralogs

| SEQ ID NO: | GID NO. | Paralog SEQ ID NO: | Paralog GID No. |
|---|---|---|---|
|  |  | 140 | G225 |
|  |  | 960 | G2718 |
|  |  | 468 | G682 |
| 164 | G241 | 156 | G233 |
| 172 | G248 | 1877 | G1785 |
| 180 | G254 | 146 | G228 |
| 184 | G256 | 1803 | G666 |
|  |  | 444 | G668 |
|  |  | 628 | G932 |
| 210 | G291 | 766 | G1211 |
| 224 | G325 | 1897 | G1998 |
| 238 | G361 | 1895 | G1995 |
|  |  | 1935 | G2826 |
|  |  | 1937 | G2838 |
|  |  | 1767 | G362 |
|  |  | 1769 | G370 |
| 250 | G390 | 1869 | G1548 |
|  |  | 1773 | G391 |
|  |  | 1775 | G392 |
|  |  | 284 | G438 |
| 284 | G438 | 1869 | G1548 |
|  |  | 250 | G390 |
|  |  | 1773 | G391 |
|  |  | 1775 | G392 |
| 292 | G464 | 1781 | G463 |
| 306 | G482 | 1857 | G1364 |
|  |  | 1911 | G2345 |
|  |  | 1783 | G481 |
|  |  | 1785 | G485 |
| 310 | G489 | 1811 | G714 |
| 346 | G545 | 1763 | G350 |
|  |  | 1765 | G351 |
| 386 | G584 | 746 | G1136 |
| 406 | G627 | 1729 | G149 |
| 436 | G663 | 1853 | G1329 |
|  |  | 1915 | G2421 |
|  |  | 1917 | G2422 |
| 438 | G664 | 108 | G197 |
|  |  | 182 | G255 |
| 458 | G676 | 124 | G212 |
|  |  | 170 | G247 |
| 464 | G680 |  | G214 |
| 468 | G682 | 940 | G1816 |
|  |  | 140 | G225 |
|  |  | 142 | G226 |
|  |  | 960 | G2718 |
| 488 | G736 | 1921 | G2432 |
| 540 | G789 | 1867 | G1494 |
| 566 | G849 | 398 | G610 |
| 568 | G859 | 70 | G157 |
|  |  | 1875 | G1759 |
|  |  | 944 | G1842 |
|  |  | 946 | G1843 |
|  |  | 948 | G1844 |
| 574 | G864 | 1873 | G1750 |
|  |  | 1779 | G440 |
| 580 | G867 | 1893 | G1930 |
|  |  | 14 | G9 |
|  |  | 1829 | G993 |
| 584 | G877 | 1737 | G175 |
| 588 | G881 | 652 | G986 |
| 596 | G896 | 1855 | G1349 |
|  |  | 1889 | G1887 |
| 616 | G912 | 1903 | G2107 |
|  |  | 1923 | G2513 |
|  |  | 44 | G40 |
|  |  | 46 | G41 |
|  |  | 48 | G42 |
| 634 | G961 | 1925 | G2535 |
|  |  | 1823 | G957 |
| 640 | G971 | 1819 | G914 |

TABLE 9-continued

*Arabidopsis* Transcription Factors and Paralogs

| SEQ ID NO: | GID NO. | Paralog SEQ ID NO: | Paralog GID No. |
|---|---|---|---|
| 642 | G974 | 6 | G5 |
| 644 | G975 | 1861 | G1387 |
|  |  | 1929 | G2583 |
| 650 | G979 | 1901 | G2106 |
|  |  | 1905 | G2131 |
| 654 | G987 | 1933 | G3010 |
| 700 | G996 | 1835 | G1051 |
| 714 | G1062 | 934 | G1664 |
| 722 | G1069 | 1907 | G2153 |
| 724 | G1073 | 718 | G1067 |
|  |  | 1909 | G2156 |
| 726 | G1075 | 728 | G1076 |
| 742 | G1134 | 1927 | G2555 |
| 750 | G1145 | 706 | G1056 |
| 764 | G1198 | 1879 | G1806 |
|  |  | 352 | G554 |
|  |  | 354 | G555 |
|  |  | 1791 | G556 |
|  |  | 356 | G558 |
| 788 | G1242 | 790 | G1243 |
| 794 | G1255 | 1865 | G1484 |
| 830 | G1313 | 848 | G1325 |
| 842 | G1322 | 1747 | G221 |
|  |  | 174 | G249 |
| 844 | G1323 | 432 | G659 |
| 894 | G1451 | 1827 | G990 |
| 906 | G1482 | 1891 | G1888 |
| 928 | G1634 | 1932 | G2701 |
| 930 | G1645 | 1919 | G2424 |
| 938 | G1760 | 64 | G152 |
|  |  | 66 | G153 |
|  |  | 570 | G860 |
| 940 | G1816 | 140 | G225 |
|  |  | 142 | G226 |
|  |  | 960 | G2718 |
|  |  | 468 | G682 |
| 944 | G1842 | 70 | G157 |
|  |  | 1875 | G1759 |
|  |  | 946 | G1843 |
|  |  | 948 | G1844 |
|  |  | 568 | G859 |
| 946 | G1843 | 70 | G157 |
|  |  | 1875 | G1759 |
|  |  | 944 | G1842 |
|  |  | 948 | G1844 |
|  |  | 568 | G859 |
| 952 | G2010 | 958 | G2347 |
| 958 | G2347 | 952 | G2010 |
| 960 | G2718 | 940 | G1816 |
|  |  | 140 | G225 |
|  |  | 142 | G226 |
|  |  | 468 | G682 |

Table 10 lists the gene identification number (GID) and homologous relationships found using analyses according to Example IX for the sequences of the Sequence Listing.

TABLE 10

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 961 | | DNA | Glycine max | Predicted polypeptide sequence is orthologous to G8 |
| 962 | | DNA | Glycine max | Predicted polypeptide sequence is orthologous to G8 |
| 963 | | DNA | Glycine max | Predicted polypeptide sequence is orthologous to G8 |
| 964 | | DNA | Glycine max | Predicted polypeptide sequence is orthologous to G8 |
| 965 | | DNA | Oryza sativa | Predicted polypeptide sequence is orthologous to G8 |
| 967 | | DNA | Zea mays | Predicted polypeptide sequence is orthologous to G8 |
| 968 | | DNA | Zea mays | Predicted polypeptide sequence is orthologous to G8 |
| 969 | | DNA | Zea mays | Predicted polypeptide sequence is orthologous to G8 |
| 970 | | DNA | Glycine max | Predicted polypeptide sequence is orthologous to G19 |
| 971 | | DNA | Glycine max | Predicted polypeptide sequence is orthologous to G19 |
| 972 | | DNA | Glycine max | Predicted polypeptide sequence is orthologous to G19 |
| 973 | | DNA | Glycine max | Predicted polypeptide sequence is orthologous to G19 |
| 974 | | DNA | Oryza sativa | Predicted polypeptide sequence is orthologous to G19 |
| 975 | | DNA | Oryza sativa | Predicted polypeptide sequence is orthologous to G19 |
| 976 | | DNA | Oryza sativa | Predicted polypeptide sequence is orthologous to G19 |
| 977 | | DNA | Zea mays | Predicted polypeptide sequence is orthologous to G19 |
| 978 | | DNA | Zea mays | Predicted polypeptide sequence is orthologous to G19 |
| 979 | | DNA | Glycine max | Predicted polypeptide sequence is orthologous to G22 |
| 980 | | DNA | Glycine max | Predicted polypeptide sequence is orthologous to G22 |
| 981 | | DNA | Glycine max | Predicted polypeptide sequence is orthologous to G24 |
| 982 | | DNA | Glycine max | Predicted polypeptide sequence is orthologous to G24 |
| 983 | | DNA | Glycine max | Predicted polypeptide sequence is orthologous to G24 |
| 984 | | DNA | Glycine max | Predicted polypeptide sequence is orthologous to G24 |
| 985 | | DNA | Glycine max | Predicted polypeptide sequence is orthologous to G24 |
| 986 | | DNA | Glycine max | Predicted polypeptide sequence is orthologous to G24 |
| 987 | | DNA | Glycine max | Predicted polypeptide sequence is orthologous to G24 |
| 988 | | DNA | Oryza sativa | Predicted polypeptide sequence is orthologous to G24 |
| 989 | | PRT | Oryza sativa | Orthologous to G24 |
| 990 | | PRT | Oryza sativa | Orthologous to G24 |
| 991 | | PRT | Oryza sativa | Orthologous to G24 |
| 992 | | DNA | Zea mays | Predicted polypeptide sequence is orthologous to G24 |
| 993 | | DNA | Glycine max | Predicted polypeptide sequence is orthologous to G28 |
| 994 | | DNA | Glycine max | Predicted polypeptide sequence is orthologous to G28 |
| 995 | | DNA | Glycine max | Predicted polypeptide sequence is orthologous to G28 |
| 996 | | DNA | Glycine max | Predicted polypeptide sequence is orthologous to G28 |
| 997 | | DNA | Glycine max | Predicted polypeptide sequence is orthologous to G28 |
| 998 | | DNA | Glycine max | Predicted polypeptide sequence is orthologous to G28 |
| 999 | | DNA | Glycine max | Predicted polypeptide sequence is orthologous to G28 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1000 | | DNA | Glycine max | Predicted polypeptide sequence is orthologous to G28 |
| 1001 | | PRT | Oryza sativa | Orthologous to G28 |
| 1002 | | PRT | Oryza sativa | Orthologous to G28 |
| 1003 | | DNA | Zea mays | Predicted polypeptide sequence is orthologous to G28 |
| 1004 | | DNA | Glycine max | Predicted polypeptide sequence is orthologous to G46 |
| 1005 | | DNA | Glycine max | Predicted polypeptide sequence is orthologous to G46 |
| 1006 | | DNA | Glycine max | Predicted polypeptide sequence is orthologous to G46 |
| 1007 | | DNA | Glycine max | Predicted polypeptide sequence is orthologous to G46 |
| 1008 | | DNA | Glycine max | Predicted polypeptide sequence is orthologous to G46 |
| 1009 | | DNA | Glycine max | Predicted polypeptide sequence is orthologous to G46 |
| 1010 | | DNA | Glycine max | Predicted polypeptide sequence is orthologous to G46 |
| 1011 | | DNA | Glycine max | Predicted polypeptide sequence is orthologous to G46 |
| 1012 | | PRT | Oryza sativa | Orthologous to G46 |
| 1013 | | DNA | Zea mays | Predicted polypeptide sequence is orthologous to G46 |
| 1014 | | DNA | Glycine max | Predicted polypeptide sequence is orthologous to G157, G859, G1842, G1843 |
| 1015 | | DNA | Glycine max | Predicted polypeptide sequence is orthologous to G180 |
| 1016 | | DNA | Glycine max | Predicted polypeptide sequence is orthologous to G180 |
| 1017 | | DNA | Oryza sativa | Predicted polypeptide sequence is orthologous to G180 |
| 1018 | | PRT | Oryza sativa | Orthologous to G180 |
| 1019 | | DNA | Zea mays | Predicted polypeptide sequence is orthologous to G180 |
| 1020 | | DNA | Glycine max | Predicted polypeptide sequence is orthologous to G188 |
| 1021 | | PRT | Oryza sativa | Orthologous to G188 |
| 1022 | | PRT | Oryza sativa | Orthologous to G188 |
| 1023 | | DNA | Zea mays | Predicted polypeptide sequence is orthologous to G188 |
| 1024 | | DNA | Glycine max | Predicted polypeptide sequence is orthologous to G192 |
| 1025 | | PRT | Oryza sativa | Orthologous to G192 |
| 1026 | | DNA | Glycine max | Predicted polypeptide sequence is orthologous to G196 |
| 1027 | | PRT | Oryza sativa | Orthologous to G196 |
| 1028 | | PRT | Oryza sativa | Orthologous to G196 |
| 1029 | | PRT | Oryza sativa | Orthologous to G196 |
| 1030 | | DNA | Zea mays | Predicted polypeptide sequence is orthologous to G196 |
| 1031 | | DNA | Zea mays | Predicted polypeptide sequence is orthologous to G196 |
| 1032 | | DNA | Glycine max | Predicted polypeptide sequence is orthologous to G211 |
| 1033 | | DNA | Oryza sativa | Predicted polypeptide sequence is orthologous to G211 |
| 1034 | | PRT | Oryza sativa | Orthologous to G211 |
| 1035 | | DNA | Glycine max | Predicted polypeptide sequence is orthologous to G214, G680 |
| 1036 | | DNA | Glycine max | Predicted polypeptide sequence is orthologous to G214, G680 |
| 1037 | | DNA | Glycine max | Predicted polypeptide sequence is orthologous to G214, G680 |
| 1038 | | DNA | Glycine max | Predicted polypeptide sequence is orthologous to G214, G680 |
| 1039 | | DNA | Oryza sativa | Predicted polypeptide sequence is orthologous to G214, G680 |
| 1040 | | DNA | Oryza sativa | Predicted polypeptide sequence is orthologous to G214, G680 |
| 1041 | | DNA | Zea mays | Predicted polypeptide sequence is orthologous to G214, G680 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1042 | | DNA | Zea mays | Predicted polypeptide sequence is orthologous to G214, G680 |
| 1043 | | DNA | Zea mays | Predicted polypeptide sequence is orthologous to G214, G680 |
| 1044 | | DNA | Glycine max | Predicted polypeptide sequence is orthologous to G226, G682, G1816, G2718 |
| 1045 | | DNA | Glycine max | Predicted polypeptide sequence is orthologous to G226, G1816, G2718 |
| 1046 | | DNA | Glycine max | Predicted polypeptide sequence is orthologous to G226, G682, G1816, G2718 |
| 1047 | | DNA | Glycine max | Predicted polypeptide sequence is orthologous to G226, G682, G1816, G2718 |
| 1048 | | DNA | Glycine max | Predicted polypeptide sequence is orthologous to G226, G682, G1816, G2718 |
| 1049 | | DNA | Oryza sativa | Predicted polypeptide sequence is orthologous to G226, G682, G1816, G2718 |
| 1050 | | PRT | Oryza sativa | Orthologous to G226, G682, G1816, G2718 |
| 1051 | | PRT | Oryza sativa | Orthologous to G226, G682, G1816, G2718 |
| 1052 | | DNA | Zea mays | Predicted polypeptide sequence is orthologous to G226, G682, G1816, G2718 |
| 1053 | | DNA | Zea mays | Predicted polypeptide sequence is orthologous to G226, G682, G1816, G2718 |
| 1054 | | DNA | Glycine max | Predicted polypeptide sequence is orthologous to G241 |
| 1055 | | DNA | Glycine max | Predicted polypeptide sequence is orthologous to G241 |
| 1056 | | DNA | Glycine max | Predicted polypeptide sequence is orthologous to G241 |
| 1057 | | DNA | Oryza sativa | Predicted polypeptide sequence is orthologous to G241 |
| 1058 | | DNA | Zea mays | Predicted polypeptide sequence is orthologous to G241 |
| 1059 | | DNA | Zea mays | Predicted polypeptide sequence is orthologous to G241 |
| 1060 | | DNA | Zea mays | Predicted polypeptide sequence is orthologous to G241 |
| 1061 | | DNA | Zea mays | Predicted polypeptide sequence is orthologous to G241 |
| 1062 | | DNA | Zea mays | Predicted polypeptide sequence is orthologous to G241 |
| 1063 | | DNA | Glycine max | Predicted polypeptide sequence is orthologous to G254 |
| 1064 | | DNA | Glycine max | Predicted polypeptide sequence is orthologous to G256 |
| 1065 | | DNA | Glycine max | Predicted polypeptide sequence is orthologous to G256 |
| 1066 | | DNA | Glycine max | Predicted polypeptide sequence is orthologous to G256 |
| 1067 | | DNA | Glycine max | Predicted polypeptide sequence is orthologous to G256 |
| 1068 | | DNA | Glycine max | Predicted polypeptide sequence is orthologous to G256 |
| 1069 | | DNA | Glycine max | Predicted polypeptide sequence is orthologous to G256 |
| 1070 | | DNA | Glycine max | Predicted polypeptide sequence is orthologous to G256 |
| 1071 | | DNA | Oryza sativa | Predicted polypeptide sequence is orthologous to G256 |
| 1072 | | PRT | Oryza sativa | Orthologous to G256 |
| 1073 | | PRT | Oryza sativa | Orthologous to G256 |
| 1074 | | PRT | Oryza sativa | Orthologous to G256 |
| 1075 | | PRT | Oryza sativa | Orthologous to G256 |
| 1076 | | PRT | Oryza sativa | Orthologous to G256 |
| 1077 | | DNA | Zea mays | Predicted polypeptide sequence is orthologous to G256 |
| 1078 | | DNA | Zea mays | Predicted polypeptide sequence is orthologous to G256 |
| 1079 | | DNA | Zea mays | Predicted polypeptide sequence is orthologous to G256 |
| 1080 | | DNA | Zea mays | Predicted polypeptide sequence is orthologous to G256 |
| 1081 | | DNA | Zea mays | Predicted polypeptide sequence is orthologous to G256 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1082 | | DNA | Zea mays | Predicted polypeptide sequence is orthologous to G256 |
| 1083 | | DNA | Glycine max | Predicted polypeptide sequence is orthologous to G325 |
| 1084 | | DNA | Zea mays | Predicted polypeptide sequence is orthologous to G325 |
| 1085 | | DNA | Glycine max | Predicted polypeptide sequence is orthologous to G361 |
| 1086 | | DNA | Glycine max | Predicted polypeptide sequence is orthologous to G361 |
| 1087 | | DNA | Glycine max | Predicted polypeptide sequence is orthologous to G361 |
| 1088 | | DNA | Glycine max | Predicted polypeptide sequence is orthologous to G361 |
| 1089 | | DNA | Glycine max | Predicted polypeptide sequence is orthologous to G361 |
| 1090 | | DNA | Oryza sativa | Predicted polypeptide sequence is orthologous to G361 |
| 1091 | | PRT | Oryza sativa | Orthologous to G361 |
| 1092 | | PRT | Oryza sativa | Orthologous to G361 |
| 1093 | | PRT | Oryza sativa | Orthologous to G361 |
| 1094 | | PRT | Oryza sativa | Orthologous to G361 |
| 1095 | | PRT | Oryza sativa | Orthologous to G361 |
| 1096 | | DNA | Zea mays | Predicted polypeptide sequence is orthologous to G361 |
| 1097 | | DNA | Zea mays | Predicted polypeptide sequence is orthologous to G361 |
| 1098 | | DNA | Glycine max | Predicted polypeptide sequence is orthologous to G390, G438 |
| 1099 | | DNA | Glycine max | Predicted polypeptide sequence is orthologous to G390, G438 |
| 1100 | | DNA | Glycine max | Predicted polypeptide sequence is orthologous to G390, G438 |
| 1101 | | DNA | Glycine max | Predicted polypeptide sequence is orthologous to G390, G438 |
| 1102 | | DNA | Glycine max | Predicted polypeptide sequence is orthologous to G390, G438 |
| 1103 | | DNA | Glycine max | Predicted polypeptide sequence is orthologous to G390, G438 |
| 1104 | | DNA | Glycine max | Predicted polypeptide sequence is orthologous to G390, G438 |
| 1105 | | DNA | Glycine max | Predicted polypeptide sequence is orthologous to G390 |
| 1106 | | DNA | Glycine max | Predicted polypeptide sequence is orthologous to G390, G438 |
| 1107 | | DNA | Glycine max | Predicted polypeptide sequence is orthologous to G390, G438 |
| 1108 | | DNA | Oryza sativa | Predicted polypeptide sequence is orthologous to G390 |
| 1109 | | PRT | Oryza sativa | Orthologous to G390, G438 |
| 1110 | | PRT | Oryza sativa | Orthologous to G390, G438 |
| 1111 | | PRT | Oryza sativa | Orthologous to G390, G438 |
| 1112 | | PRT | Oryza sativa | Orthologous to G390, G438 |
| 1113 | | DNA | Oryza sativa | Predicted polypeptide sequence is orthologous to G390, G438 |
| 1114 | | DNA | Zea mays | Predicted polypeptide sequence is orthologous to G390, G438 |
| 1115 | | DNA | Zea mays | Predicted polypeptide sequence is orthologous to G390, G438 |
| 1116 | | DNA | Zea mays | Predicted polypeptide sequence is orthologous to G390, G438 |
| 1117 | | DNA | Zea mays | Predicted polypeptide sequence is orthologous to G390 |
| 1118 | | DNA | Zea mays | Predicted polypeptide sequence is orthologous to G390, G438 |
| 1119 | | DNA | Zea mays | Predicted polypeptide sequence is orthologous to G390, G438 |
| 1120 | | DNA | Zea mays | Predicted polypeptide sequence is orthologous to G390, G438 |
| 1121 | | DNA | Zea mays | Predicted polypeptide sequence is orthologous to G390, G438 |
| 1122 | | DNA | Zea mays | Predicted polypeptide sequence is orthologous to G390, G438 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1123 | | DNA | Zea mays | Predicted polypeptide sequence is orthologous to G390, G438 |
| 1124 | | DNA | Glycine max | Predicted polypeptide sequence is orthologous to G409 |
| 1125 | | DNA | Glycine max | Predicted polypeptide sequence is orthologous to G409 |
| 1126 | | DNA | Glycine max | Predicted polypeptide sequence is orthologous to G409 |
| 1127 | | DNA | Glycine max | Predicted polypeptide sequence is orthologous to G409 |
| 1128 | | DNA | Glycine max | Predicted polypeptide sequence is orthologous to G409 |
| 1129 | | DNA | Glycine max | Predicted polypeptide sequence is orthologous to G409 |
| 1130 | | DNA | Glycine max | Predicted polypeptide sequence is orthologous to G409 |
| 1131 | | DNA | Glycine max | Predicted polypeptide sequence is orthologous to G409 |
| 1132 | | DNA | Oryza sativa | Predicted polypeptide sequence is orthologous to G409 |
| 1133 | | DNA | Oryza sativa | Predicted polypeptide sequence is orthologous to G409 |
| 1134 | | DNA | Oryza sativa | Predicted polypeptide sequence is orthologous to G409 |
| 1135 | | DNA | Zea mays | Predicted polypeptide sequence is orthologous to G409 |
| 1136 | | DNA | Zea mays | Predicted polypeptide sequence is orthologous to G409 |
| 1137 | | DNA | Zea mays | Predicted polypeptide sequence is orthologous to G409 |
| 1138 | | DNA | Zea mays | Predicted polypeptide sequence is orthologous to G409 |
| 1139 | | DNA | Zea mays | Predicted polypeptide sequence is orthologous to G409 |
| 1140 | | DNA | Zea mays | Predicted polypeptide sequence is orthologous to G409 |
| 1141 | | DNA | Zea mays | Predicted polypeptide sequence is orthologous to G409 |
| 1142 | | DNA | Glycine max | Predicted polypeptide sequence is orthologous to G438 |
| 1143 | | DNA | Oryza sativa | Predicted polypeptide sequence is orthologous to G438 |
| 1144 | | DNA | Oryza sativa | Predicted polypeptide sequence is orthologous to G438 |
| 1145 | | DNA | Oryza sativa | Predicted polypeptide sequence is orthologous to G438 |
| 1146 | | DNA | Oryza sativa | Predicted polypeptide sequence is orthologous to G438 |
| 1147 | | DNA | Oryza sativa | Predicted polypeptide sequence is orthologous to G438 |
| 1148 | | DNA | Zea mays | Predicted polypeptide sequence is orthologous to G438 |
| 1149 | | DNA | Oryza sativa | Predicted polypeptide sequence is orthologous to G464 |
| 1150 | | PRT | Oryza sativa | Orthologous to G464 |
| 1151 | | DNA | Zea mays | Predicted polypeptide sequence is orthologous to G464 |
| 1152 | | DNA | Glycine max | Predicted polypeptide sequence is orthologous to G470 |
| 1153 | | DNA | Oryza sativa | Predicted polypeptide sequence is orthologous to G470 |
| 1154 | | DNA | Oryza sativa | Predicted polypeptide sequence is orthologous to G470 |
| 1155 | | DNA | Glycine max | Predicted polypeptide sequence is orthologous to G475 |
| 1156 | | DNA | Glycine max | Predicted polypeptide sequence is orthologous to G482 |
| 1157 | | DNA | Glycine max | Predicted polypeptide sequence is orthologous to G482 |
| 1158 | | DNA | Glycine max | Predicted polypeptide sequence is orthologous to G482 |
| 1159 | | DNA | Glycine max | Predicted polypeptide sequence is orthologous to G482 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1160 | | DNA | Glycine max | Predicted polypeptide sequence is orthologous to G482 |
| 1161 | | DNA | Glycine max | Predicted polypeptide sequence is orthologous to G482 |
| 1162 | | DNA | Glycine max | Predicted polypeptide sequence is orthologous to G482 |
| 1163 | | DNA | Glycine max | Predicted polypeptide sequence is orthologous to G482 |
| 1164 | | DNA | Glycine max | Predicted polypeptide sequence is orthologous to G482 |
| 1165 | | PRT | Oryza sativa | Orthologous to G482 |
| 1166 | | PRT | Oryza sativa | Orthologous to G482 |
| 1167 | | PRT | Oryza sativa | Orthologous to G482 |
| 1168 | | PRT | Oryza sativa | Orthologous to G482 |
| 1169 | | PRT | Oryza sativa | Orthologous to G482 |
| 1170 | | DNA | Oryza sativa | Predicted polypeptide sequence is orthologous to G482 |
| 1171 | | DNA | Zea mays | Predicted polypeptide sequence is orthologous to G482 |
| 1172 | | DNA | Zea mays | Predicted polypeptide sequence is orthologous to G482 |
| 1173 | | DNA | Zea mays | Predicted polypeptide sequence is orthologous to G482 |
| 1174 | | DNA | Zea mays | Predicted polypeptide sequence is orthologous to G482 |
| 1175 | | DNA | Zea mays | Predicted polypeptide sequence is orthologous to G482 |
| 1176 | | DNA | Zea mays | Predicted polypeptide sequence is orthologous to G482 |
| 1177 | | DNA | Zea mays | Predicted polypeptide sequence is orthologous to G482 |
| 1178 | | DNA | Zea mays | Predicted polypeptide sequence is orthologous to G482 |
| 1179 | | DNA | Zea mays | Predicted polypeptide sequence is orthologous to G482 |
| 1180 | | DNA | Glycine max | Predicted polypeptide sequence is orthologous to G489 |
| 1181 | | DNA | Glycine max | Predicted polypeptide sequence is orthologous to G489 |
| 1182 | | DNA | Glycine max | Predicted polypeptide sequence is orthologous to G489 |
| 1183 | | DNA | Glycine max | Predicted polypeptide sequence is orthologous to G489 |
| 1184 | | DNA | Glycine max | Predicted polypeptide sequence is orthologous to G489 |
| 1185 | | DNA | Glycine max | Predicted polypeptide sequence is orthologous to G489 |
| 1186 | | DNA | Glycine max | Predicted polypeptide sequence is orthologous to G489 |
| 1187 | | DNA | Oryza sativa | Predicted polypeptide sequence is orthologous to G489 |
| 1188 | | DNA | Oryza sativa | Predicted polypeptide sequence is orthologous to G489 |
| 1189 | | PRT | Oryza sativa | Orthologous to G489 |
| 1190 | | PRT | Oryza sativa | Orthologous to G489 |
| 1191 | | PRT | Oryza sativa | Orthologous to G489 |
| 1192 | | DNA | Zea mays | Predicted polypeptide sequence is orthologous to G489 |
| 1193 | | DNA | Glycine max | Predicted polypeptide sequence is orthologous to G509 |
| 1194 | | DNA | Glycine max | Predicted polypeptide sequence is orthologous to G509 |
| 1195 | | DNA | Glycine max | Predicted polypeptide sequence is orthologous to G509 |
| 1196 | | DNA | Oryza sativa | Predicted polypeptide sequence is orthologous to G509 |
| 1197 | | PRT | Oryza sativa | Orthologous to G509 |
| 1198 | | PRT | Oryza sativa | Orthologous to G509 |
| 1199 | | PRT | Oryza sativa | Orthologous to G509 |
| 1200 | | DNA | Oryza sativa | Predicted polypeptide sequence is orthologous to G509 |
| 1201 | | DNA | Zea mays | Predicted polypeptide sequence is orthologous to G509 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1202 | | DNA | Zea mays | Predicted polypeptide sequence is orthologous to G509 |
| 1203 | | DNA | Zea mays | Predicted polypeptide sequence is orthologous to G509 |
| 1204 | | DNA | Zea mays | Predicted polypeptide sequence is orthologous to G509 |
| 1205 | | DNA | Glycine max | Predicted polypeptide sequence is orthologous to G545 |
| 1206 | | DNA | Glycine max | Predicted polypeptide sequence is orthologous to G545 |
| 1207 | | DNA | Glycine max | Predicted polypeptide sequence is orthologous to G545 |
| 1208 | | DNA | Glycine max | Predicted polypeptide sequence is orthologous to G545 |
| 1209 | | DNA | Glycine max | Predicted polypeptide sequence is orthologous to G545 |
| 1210 | | DNA | Glycine max | Predicted polypeptide sequence is orthologous to G545 |
| 1211 | | DNA | Glycine max | Predicted polypeptide sequence is orthologous to G545 |
| 1212 | | DNA | Oryza sativa | Predicted polypeptide sequence is orthologous to G545 |
| 1213 | | PRT | Oryza sativa | Orthologous to G545 |
| 1214 | | PRT | Oryza sativa | Orthologous to G545 |
| 1215 | | PRT | Oryza sativa | Orthologous to G545 |
| 1216 | | PRT | Oryza sativa | Orthologous to G545 |
| 1217 | | DNA | Zea mays | Predicted polypeptide sequence is orthologous to G545 |
| 1218 | | DNA | Zea mays | Predicted polypeptide sequence is orthologous to G545 |
| 1219 | | DNA | Zea mays | Predicted polypeptide sequence is orthologous to G545 |
| 1220 | | DNA | Zea mays | Predicted polypeptide sequence is orthologous to G561 |
| 1221 | | DNA | Glycine max | Predicted polypeptide sequence is orthologous to G562 |
| 1222 | | DNA | Glycine max | Predicted polypeptide sequence is orthologous to G562 |
| 1223 | | DNA | Glycine max | Predicted polypeptide sequence is orthologous to G562 |
| 1224 | | DNA | Glycine max | Predicted polypeptide sequence is orthologous to G562 |
| 1225 | | DNA | Glycine max | Predicted polypeptide sequence is orthologous to G562 |
| 1226 | | PRT | Oryza sativa | Orthologous to G562 |
| 1227 | | PRT | Oryza sativa | Orthologous to G562 |
| 1228 | | DNA | Zea mays | Predicted polypeptide sequence is orthologous to G562 |
| 1229 | | DNA | Zea mays | Predicted polypeptide sequence is orthologous to G562 |
| 1230 | | DNA | Zea mays | Predicted polypeptide sequence is orthologous to G562 |
| 1231 | | DNA | Glycine max | Predicted polypeptide sequence is orthologous to G567 |
| 1232 | | DNA | Oryza sativa | Predicted polypeptide sequence is orthologous to G567 |
| 1233 | | PRT | Oryza sativa | Orthologous to G567 |
| 1234 | | DNA | Glycine max | Predicted polypeptide sequence is orthologous to G584 |
| 1235 | | DNA | Glycine max | Predicted polypeptide sequence is orthologous to G584 |
| 1236 | | DNA | Glycine max | Predicted polypeptide sequence is orthologous to G584 |
| 1237 | | DNA | Glycine max | Predicted polypeptide sequence is orthologous to G584 |
| 1238 | | DNA | Glycine max | Predicted polypeptide sequence is orthologous to G584 |
| 1239 | | PRT | Oryza sativa | Orthologous to G584 |
| 1240 | | DNA | Zea mays | Predicted polypeptide sequence is orthologous to G584 |
| 1241 | | DNA | Zea mays | Predicted polypeptide sequence is orthologous to G584 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1242 | | DNA | Zea mays | Predicted polypeptide sequence is orthologous to G584 |
| 1243 | | DNA | Glycine max | Predicted polypeptide sequence is orthologous to G590 |
| 1244 | | DNA | Glycine max | Predicted polypeptide sequence is orthologous to G590 |
| 1245 | | DNA | Glycine max | Predicted polypeptide sequence is orthologous to G590 |
| 1246 | | PRT | Oryza sativa | Orthologous to G590 |
| 1247 | | PRT | Oryza sativa | Orthologous to G590 |
| 1248 | | DNA | Oryza sativa | Predicted polypeptide sequence is orthologous to G590 |
| 1249 | | DNA | Zea mays | Predicted polypeptide sequence is orthologous to G590 |
| 1250 | | DNA | Glycine max | Predicted polypeptide sequence is orthologous to G592 |
| 1251 | | DNA | Glycine max | Predicted polypeptide sequence is orthologous to G592 |
| 1252 | | DNA | Glycine max | Predicted polypeptide sequence is orthologous to G592 |
| 1253 | | DNA | Glycine max | Predicted polypeptide sequence is orthologous to G592 |
| 1254 | | DNA | Glycine max | Predicted polypeptide sequence is orthologous to G592 |
| 1255 | | DNA | Oryza sativa | Predicted polypeptide sequence is orthologous to G592 |
| 1256 | | DNA | Oryza sativa | Predicted polypeptide sequence is orthologous to G592 |
| 1257 | | DNA | Oryza sativa | Predicted polypeptide sequence is orthologous to G592 |
| 1258 | | PRT | Oryza sativa | Orthologous to G592 |
| 1259 | | PRT | Oryza sativa | Orthologous to G592 |
| 1260 | | DNA | Oryza sativa | Predicted polypeptide sequence is orthologous to G592 |
| 1261 | | DNA | Zea mays | Predicted polypeptide sequence is orthologous to G592 |
| 1262 | | DNA | Zea mays | Predicted polypeptide sequence is orthologous to G592 |
| 1263 | | DNA | Zea mays | Predicted polypeptide sequence is orthologous to G592 |
| 1264 | | DNA | Zea mays | Predicted polypeptide sequence is orthologous to G592 |
| 1265 | | DNA | Glycine max | Predicted polypeptide sequence is orthologous to G627 |
| 1266 | | DNA | GLYCINE MAX | Predicted polypeptide sequence is orthologous to G627 |
| 1267 | | DNA | Oryza sativa | Predicted polypeptide sequence is orthologous to G627 |
| 1268 | | DNA | Oryza sativa | Predicted polypeptide sequence is orthologous to G634 |
| 1269 | | PRT | Oryza sativa | Orthologous to G634 |
| 1270 | | DNA | Oryza sativa | Predicted polypeptide sequence is orthologous to G634 |
| 1271 | | DNA | Oryza sativa | Predicted polypeptide sequence is orthologous to G634 |
| 1272 | | DNA | Zea mays | Predicted polypeptide sequence is orthologous to G634 |
| 1273 | | DNA | Zea mays | Predicted polypeptide sequence is orthologous to G634 |
| 1274 | | DNA | Zea mays | Predicted polypeptide sequence is orthologous to G634 |
| 1275 | | DNA | Glycine max | Predicted polypeptide sequence is orthologous to G636 |
| 1276 | | DNA | Glycine max | Predicted polypeptide sequence is orthologous to G636 |
| 1277 | | DNA | Glycine max | Predicted polypeptide sequence is orthologous to G636 |
| 1278 | | DNA | Glycine max | Predicted polypeptide sequence is orthologous to G636 |
| 1279 | | DNA | Glycine max | Predicted polypeptide sequence is orthologous to G636 |
| 1280 | | DNA | Glycine max | Predicted polypeptide sequence is orthologous to G636 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1281 | | DNA | Glycine max | Predicted polypeptide sequence is orthologous to G636 |
| 1282 | | DNA | Glycine max | Predicted polypeptide sequence is orthologous to G636 |
| 1283 | | DNA | Oryza sativa | Predicted polypeptide sequence is orthologous to G636 |
| 1284 | | DNA | Oryza sativa | Predicted polypeptide sequence is orthologous to G636 |
| 1285 | | DNA | Oryza sativa | Predicted polypeptide sequence is orthologous to G636 |
| 1286 | | DNA | Oryza sativa | Predicted polypeptide sequence is orthologous to G636 |
| 1287 | | DNA | Zea mays | Predicted polypeptide sequence is orthologous to G636 |
| 1288 | | DNA | Zea mays | Predicted polypeptide sequence is orthologous to G636 |
| 1289 | | DNA | Zea mays | Predicted polypeptide sequence is orthologous to G636 |
| 1290 | | DNA | Zea mays | Predicted polypeptide sequence is orthologous to G636 |
| 1291 | | DNA | Glycine max | Predicted polypeptide sequence is orthologous to G638 |
| 1292 | | DNA | Glycine max | Predicted polypeptide sequence is orthologous to G638 |
| 1293 | | DNA | Glycine max | Predicted polypeptide sequence is orthologous to G638 |
| 1294 | | DNA | Glycine max | Predicted polypeptide sequence is orthologous to G638 |
| 1295 | | DNA | Glycine max | Predicted polypeptide sequence is orthologous to G663 |
| 1296 | | DNA | Glycine max | Predicted polypeptide sequence is orthologous to G664 |
| 1297 | | DNA | Glycine max | Predicted polypeptide sequence is orthologous to G664 |
| 1298 | | DNA | Glycine max | Predicted polypeptide sequence is orthologous to G664 |
| 1299 | | DNA | Glycine max | Predicted polypeptide sequence is orthologous to G664 |
| 1300 | | DNA | Glycine max | Predicted polypeptide sequence is orthologous to G664 |
| 1301 | | DNA | Glycine max | Predicted polypeptide sequence is orthologous to G664 |
| 1302 | | DNA | Glycine max | Predicted polypeptide sequence is orthologous to G664 |
| 1303 | | DNA | Oryza sativa | Predicted polypeptide sequence is orthologous to G664 |
| 1304 | | DNA | Oryza sativa | Predicted polypeptide sequence is orthologous to G664 |
| 1305 | | DNA | Oryza sativa | Predicted polypeptide sequence is orthologous to G664 |
| 1306 | | DNA | Oryza sativa | Predicted polypeptide sequence is orthologous to G664 |
| 1307 | | PRT | Oryza sativa | Orthologous to G664 |
| 1308 | | PRT | Oryza sativa | Orthologous to G664 |
| 1309 | | PRT | Oryza sativa | Orthologous to G664 |
| 1310 | | PRT | Oryza sativa | Orthologous to G664 |
| 1311 | | DNA | Zea mays | Predicted polypeptide sequence is orthologous to G664 |
| 1312 | | DNA | Zea mays | Predicted polypeptide sequence is orthologous to G664 |
| 1313 | | DNA | Zea mays | Predicted polypeptide sequence is orthologous to G664 |
| 1314 | | DNA | Zea mays | Predicted polypeptide sequence is orthologous to G664 |
| 1315 | | DNA | Zea mays | Predicted polypeptide sequence is orthologous to G664 |
| 1316 | | DNA | Zea mays | Predicted polypeptide sequence is orthologous to G664 |
| 1317 | | DNA | Zea mays | Predicted polypeptide sequence is orthologous to G664 |
| 1318 | | DNA | Zea mays | Predicted polypeptide sequence is orthologous to G664 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1319 | | DNA | Oryza sativa | Predicted polypeptide sequence is orthologous to G680 |
| 1320 | | DNA | Zea mays | Predicted polypeptide sequence is orthologous to G680 |
| 1321 | | DNA | Glycine max | Predicted polypeptide sequence is orthologous to G736 |
| 1322 | | DNA | Glycine max | Predicted polypeptide sequence is orthologous to G736 |
| 1323 | | PRT | Oryza sativa | Orthologous to G736 |
| 1324 | | DNA | Glycine max | Predicted polypeptide sequence is orthologous to G748 |
| 1325 | | DNA | Glycine max | Predicted polypeptide sequence is orthologous to G748 |
| 1326 | | DNA | Glycine max | Predicted polypeptide sequence is orthologous to G748 |
| 1327 | | DNA | Oryza sativa | Predicted polypeptide sequence is orthologous to G748 |
| 1328 | | DNA | Oryza sativa | Predicted polypeptide sequence is orthologous to G748 |
| 1329 | | PRT | Oryza sativa | Orthologous to G748 |
| 1330 | | PRT | Oryza sativa | Orthologous to G748 |
| 1331 | | PRT | Oryza sativa | Orthologous to G748 |
| 1332 | | PRT | Oryza sativa | Orthologous to G748 |
| 1333 | | DNA | Zea mays | Predicted polypeptide sequence is orthologous to G748 |
| 1334 | | DNA | Glycine max | Predicted polypeptide sequence is orthologous to G789 |
| 1335 | | DNA | Glycine max | Predicted polypeptide sequence is orthologous to G789 |
| 1336 | | DNA | Oryza sativa | Predicted polypeptide sequence is orthologous to G789 |
| 1337 | | DNA | Oryza sativa | Predicted polypeptide sequence is orthologous to G789 |
| 1338 | | PRT | Oryza sativa | Orthologous to G789 |
| 1339 | | PRT | Oryza sativa | Orthologous to G789 |
| 1340 | | PRT | Oryza sativa | Orthologous to G789 |
| 1341 | | DNA | Zea mays | Predicted polypeptide sequence is orthologous to G789 |
| 1342 | | DNA | Glycine max | Predicted polypeptide sequence is orthologous to G801 |
| 1343 | | DNA | Glycine max | Predicted polypeptide sequence is orthologous to G801 |
| 1344 | | DNA | Zea mays | Predicted polypeptide sequence is orthologous to G801 |
| 1345 | | DNA | Glycine max | Predicted polypeptide sequence is orthologous to G849 |
| 1346 | | DNA | Glycine max | Predicted polypeptide sequence is orthologous to G849 |
| 1347 | | DNA | Glycine max | Predicted polypeptide sequence is orthologous to G849 |
| 1348 | | DNA | Glycine max | Predicted polypeptide sequence is orthologous to G849 |
| 1349 | | DNA | Glycine max | Predicted polypeptide sequence is orthologous to G849 |
| 1350 | | DNA | Glycine max | Predicted polypeptide sequence is orthologous to G849 |
| 1351 | | DNA | Zea mays | Predicted polypeptide sequence is orthologous to G849 |
| 1352 | | DNA | Zea mays | Predicted polypeptide sequence is orthologous to G849 |
| 1353 | | DNA | Zea mays | Predicted polypeptide sequence is orthologous to G849 |
| 1354 | | DNA | Glycine max | Predicted polypeptide sequence is orthologous to G864 |
| 1355 | | DNA | Glycine max | Predicted polypeptide sequence is orthologous to G864 |
| 1356 | | DNA | Glycine max | Predicted polypeptide sequence is orthologous to G864 |
| 1357 | | DNA | Glycine max | Predicted polypeptide sequence is orthologous to G864 |
| 1358 | | DNA | Glycine max | Predicted polypeptide sequence is orthologous to G864 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1359 | | DNA | Glycine max | Predicted polypeptide sequence is orthologous to G864 |
| 1360 | | DNA | Oryza sativa | Predicted polypeptide sequence is orthologous to G864 |
| 1361 | | PRT | Oryza sativa | Orthologous to G864 |
| 1362 | | PRT | Oryza sativa | Orthologous to G864 |
| 1363 | | DNA | Zea mays | Predicted polypeptide sequence is orthologous to G864 |
| 1364 | | DNA | Zea mays | Predicted polypeptide sequence is orthologous to G864 |
| 1365 | | DNA | Zea mays | Predicted polypeptide sequence is orthologous to G864 |
| 1366 | | DNA | Glycine max | Predicted polypeptide sequence is orthologous to G867 |
| 1367 | | DNA | Glycine max | Predicted polypeptide sequence is orthologous to G867 |
| 1368 | | DNA | Glycine max | Predicted polypeptide sequence is orthologous to G867 |
| 1369 | | DNA | Glycine max | Predicted polypeptide sequence is orthologous to G867 |
| 1370 | | DNA | Glycine max | Predicted polypeptide sequence is orthologous to G867 |
| 1371 | | DNA | Glycine max | Predicted polypeptide sequence is orthologous to G867 |
| 1372 | | DNA | Oryza sativa | Predicted polypeptide sequence is orthologous to G867 |
| 1373 | | PRT | Oryza sativa | Orthologous to G867 |
| 1374 | | PRT | Oryza sativa | Orthologous to G867 |
| 1375 | | PRT | Oryza sativa | Orthologous to G867 |
| 1376 | | DNA | Oryza sativa | Predicted polypeptide sequence is orthologous to G867 |
| 1377 | | DNA | Zea mays | Predicted polypeptide sequence is orthologous to G867 |
| 1378 | | DNA | Zea mays | Predicted polypeptide sequence is orthologous to G867 |
| 1379 | | DNA | Zea mays | Predicted polypeptide sequence is orthologous to G867 |
| 1380 | | DNA | Zea mays | Predicted polypeptide sequence is orthologous to G867 |
| 1381 | | DNA | Glycine max | Predicted polypeptide sequence is orthologous to G869 |
| 1382 | | DNA | Glycine max | Predicted polypeptide sequence is orthologous to G869 |
| 1383 | | DNA | Oryza sativa | Predicted polypeptide sequence is orthologous to G869 |
| 1384 | | PRT | Oryza sativa | Orthologous to G869 |
| 1385 | | DNA | Zea mays | Predicted polypeptide sequence is orthologous to G869 |
| 1386 | | DNA | Glycine max | Predicted polypeptide sequence is orthologous to G877 |
| 1387 | | DNA | Oryza sativa | Predicted polypeptide sequence is orthologous to G877 |
| 1388 | | DNA | Oryza sativa | Predicted polypeptide sequence is orthologous to G877 |
| 1389 | | PRT | Oryza sativa | Orthologous to G877 |
| 1390 | | PRT | Oryza sativa | Orthologous to G877 |
| 1391 | | PRT | Oryza sativa | Orthologous to G877 |
| 1392 | | DNA | Zea mays | Predicted polypeptide sequence is orthologous to G877 |
| 1393 | | DNA | Zea mays | Predicted polypeptide sequence is orthologous to G877 |
| 1394 | | DNA | Zea mays | Predicted polypeptide sequence is orthologous to G877 |
| 1395 | | DNA | Glycine max | Predicted polypeptide sequence is orthologous to G881 |
| 1396 | | PRT | Oryza sativa | Orthologous to G881 |
| 1397 | | DNA | Oryza sativa | Predicted polypeptide sequence is orthologous to G881 |
| 1398 | | DNA | Oryza sativa | Predicted polypeptide sequence is orthologous to G881 |
| 1399 | | DNA | Zea mays | Predicted polypeptide sequence is orthologous to G881 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1400 | | DNA | Zea mays | Predicted polypeptide sequence is orthologous to G881 |
| 1401 | | DNA | Zea mays | Predicted polypeptide sequence is orthologous to G881 |
| 1402 | | DNA | Zea mays | Predicted polypeptide sequence is orthologous to G881 |
| 1403 | | DNA | Glycine max | Predicted polypeptide sequence is orthologous to G912 |
| 1404 | | DNA | Glycine max | Predicted polypeptide sequence is orthologous to G912 |
| 1405 | | DNA | Glycine max | Predicted polypeptide sequence is orthologous to G912 |
| 1406 | | DNA | Glycine max | Predicted polypeptide sequence is orthologous to G912 |
| 1407 | | DNA | Glycine max | Predicted polypeptide sequence is orthologous to G912 |
| 1408 | | DNA | Glycine max | Predicted polypeptide sequence is orthologous to G912 |
| 1409 | | DNA | Glycine max | Predicted polypeptide sequence is orthologous to G912 |
| 1410 | | DNA | Oryza sativa | Predicted polypeptide sequence is orthologous to G912 |
| 1411 | | PRT | Oryza sativa | Orthologous to G912 |
| 1412 | | PRT | Oryza sativa | Orthologous to G912 |
| 1413 | | PRT | Oryza sativa | Orthologous to G912 |
| 1414 | | PRT | Oryza sativa | Orthologous to G912 |
| 1415 | | DNA | Oryza sativa | Predicted polypeptide sequence is orthologous to G912 |
| 1416 | | DNA | Zea mays | Predicted polypeptide sequence is orthologous to G912 |
| 1417 | | DNA | Zea mays | Predicted polypeptide sequence is orthologous to G912 |
| 1418 | | DNA | Zea mays | Predicted polypeptide sequence is orthologous to G912 |
| 1419 | | DNA | Zea mays | Predicted polypeptide sequence is orthologous to G912 |
| 1420 | | DNA | Zea mays | Predicted polypeptide sequence is orthologous to G912 |
| 1421 | | DNA | Glycine max | Predicted polypeptide sequence is orthologous to G961 |
| 1422 | | DNA | Glycine max | Predicted polypeptide sequence is orthologous to G961 |
| 1423 | | DNA | Oryza sativa | Predicted polypeptide sequence is orthologous to G961 |
| 1424 | | PRT | Oryza sativa | Orthologous to G961 |
| 1425 | | DNA | Zea mays | Predicted polypeptide sequence is orthologous to G961 |
| 1426 | | DNA | Zea mays | Predicted polypeptide sequence is orthologous to G961 |
| 1427 | | DNA | Zea mays | Predicted polypeptide sequence is orthologous to G961 |
| 1428 | | DNA | Glycine max | Predicted polypeptide sequence is orthologous to G974 |
| 1429 | | DNA | Glycine max | Predicted polypeptide sequence is orthologous to G974 |
| 1430 | | DNA | Glycine max | Predicted polypeptide sequence is orthologous to G974 |
| 1431 | | DNA | Glycine max | Predicted polypeptide sequence is orthologous to G974 |
| 1432 | | DNA | Glycine max | Predicted polypeptide sequence is orthologous to G974 |
| 1433 | | DNA | Glycine max | Predicted polypeptide sequence is orthologous to G974 |
| 1434 | | DNA | Oryza sativa | Predicted polypeptide sequence is orthologous to G974 |
| 1435 | | PRT | Oryza sativa | Orthologous to G974 |
| 1436 | | PRT | Oryza sativa | Orthologous to G974 |
| 1437 | | PRT | Oryza sativa | Orthologous to G974 |
| 1438 | | DNA | Zea mays | Predicted polypeptide sequence is orthologous to G974 |
| 1439 | | DNA | Zea mays | Predicted polypeptide sequence is orthologous to G974 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1440 | | DNA | Zea mays | Predicted polypeptide sequence is orthologous to G974 |
| 1441 | | DNA | Zea mays | Predicted polypeptide sequence is orthologous to G974 |
| 1442 | | DNA | Glycine max | Predicted polypeptide sequence is orthologous to G975 |
| 1443 | | DNA | Glycine max | Predicted polypeptide sequence is orthologous to G975 |
| 1444 | | DNA | Glycine max | Predicted polypeptide sequence is orthologous to G975 |
| 1445 | | DNA | Glycine max | Predicted polypeptide sequence is orthologous to G975 |
| 1446 | | DNA | Glycine max | Predicted polypeptide sequence is orthologous to G975 |
| 1447 | | DNA | Oryza sativa | Predicted polypeptide sequence is orthologous to G975 |
| 1448 | | PRT | Oryza sativa | Orthologous to G975 |
| 1449 | | DNA | Oryza sativa | Predicted polypeptide sequence is orthologous to G975 |
| 1450 | | DNA | Zea mays | Predicted polypeptide sequence is orthologous to G975 |
| 1451 | | DNA | Zea mays | Predicted polypeptide sequence is orthologous to G975 |
| 1452 | | DNA | Glycine max | Predicted polypeptide sequence is orthologous to G979 |
| 1453 | | DNA | Glycine max | Predicted polypeptide sequence is orthologous to G979 |
| 1454 | | DNA | Glycine max | Predicted polypeptide sequence is orthologous to G979 |
| 1455 | | DNA | Oryza sativa | Predicted polypeptide sequence is orthologous to G979 |
| 1456 | | PRT | Oryza sativa | Orthologous to G979 |
| 1457 | | PRT | Oryza sativa | Orthologous to G979 |
| 1458 | | PRT | Oryza sativa | Orthologous to G979 |
| 1459 | | PRT | Oryza sativa | Orthologous to G979 |
| 1460 | | PRT | Oryza sativa | Orthologous to G979 |
| 1461 | | DNA | Zea mays | Predicted polypeptide sequence is orthologous to G979 |
| 1462 | | DNA | Zea mays | Predicted polypeptide sequence is orthologous to G979 |
| 1463 | | DNA | Zea mays | Predicted polypeptide sequence is orthologous to G979 |
| 1464 | | DNA | Glycine max | Predicted polypeptide sequence is orthologous to G987 |
| 1465 | | DNA | Glycine max | Predicted polypeptide sequence is orthologous to G987 |
| 1466 | | DNA | Glycine max | Predicted polypeptide sequence is orthologous to G987 |
| 1467 | | DNA | Glycine max | Predicted polypeptide sequence is orthologous to G987 |
| 1468 | | DNA | Glycine max | Predicted polypeptide sequence is orthologous to G987 |
| 1469 | | DNA | Glycine max | Predicted polypeptide sequence is orthologous to G987 |
| 1470 | | DNA | Oryza sativa | Predicted polypeptide sequence is orthologous to G987 |
| 1471 | | DNA | Oryza sativa | Predicted polypeptide sequence is orthologous to G987 |
| 1472 | | PRT | Oryza sativa | Orthologous to G987 |
| 1473 | | DNA | Zea mays | Predicted polypeptide sequence is orthologous to G987 |
| 1474 | | DNA | Glycine max | Predicted polypeptide sequence is orthologous to G1052 |
| 1475 | | DNA | Glycine max | Predicted polypeptide sequence is orthologous to G1052 |
| 1476 | | DNA | Glycine max | Predicted polypeptide sequence is orthologous to G1052 |
| 1477 | | DNA | Glycine max | Predicted polypeptide sequence is orthologous to G1052 |
| 1478 | | DNA | Glycine max | Predicted polypeptide sequence is orthologous to G1052 |
| 1479 | | DNA | Glycine max | Predicted polypeptide sequence is orthologous to G1052 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1480 | | DNA | *Glycine max* | Predicted polypeptide sequence is orthologous to G1052 |
| 1481 | | DNA | *Oryza sativa* | Predicted polypeptide sequence is orthologous to G1052 |
| 1482 | | DNA | *Oryza sativa* | Predicted polypeptide sequence is orthologous to G1052 |
| 1483 | | PRT | *Oryza sativa* | Orthologous to G1052 |
| 1484 | | PRT | *Oryza sativa* | Orthologous to G1052 |
| 1485 | | DNA | *Zea mays* | Predicted polypeptide sequence is orthologous to G1052 |
| 1486 | | DNA | *Zea mays* | Predicted polypeptide sequence is orthologous to G1052 |
| 1487 | | DNA | *Zea mays* | Predicted polypeptide sequence is orthologous to G1052 |
| 1488 | | DNA | *Zea mays* | Predicted polypeptide sequence is orthologous to G1052 |
| 1489 | | DNA | *Zea mays* | Predicted polypeptide sequence is orthologous to G1052 |
| 1490 | | DNA | *Zea mays* | Predicted polypeptide sequence is orthologous to G1052 |
| 1491 | | DNA | *Zea mays* | Predicted polypeptide sequence is orthologous to G1052 |
| 1492 | | DNA | *Zea mays* | Predicted polypeptide sequence is orthologous to G1052 |
| 1493 | | DNA | *Zea mays* | Predicted polypeptide sequence is orthologous to G1052 |
| 1494 | | DNA | *Glycine max* | Predicted polypeptide sequence is orthologous to G1062 |
| 1495 | | DNA | *Glycine max* | Predicted polypeptide sequence is orthologous to G1062 |
| 1496 | | DNA | *Glycine max* | Predicted polypeptide sequence is orthologous to G1062 |
| 1497 | | DNA | *Glycine max* | Predicted polypeptide sequence is orthologous to G1062 |
| 1498 | | DNA | *Oryza sativa* | Predicted polypeptide sequence is orthologous to G1062 |
| 1499 | | DNA | *Oryza sativa* | Predicted polypeptide sequence is orthologous to G1062 |
| 1500 | | PRT | *Oryza sativa* | Orthologous to G1062 |
| 1501 | | DNA | *Zea mays* | Predicted polypeptide sequence is orthologous to G1062 |
| 1502 | | DNA | *Zea mays* | Predicted polypeptide sequence is orthologous to G1062 |
| 1503 | | DNA | *Zea mays* | Predicted polypeptide sequence is orthologous to G1062 |
| 1504 | | DNA | *Zea mays* | Predicted polypeptide sequence is orthologous to G1062 |
| 1505 | | DNA | *Zea mays* | Predicted polypeptide sequence is orthologous to G1062 |
| 1506 | | DNA | *Glycine max* | Predicted polypeptide sequence is orthologous to G1069 |
| 1507 | | DNA | *Glycine max* | Predicted polypeptide sequence is orthologous to G1069 |
| 1508 | | PRT | *Oryza sativa* | Orthologous to G1069 |
| 1509 | | DNA | *Zea mays* | Predicted polypeptide sequence is orthologous to G1069 |
| 1510 | | PRT | *Oryza sativa* | Orthologous to G1073 |
| 1511 | | PRT | *Oryza sativa* | Orthologous to G1073 |
| 1512 | | DNA | *Glycine max* | Predicted polypeptide sequence is orthologous to G1075 |
| 1513 | | DNA | *Glycine max* | Predicted polypeptide sequence is orthologous to G1075 |
| 1514 | | DNA | *Glycine max* | Predicted polypeptide sequence is orthologous to G1075 |
| 1515 | | DNA | *Glycine max* | Predicted polypeptide sequence is orthologous to G1075 |
| 1516 | | DNA | *Glycine max* | Predicted polypeptide sequence is orthologous to G1075 |
| 1517 | | DNA | *Oryza sativa* | Predicted polypeptide sequence is orthologous to G1075 |
| 1518 | | DNA | *Oryza sativa* | Predicted polypeptide sequence is orthologous to G1075 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1519 | | DNA | Oryza sativa | Predicted polypeptide sequence is orthologous to G1075 |
| 1520 | | PRT | Oryza sativa | Orthologous to G1089 |
| 1521 | | DNA | Oryza sativa | Predicted polypeptide sequence is orthologous to G1089 |
| 1522 | | DNA | Zea mays | Predicted polypeptide sequence is orthologous to G1089 |
| 1523 | | DNA | Zea mays | Predicted polypeptide sequence is orthologous to G1089 |
| 1524 | | DNA | Zea mays | Predicted polypeptide sequence is orthologous to G1089 |
| 1525 | | DNA | Zea mays | Predicted polypeptide sequence is orthologous to G1089 |
| 1526 | | DNA | Zea mays | Predicted polypeptide sequence is orthologous to G1089 |
| 1527 | | DNA | Glycine max | Predicted polypeptide sequence is orthologous to G1134 |
| 1528 | | DNA | Glycine max | Predicted polypeptide sequence is orthologous to G1134 |
| 1529 | | DNA | Oryza sativa | Predicted polypeptide sequence is orthologous to G1134 |
| 1530 | | DNA | Glycine max | Predicted polypeptide sequence is orthologous to G1145 |
| 1531 | | DNA | Glycine max | Predicted polypeptide sequence is orthologous to G1145 |
| 1532 | | DNA | Glycine max | Predicted polypeptide sequence is orthologous to G1145 |
| 1533 | | DNA | Glycine max | Predicted polypeptide sequence is orthologous to G1145 |
| 1534 | | DNA | Glycine max | Predicted polypeptide sequence is orthologous to G1145 |
| 1535 | | DNA | Glycine max | Predicted polypeptide sequence is orthologous to G1145 |
| 1536 | | DNA | Glycine max | Predicted polypeptide sequence is orthologous to G1145 |
| 1537 | | DNA | Glycine max | Predicted polypeptide sequence is orthologous to G1145 |
| 1538 | | PRT | Oryza sativa | Orthologous to G1145 |
| 1539 | | PRT | Oryza sativa | Orthologous to G1145 |
| 1540 | | PRT | Oryza sativa | Orthologous to G1145 |
| 1541 | | PRT | Oryza sativa | Orthologous to G1145 |
| 1542 | | PRT | Oryza sativa | Orthologous to G1145 |
| 1543 | | PRT | Oryza sativa | Orthologous to G1145 |
| 1544 | | DNA | Oryza sativa | Predicted polypeptide sequence is orthologous to G1145 |
| 1545 | | DNA | Zea mays | Predicted polypeptide sequence is orthologous to G1145 |
| 1546 | | DNA | Zea mays | Predicted polypeptide sequence is orthologous to G1145 |
| 1547 | | DNA | Zea mays | Predicted polypeptide sequence is orthologous to G1145 |
| 1548 | | DNA | Zea mays | Predicted polypeptide sequence is orthologous to G1145 |
| 1549 | | DNA | Zea mays | Predicted polypeptide sequence is orthologous to G1145 |
| 1550 | | DNA | Glycine max | Predicted polypeptide sequence is orthologous to G1198 |
| 1551 | | DNA | Glycine max | Predicted polypeptide sequence is orthologous to G1198 |
| 1552 | | DNA | Glycine max | Predicted polypeptide sequence is orthologous to G1198 |
| 1553 | | DNA | Glycine max | Predicted polypeptide sequence is orthologous to G1198 |
| 1554 | | DNA | Glycine max | Predicted polypeptide sequence is orthologous to G1198 |
| 1555 | | DNA | Glycine max | Predicted polypeptide sequence is orthologous to G1198 |
| 1556 | | DNA | Glycine max | Predicted polypeptide sequence is orthologous to G1198 |
| 1557 | | DNA | Glycine max | Predicted polypeptide sequence is orthologous to G1198 |
| 1558 | | DNA | Oryza sativa | Predicted polypeptide sequence is orthologous to G1198 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1559 | | DNA | Oryza sativa | Predicted polypeptide sequence is orthologous to G1198 |
| 1560 | | DNA | Oryza sativa | Predicted polypeptide sequence is orthologous to G1198 |
| 1561 | | DNA | Oryza sativa | Predicted polypeptide sequence is orthologous to G1198 |
| 1562 | | DNA | Oryza sativa | Predicted polypeptide sequence is orthologous to G1198 |
| 1563 | | PRT | Oryza sativa | Orthologous to G1198 |
| 1564 | | PRT | Oryza sativa | Orthologous to G1198 |
| 1565 | | PRT | Oryza sativa | Orthologous to G1198 |
| 1566 | | PRT | Oryza sativa | Orthologous to G1198 |
| 1567 | | PRT | Oryza sativa | Orthologous to G1198 |
| 1568 | | PRT | Oryza sativa | Orthologous to G1198 |
| 1569 | | PRT | Oryza sativa | Orthologous to G1198 |
| 1570 | | DNA | Zea mays | Predicted polypeptide sequence is orthologous to G1198 |
| 1571 | | DNA | Zea mays | Predicted polypeptide sequence is orthologous to G1198 |
| 1572 | | DNA | Zea mays | Predicted polypeptide sequence is orthologous to G1198 |
| 1573 | | DNA | Zea mays | Predicted polypeptide sequence is orthologous to G1198 |
| 1574 | | DNA | Zea mays | Predicted polypeptide sequence is orthologous to G1198 |
| 1575 | | DNA | Zea mays | Predicted polypeptide sequence is orthologous to G1198 |
| 1576 | | DNA | Zea mays | Predicted polypeptide sequence is orthologous to G1198 |
| 1577 | | DNA | Zea mays | Predicted polypeptide sequence is orthologous to G1198 |
| 1578 | | DNA | Zea mays | Predicted polypeptide sequence is orthologous to G1198 |
| 1579 | | DNA | Zea mays | Predicted polypeptide sequence is orthologous to G1198 |
| 1580 | | DNA | Glycine max | Predicted polypeptide sequence is orthologous to G1242 |
| 1581 | | DNA | Oryza sativa | Predicted polypeptide sequence is orthologous to G1242 |
| 1582 | | PRT | Oryza sativa | Orthologous to G1242 |
| 1583 | | PRT | Oryza sativa | Orthologous to G1242 |
| 1584 | | DNA | Zea mays | Predicted polypeptide sequence is orthologous to G1242 |
| 1585 | | DNA | Zea mays | Predicted polypeptide sequence is orthologous to G1242 |
| 1586 | | DNA | Glycine max | Predicted polypeptide sequence is orthologous to G1255 |
| 1587 | | DNA | Glycine max | Predicted polypeptide sequence is orthologous to G1255 |
| 1588 | | DNA | Glycine max | Predicted polypeptide sequence is orthologous to G1255 |
| 1589 | | DNA | Glycine max | Predicted polypeptide sequence is orthologous to G1255 |
| 1590 | | DNA | Glycine max | Predicted polypeptide sequence is orthologous to G1255 |
| 1591 | | DNA | Glycine max | Predicted polypeptide sequence is orthologous to G1255 |
| 1592 | | DNA | Glycine max | Predicted polypeptide sequence is orthologous to G1255 |
| 1593 | | DNA | Oryza sativa | Predicted polypeptide sequence is orthologous to G1255 |
| 1594 | | PRT | Oryza sativa | Orthologous to G1255 |
| 1595 | | DNA | Oryza sativa | Predicted polypeptide sequence is orthologous to G1255 |
| 1596 | | DNA | Oryza sativa | Predicted polypeptide sequence is orthologous to G1255 |
| 1597 | | DNA | Oryza sativa | Predicted polypeptide sequence is orthologous to G1255 |
| 1598 | | DNA | Zea mays | Predicted polypeptide sequence is orthologous to G1255 |
| 1599 | | DNA | Zea mays | Predicted polypeptide sequence is orthologous to G1255 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1600 | | DNA | Zea mays | Predicted polypeptide sequence is orthologous to G1255 |
| 1601 | | DNA | Zea mays | Predicted polypeptide sequence is orthologous to G1255 |
| 1602 | | DNA | Zea mays | Predicted polypeptide sequence is orthologous to G1255 |
| 1603 | | DNA | Zea mays | Predicted polypeptide sequence is orthologous to G1255 |
| 1604 | | DNA | Glycine max | Predicted polypeptide sequence is orthologous to G1266 |
| 1605 | | DNA | Glycine max | Predicted polypeptide sequence is orthologous to G1266 |
| 1606 | | DNA | Glycine max | Predicted polypeptide sequence is orthologous to G1266 |
| 1607 | | DNA | Glycine max | Predicted polypeptide sequence is orthologous to G1266 |
| 1608 | | DNA | Oryza sativa | Predicted polypeptide sequence is orthologous to G1266 |
| 1609 | | DNA | Glycine max | Predicted polypeptide sequence is orthologous to G1274 |
| 1610 | | DNA | Glycine max | Predicted polypeptide sequence is orthologous to G1274 |
| 1611 | | PRT | Oryza sativa | Orthologous to G1274 |
| 1612 | | PRT | Oryza sativa | Orthologous to G1274 |
| 1613 | | DNA | Zea mays | Predicted polypeptide sequence is orthologous to G1274 |
| 1614 | | DNA | Zea mays | Predicted polypeptide sequence is orthologous to G1274 |
| 1615 | | DNA | Zea mays | Predicted polypeptide sequence is orthologous to G1274 |
| 1616 | | DNA | Zea mays | Predicted polypeptide sequence is orthologous to G1274 |
| 1617 | | DNA | Oryza sativa | Predicted polypeptide sequence is orthologous to G1275 |
| 1618 | | PRT | Oryza sativa | Orthologous to G1275 |
| 1619 | | PRT | Oryza sativa | Orthologous to G1275 |
| 1620 | | PRT | Oryza sativa | Orthologous to G1275 |
| 1621 | | DNA | Zea mays | Predicted polypeptide sequence is orthologous to G1275 |
| 1622 | | DNA | Zea mays | Predicted polypeptide sequence is orthologous to G1275 |
| 1623 | | DNA | Zea mays | Predicted polypeptide sequence is orthologous to G1275 |
| 1624 | | DNA | Glycine max | Predicted polypeptide sequence is orthologous to G1313 |
| 1625 | | DNA | Oryza sativa | Predicted polypeptide sequence is orthologous to G1313 |
| 1626 | | PRT | Oryza sativa | Orthologous to G1313 |
| 1627 | | PRT | Oryza sativa | Orthologous to G1313 |
| 1628 | | DNA | Zea mays | Predicted polypeptide sequence is orthologous to G1313 |
| 1629 | | DNA | Zea mays | Predicted polypeptide sequence is orthologous to G1313 |
| 1630 | | DNA | Zea mays | Predicted polypeptide sequence is orthologous to G1313 |
| 1631 | | DNA | Glycine max | Predicted polypeptide sequence is orthologous to G1322 |
| 1632 | | DNA | Glycine max | Predicted polypeptide sequence is orthologous to G1322 |
| 1633 | | DNA | Glycine max | Predicted polypeptide sequence is orthologous to G1322 |
| 1634 | | DNA | Oryza sativa | Predicted polypeptide sequence is orthologous to G1322 |
| 1635 | | PRT | Oryza sativa | Orthologous to G1322 |
| 1636 | | PRT | Oryza sativa | Orthologous to G1322 |
| 1637 | | DNA | Zea mays | Predicted polypeptide sequence is orthologous to G1323 |
| 1638 | | DNA | Zea mays | Predicted polypeptide sequence is orthologous to G1323 |
| 1639 | | DNA | Glycine max | Predicted polypeptide sequence is orthologous to G1417 |
| 1640 | | PRT | Oryza sativa | Orthologous to G1417 |
| 1641 | | PRT | Oryza sativa | Orthologous to G1417 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
| --- | --- | --- | --- | --- |
| 1642 | | DNA | Glycine max | Predicted polypeptide sequence is orthologous to G1449 |
| 1643 | | DNA | Glycine max | Predicted polypeptide sequence is orthologous to G1449 |
| 1644 | | DNA | Oryza sativa | Predicted polypeptide sequence is orthologous to G1449 |
| 1645 | | DNA | Oryza sativa | Predicted polypeptide sequence is orthologous to G1449 |
| 1646 | | DNA | Zea mays | Predicted polypeptide sequence is orthologous to G1449 |
| 1647 | | DNA | Zea mays | Predicted polypeptide sequence is orthologous to G1449 |
| 1648 | | DNA | Zea mays | Predicted polypeptide sequence is orthologous to G1449 |
| 1649 | | DNA | Zea mays | Predicted polypeptide sequence is orthologous to G1449 |
| 1650 | | DNA | Glycine max | Predicted polypeptide sequence is orthologous to G1451 |
| 1651 | | DNA | Glycine max | Predicted polypeptide sequence is orthologous to G1451 |
| 1652 | | DNA | Oryza sativa | Predicted polypeptide sequence is orthologous to G1451 |
| 1653 | | DNA | Oryza sativa | Predicted polypeptide sequence is orthologous to G1451 |
| 1654 | | DNA | Oryza sativa | Predicted polypeptide sequence is orthologous to G1451 |
| 1655 | | PRT | Oryza sativa | Orthologous to G1451 |
| 1656 | | PRT | Oryza sativa | Orthologous to G1451 |
| 1657 | | PRT | Oryza sativa | Orthologous to G1451 |
| 1658 | | PRT | Oryza sativa | Orthologous to G1451 |
| 1659 | | DNA | Zea mays | Predicted polypeptide sequence is orthologous to G1451 |
| 1660 | | DNA | Zea mays | Predicted polypeptide sequence is orthologous to G1451 |
| 1661 | | DNA | Zea mays | Predicted polypeptide sequence is orthologous to G1451 |
| 1662 | | DNA | Zea mays | Predicted polypeptide sequence is orthologous to G1451 |
| 1663 | | DNA | Glycine max | Predicted polypeptide sequence is orthologous to G1482 |
| 1664 | | DNA | Glycine max | Predicted polypeptide sequence is orthologous to G1482 |
| 1665 | | DNA | Glycine max | Predicted polypeptide sequence is orthologous to G1482 |
| 1666 | | DNA | Glycine max | Predicted polypeptide sequence is orthologous to G1482 |
| 1667 | | DNA | Glycine max | Predicted polypeptide sequence is orthologous to G1482 |
| 1668 | | DNA | Oryza sativa | Predicted polypeptide sequence is orthologous to G1482 |
| 1669 | | DNA | Oryza sativa | Predicted polypeptide sequence is orthologous to G1482 |
| 1670 | | DNA | Oryza sativa | Predicted polypeptide sequence is orthologous to G1482 |
| 1671 | | DNA | Oryza sativa | Predicted polypeptide sequence is orthologous to G1482 |
| 1672 | | PRT | Oryza sativa | Orthologous to G1482 |
| 1673 | | PRT | Oryza sativa | Orthologous to G1482 |
| 1674 | | DNA | Zea mays | Predicted polypeptide sequence is orthologous to G1482 |
| 1675 | | DNA | Zea mays | Predicted polypeptide sequence is orthologous to G1482 |
| 1676 | | DNA | Zea mays | Predicted polypeptide sequence is orthologous to G1482 |
| 1677 | | DNA | Zea mays | Predicted polypeptide sequence is orthologous to G1482 |
| 1678 | | DNA | Zea mays | Predicted polypeptide sequence is orthologous to G1482 |
| 1679 | | DNA | Zea mays | Predicted polypeptide sequence is orthologous to G1482 |
| 1680 | | PRT | Oryza sativa | Orthologous to G1499 |
| 1681 | | DNA | Glycine max | Predicted polypeptide sequence is orthologous to G1540 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1682 | | PRT | Oryza sativa | Orthologous to G1540 |
| 1683 | | DNA | Glycine max | Predicted polypeptide sequence is orthologous to G1560 |
| 1684 | | DNA | Glycine max | Predicted polypeptide sequence is orthologous to G1560 |
| 1685 | | DNA | Oryza sativa | Predicted polypeptide sequence is orthologous to G1560 |
| 1686 | | PRT | Oryza sativa | Orthologous to G1560 |
| 1687 | | PRT | Oryza sativa | Orthologous to G1560 |
| 1688 | | PRT | Oryza sativa | Orthologous to G1560 |
| 1689 | | PRT | Oryza sativa | Orthologous to G1560 |
| 1690 | | DNA | Zea mays | Predicted polypeptide sequence is orthologous to G1560 |
| 1691 | | DNA | Zea mays | Predicted polypeptide sequence is orthologous to G1560 |
| 1692 | | DNA | Zea mays | Predicted polypeptide sequence is orthologous to G1560 |
| 1693 | | DNA | Zea mays | Predicted polypeptide sequence is orthologous to G1560 |
| 1694 | | DNA | Zea mays | Predicted polypeptide sequence is orthologous to G1560 |
| 1695 | | DNA | Zea mays | Predicted polypeptide sequence is orthologous to G1560 |
| 1696 | | PRT | Oryza sativa | Orthologous to G1645 |
| 1697 | | DNA | Zea mays | Predicted polypeptide sequence is orthologous to G1645 |
| 1698 | | DNA | Zea mays | Predicted polypeptide sequence is orthologous to G1645 |
| 1699 | | DNA | Zea mays | Predicted polypeptide sequence is orthologous to G1645 |
| 1700 | | DNA | Glycine max | Predicted polypeptide sequence is orthologous to G1760 |
| 1701 | | DNA | Glycine max | Predicted polypeptide sequence is orthologous to G1760 |
| 1702 | | PRT | Oryza sativa | Orthologous to G1760 |
| 1703 | | PRT | Oryza sativa | Orthologous to G1760 |
| 1704 | | DNA | Zea mays | Predicted polypeptide sequence is orthologous to G1760 |
| 1705 | | DNA | Zea mays | Predicted polypeptide sequence is orthologous to G1760 |
| 1706 | | DNA | Zea mays | Predicted polypeptide sequence is orthologous to G1760 |
| 1707 | | DNA | Oryza sativa | Predicted polypeptide sequence is orthologous to G1816 |
| 1708 | | DNA | Glycine max | Predicted polypeptide sequence is orthologous to G2010, G2347 |
| 1709 | | DNA | Oryza sativa | Predicted polypeptide sequence is orthologous to G2010, G2347 |
| 1710 | | DNA | Zea mays | Predicted polypeptide sequence is orthologous to G2010 |
| 1711 | | DNA | Zea mays | Predicted polypeptide sequence is orthologous to G2010, G2347 |
| 1712 | G5 | DNA | Arabidopsis thaliana | Predicted polypeptide sequence is paralogous to G974 |
| 1713 | G5 | PRT | Arabidopsis thaliana | Paralogous to G974 |
| 1714 | G9 | DNA | Arabidopsis thaliana | Predicted polypeptide sequence is paralogous to G867 |
| 1715 | G9 | PRT | Arabidopsis thaliana | Paralogous to G867 |
| 1716 | G12 | DNA | Arabidopsis thaliana | Predicted polypeptide sequence is paralogous to G24 |
| 1717 | G12 | PRT | Arabidopsis thaliana | Paralogous to G24 |
| 1718 | G29 | DNA | Arabidopsis thaliana | Predicted polypeptide sequence is paralogous to G46 |
| 1719 | G29 | PRT | Arabidopsis thaliana | Paralogous to G46 |
| 1720 | G40 | DNA | Arabidopsis thaliana | Predicted polypeptide sequence is paralogous to G912 |
| 1721 | G40 | PRT | Arabidopsis thaliana | Paralogous to G912 |
| 1722 | G41 | DNA | Arabidopsis thaliana | Predicted polypeptide sequence is paralogous to G912 |
| 1723 | G41 | PRT | Arabidopsis thaliana | Paralogous to G912 |
| 1724 | G42 | DNA | Arabidopsis thaliana | Predicted polypeptide sequence is paralogous to G912 |
| 1725 | G42 | PRT | Arabidopsis thaliana | Paralogous to G912 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1726 | G43 | DNA | *Arabidopsis thaliana* | Predicted polypeptide sequence is paralogous to G46 |
| 1727 | G43 | PRT | *Arabidopsis thaliana* | Paralogous to G46 |
| 1728 | G149 | DNA | *Arabidopsis thaliana* | Predicted polypeptide sequence is paralogous to G627 |
| 1729 | G149 | PRT | *Arabidopsis thaliana* | Paralogous to G627 |
| 1730 | G152 | DNA | *Arabidopsis thaliana* | Predicted polypeptide sequence is paralogous to G1760 |
| 1731 | G152 | PRT | *Arabidopsis thaliana* | Paralogous to G1760 |
| 1732 | G153 | DNA | *Arabidopsis thaliana* | Predicted polypeptide sequence is paralogous to G1760 |
| 1733 | G153 | PRT | *Arabidopsis thaliana* | Paralogous to G1760 |
| 1734 | G157 | DNA | *Arabidopsis thaliana* | Predicted polypeptide sequence is paralogous to G859, G1842, G1843 |
| 1735 | G157 | PRT | *Arabidopsis thaliana* | Paralogous to G859, G1842, G1843 |
| 1736 | G175 | DNA | *Arabidopsis thaliana* | Predicted polypeptide sequence is paralogous to G877 |
| 1737 | G175 | PRT | *Arabidopsis thaliana* | Paralogous to G877 |
| 1738 | G182 | DNA | *Arabidopsis thaliana* | Predicted polypeptide sequence is paralogous to G196 |
| 1739 | G182 | PRT | *Arabidopsis thaliana* | Paralogous to G196 |
| 1740 | G197 | DNA | *Arabidopsis thaliana* | Predicted polypeptide sequence is paralogous to G664 |
| 1741 | G197 | PRT | *Arabidopsis thaliana* | Paralogous to G664 |
| 1742 | G212 | DNA | *Arabidopsis thaliana* | Predicted polypeptide sequence is paralogous to G676 |
| 1743 | G212 | PRT | *Arabidopsis thaliana* | Paralogous to G676 |
| 1744 | G214 | DNA | *Arabidopsis thaliana* | Predicted polypeptide sequence is paralogous to G680 |
| 1745 | G214 | PRT | *Arabidopsis thaliana* | Paralogous to G680 |
| 1746 | G221 | DNA | *Arabidopsis thaliana* | Predicted polypeptide sequence is paralogous to G1322 |
| 1747 | G221 | PRT | *Arabidopsis thaliana* | Paralogous to G1322 |
| 1748 | G225 | DNA | *Arabidopsis thaliana* | Predicted polypeptide sequence is paralogous to G226, G682, G1816, G2718 |
| 1749 | G225 | PRT | *Arabidopsis thaliana* | Paralogous to G226, G682, G1816, G2718 |
| 1750 | G226 | DNA | *Arabidopsis thaliana* | Predicted polypeptide sequence is paralogous to G682, G1816, G2718 |
| 1751 | G226 | PRT | *Arabidopsis thaliana* | Paralogous to G682, G1816, G2718 |
| 1752 | G228 | DNA | *Arabidopsis thaliana* | Predicted polypeptide sequence is paralogous to G254 |
| 1753 | G228 | PRT | *Arabidopsis thaliana* | Paralogous to G254 |
| 1754 | G233 | DNA | *Arabidopsis thaliana* | Predicted polypeptide sequence is paralogous to G241 |
| 1755 | G233 | PRT | *Arabidopsis thaliana* | Paralogous to G241 |
| 1756 | G247 | DNA | *Arabidopsis thaliana* | Predicted polypeptide sequence is paralogous to G676 |
| 1757 | G247 | PRT | *Arabidopsis thaliana* | Paralogous to G676 |
| 1758 | G249 | DNA | *Arabidopsis thaliana* | Predicted polypeptide sequence is paralogous to G1322 |
| 1759 | G249 | PRT | *Arabidopsis thaliana* | Paralogous to G1322 |
| 1760 | G255 | DNA | *Arabidopsis thaliana* | Predicted polypeptide sequence is paralogous to G664 |
| 1761 | G255 | PRT | *Arabidopsis thaliana* | Paralogous to G664 |
| 1762 | G350 | DNA | *Arabidopsis thaliana* | Predicted polypeptide sequence is paralogous to G545 |
| 1763 | G350 | PRT | *Arabidopsis thaliana* | Paralogous to G545 |
| 1764 | G351 | DNA | *Arabidopsis thaliana* | Predicted polypeptide sequence is paralogous to G545 |
| 1765 | G351 | PRT | *Arabidopsis thaliana* | Paralogous to G545 |
| 1766 | G362 | DNA | *Arabidopsis thaliana* | Predicted polypeptide sequence is paralogous to G361 |
| 1767 | G362 | PRT | *Arabidopsis thaliana* | Paralogous to G361 |
| 1768 | G370 | DNA | *Arabidopsis thaliana* | Predicted polypeptide sequence is paralogous to G361 |
| 1769 | G370 | PRT | *Arabidopsis thaliana* | Paralogous to G361 |
| 1770 | G390 | DNA | *Arabidopsis thaliana* | Predicted polypeptide sequence is paralogous to G438 |
| 1771 | G390 | PRT | *Arabidopsis thaliana* | Paralogous to G438 |
| 1772 | G391 | DNA | *Arabidopsis thaliana* | Predicted polypeptide sequence is paralogous to G390, G438 |
| 1773 | G391 | PRT | *Arabidopsis thaliana* | Paralogous to G390, G438 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1774 | G392 | DNA | *Arabidopsis thaliana* | Predicted polypeptide sequence is paralogous to G390, G438 |
| 1775 | G392 | PRT | *Arabidopsis thaliana* | Paralogous to G390, G438 |
| 1776 | G438 | DNA | *Arabidopsis thaliana* | Predicted polypeptide sequence is paralogous to G390 |
| 1777 | G438 | PRT | *Arabidopsis thaliana* | Paralogous to G390 |
| 1778 | G440 | DNA | *Arabidopsis thaliana* | Predicted polypeptide sequence is paralogous to G864 |
| 1779 | G440 | PRT | *Arabidopsis thaliana* | Paralogous to G864 |
| 1780 | G463 | DNA | *Arabidopsis thaliana* | Predicted polypeptide sequence is paralogous to G464 |
| 1781 | G463 | PRT | *Arabidopsis thaliana* | Paralogous to G464 |
| 1782 | G481 | DNA | *Arabidopsis thaliana* | Predicted polypeptide sequence is paralogous to G482 |
| 1783 | G481 | PRT | *Arabidopsis thaliana* | Paralogous to G482 |
| 1784 | G485 | DNA | *Arabidopsis thaliana* | Predicted polypeptide sequence is paralogous to G482 |
| 1785 | G485 | PRT | *Arabidopsis thaliana* | Paralogous to G482 |
| 1786 | G554 | DNA | *Arabidopsis thaliana* | Predicted polypeptide sequence is paralogous to G1198 |
| 1787 | G554 | PRT | *Arabidopsis thaliana* | Paralogous to G1198 |
| 1788 | G555 | DNA | *Arabidopsis thaliana* | Predicted polypeptide sequence is paralogous to G1198 |
| 1789 | G555 | PRT | *Arabidopsis thaliana* | Paralogous to G1198 |
| 1790 | G556 | DNA | *Arabidopsis thaliana* | Predicted polypeptide sequence is paralogous to G1198 |
| 1791 | G556 | PRT | *Arabidopsis thaliana* | Paralogous to G1198 |
| 1792 | G558 | DNA | *Arabidopsis thaliana* | Predicted polypeptide sequence is paralogous to G1198 |
| 1793 | G558 | PRT | *Arabidopsis thaliana* | Paralogous to G1198 |
| 1794 | G578 | DNA | *Arabidopsis thaliana* | Predicted polypeptide sequence is paralogous to G1198 |
| 1795 | G578 | PRT | *Arabidopsis thaliana* | Paralogous to G1198 |
| 1796 | G610 | DNA | *Arabidopsis thaliana* | Predicted polypeptide sequence is paralogous to G849 |
| 1797 | G610 | PRT | *Arabidopsis thaliana* | Paralogous to G849 |
| 1798 | G629 | DNA | *Arabidopsis thaliana* | Predicted polypeptide sequence is paralogous to G1198 |
| 1799 | G629 | PRT | *Arabidopsis thaliana* | Paralogous to G1198 |
| 1800 | G659 | DNA | *Arabidopsis thaliana* | Predicted polypeptide sequence is paralogous to G1323 |
| 1801 | G659 | PRT | *Arabidopsis thaliana* | Paralogous to G1323 |
| 1802 | G666 | DNA | *Arabidopsis thaliana* | Predicted polypeptide sequence is paralogous to G256 |
| 1803 | G666 | PRT | *Arabidopsis thaliana* | Paralogous to G256 |
| 1804 | G668 | DNA | *Arabidopsis thaliana* | Predicted polypeptide sequence is paralogous to G256 |
| 1805 | G668 | PRT | *Arabidopsis thaliana* | Paralogous to G256 |
| 1806 | G680 | DNA | *Arabidopsis thaliana* | Predicted polypeptide sequence is paralogous to G214 |
| 1807 | G680 | PRT | *Arabidopsis thaliana* | Paralogous to G214 |
| 1808 | G682 | DNA | *Arabidopsis thaliana* | Predicted polypeptide sequence is paralogous to G226, G1816, G2718 |
| 1809 | G682 | PRT | *Arabidopsis thaliana* | Paralogous to G226, G1816, G2718 |
| 1810 | G714 | DNA | *Arabidopsis thaliana* | Predicted polypeptide sequence is paralogous to G489 |
| 1811 | G714 | PRT | *Arabidopsis thaliana* | Paralogous to G489 |
| 1812 | G859 | DNA | *Arabidopsis thaliana* | Predicted polypeptide sequence is paralogous to G157, G1842, G1843 |
| 1813 | G859 | PRT | *Arabidopsis thaliana* | Paralogous to G157, G1842, G1843 |
| 1814 | G860 | DNA | *Arabidopsis thaliana* | Predicted polypeptide sequence is paralogous to G1760 |
| 1815 | G860 | PRT | *Arabidopsis thaliana* | Paralogous to G1760 |
| 1816 | G913 | DNA | *Arabidopsis thaliana* | Predicted polypeptide sequence is paralogous to G912 |
| 1817 | G913 | PRT | *Arabidopsis thaliana* | Paralogous to G912 |
| 1818 | G914 | DNA | *Arabidopsis thaliana* | Predicted polypeptide sequence is paralogous to G971 |
| 1819 | G914 | PRT | *Arabidopsis thaliana* | Paralogous to G971 |
| 1820 | G932 | DNA | *Arabidopsis thaliana* | Predicted polypeptide sequence is paralogous to G256 |
| 1821 | G932 | PRT | *Arabidopsis thaliana* | Paralogous to G256 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1822 | G957 | DNA | *Arabidopsis thaliana* | Predicted polypeptide sequence is paralogous to G961 |
| 1823 | G957 | PRT | *Arabidopsis thaliana* | Paralogous to G961 |
| 1824 | G986 | DNA | *Arabidopsis thaliana* | Predicted polypeptide sequence is paralogous to G881 |
| 1825 | G986 | PRT | *Arabidopsis thaliana* | Paralogous to G881 |
| 1826 | G990 | DNA | *Arabidopsis thaliana* | Predicted polypeptide sequence is paralogous to G1451 |
| 1827 | G990 | PRT | *Arabidopsis thaliana* | Paralogous to G1451 |
| 1828 | G993 | DNA | *Arabidopsis thaliana* | Predicted polypeptide sequence is paralogous to G867 |
| 1829 | G993 | PRT | *Arabidopsis thaliana* | Paralogous to G867 |
| 1830 | G1004 | DNA | *Arabidopsis thaliana* | Predicted polypeptide sequence is paralogous to G46 |
| 1831 | G1004 | PRT | *Arabidopsis thaliana* | Paralogous to G46 |
| 1832 | G1006 | DNA | *Arabidopsis thaliana* | Predicted polypeptide sequence is paralogous to G28 |
| 1833 | G1006 | PRT | *Arabidopsis thaliana* | Paralogous to G28 |
| 1834 | G1051 | DNA | *Arabidopsis thaliana* | Predicted polypeptide sequence is paralogous to G1052 |
| 1835 | G1051 | PRT | *Arabidopsis thaliana* | Paralogous to G1052 |
| 1836 | G1056 | DNA | *Arabidopsis thaliana* | Predicted polypeptide sequence is paralogous to G1145 |
| 1837 | G1056 | PRT | *Arabidopsis thaliana* | Paralogous to G1145 |
| 1838 | G1067 | DNA | *Arabidopsis thaliana* | Predicted polypeptide sequence is paralogous to G1073 |
| 1839 | G1067 | PRT | *Arabidopsis thaliana* | Paralogous to G1073 |
| 1840 | G1076 | DNA | *Arabidopsis thaliana* | Predicted polypeptide sequence is paralogous to G1075 |
| 1841 | G1076 | PRT | *Arabidopsis thaliana* | Paralogous to G1075 |
| 1842 | G1136 | DNA | *Arabidopsis thaliana* | Predicted polypeptide sequence is paralogous to G584 |
| 1843 | G1136 | PRT | *Arabidopsis thaliana* | Paralogous to G584 |
| 1844 | G1211 | DNA | *Arabidopsis thaliana* | Predicted polypeptide sequence is paralogous to G291 |
| 1845 | G1211 | PRT | *Arabidopsis thaliana* | Paralogous to G291 |
| 1846 | G1243 | DNA | *Arabidopsis thaliana* | Predicted polypeptide sequence is paralogous to G1242 |
| 1847 | G1243 | PRT | *Arabidopsis thaliana* | Paralogous to G1242 |
| 1848 | G1277 | DNA | *Arabidopsis thaliana* | Predicted polypeptide sequence is paralogous to G24 |
| 1849 | G1277 | PRT | *Arabidopsis thaliana* | Paralogous to G24 |
| 1850 | G1325 | DNA | *Arabidopsis thaliana* | Predicted polypeptide sequence is paralogous to G1313 |
| 1851 | G1325 | PRT | *Arabidopsis thaliana* | Paralogous to G1313 |
| 1852 | G1329 | DNA | *Arabidopsis thaliana* | Predicted polypeptide sequence is paralogous to G663 |
| 1853 | G1329 | PRT | *Arabidopsis thaliana* | Paralogous to G663 |
| 1854 | G1349 | DNA | *Arabidopsis thaliana* | Predicted polypeptide sequence is paralogous to G896 |
| 1855 | G1349 | PRT | *Arabidopsis thaliana* | Paralogous to G896 |
| 1856 | G1364 | DNA | *Arabidopsis thaliana* | Predicted polypeptide sequence is paralogous to G482 |
| 1857 | G1364 | PRT | *Arabidopsis thaliana* | Paralogous to G482 |
| 1858 | G1379 | DNA | *Arabidopsis thaliana* | Predicted polypeptide sequence is paralogous to G24 |
| 1859 | G1379 | PRT | *Arabidopsis thaliana* | Paralogous to G24 |
| 1860 | G1387 | DNA | *Arabidopsis thaliana* | Predicted polypeptide sequence is paralogous to G975 |
| 1861 | G1387 | PRT | *Arabidopsis thaliana* | Paralogous to C975 |
| 1862 | G1419 | DNA | *Arabidopsis thaliana* | Predicted polypeptide sequence is paralogous to G46 |
| 1863 | G1419 | PRT | *Arabidopsis thaliana* | Paralogous to G46 |
| 1864 | G1484 | DNA | *Arabidopsis thaliana* | Predicted polypeptide sequence is paralogous to G1255 |
| 1865 | G1484 | PRT | *Arabidopsis thaliana* | Paralogous to G1255 |
| 1866 | G1494 | DNA | *Arabidopsis thaliana* | Predicted polypeptide sequence is paralogous to G789 |
| 1867 | G1494 | PRT | *Arabidopsis thaliana* | Paralogous to G789 |
| 1868 | G1548 | DNA | *Arabidopsis thaliana* | Predicted polypeptide sequence is paralogous to G390, G438 |
| 1869 | G1548 | PRT | *Arabidopsis thaliana* | Paralogous to G390, G438 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1870 | G1664 | DNA | *Arabidopsis thaliana* | Predicted polypeptide sequence is paralogous to G1062 |
| 1871 | G1664 | PRT | *Arabidopsis thaliana* | Paralogous to G1062 |
| 1872 | G1750 | DNA | *Arabidopsis thaliana* | Predicted polypeptide sequence is paralogous to G864 |
| 1873 | G1750 | PRT | *Arabidopsis thaliana* | Paralogous to G864 |
| 1874 | G1759 | DNA | *Arabidopsis thaliana* | Predicted polypeptide sequence is paralogous to G157, G859, G1842, G1843 |
| 1875 | G1759 | PRT | *Arabidopsis thaliana* | Paralogous to G157, G859, G1842, G1843 |
| 1876 | G1785 | DNA | *Arabidopsis thaliana* | Predicted polypeptide sequence is paralogous to G248 |
| 1877 | G1785 | PRT | *Arabidopsis thaliana* | Paralogous to G248 |
| 1878 | G1806 | DNA | *Arabidopsis thaliana* | Predicted polypeptide sequence is paralogous to G1198 |
| 1879 | G1806 | PRT | *Arabidopsis thaliana* | Paralogous to G1198 |
| 1880 | G1816 | DNA | *Arabidopsis thaliana* | Predicted polypeptide sequence is paralogous to G226, G682, G2718 |
| 1881 | G1816 | PRT | *Arabidopsis thaliana* | Paralogous to G226, G682, G2718 |
| 1882 | G1842 | DNA | *Arabidopsis thaliana* | Predicted polypeptide sequence is paralogous to G157, G859, G1843 |
| 1883 | G1842 | PRT | *Arabidopsis thaliana* | Paralogous to G157, G859, G1843 |
| 1884 | G1843 | DNA | *Arabidopsis thaliana* | Predicted polypeptide sequence is paralogous to G157, G859, G1842 |
| 1885 | G1843 | PRT | *Arabidopsis thaliana* | Paralogous to G157, G859, G1842 |
| 1886 | G1844 | DNA | *Arabidopsis thaliana* | Predicted polypeptide sequence is paralogous to G157, G859, G1842, G1843 |
| 1887 | G1844 | PRT | *Arabidopsis thaliana* | Paralogous to G157, G859, G1842, G1843 |
| 1888 | G1887 | DNA | *Arabidopsis thaliana* | Predicted polypeptide sequence is paralogous to G896 |
| 1889 | G1887 | PRT | *Arabidopsis thaliana* | Paralogous to G896 |
| 1890 | G1888 | DNA | *Arabidopsis thaliana* | Predicted polypeptide sequence is paralogous to G1482 |
| 1891 | G1888 | PRT | *Arabidopsis thaliana* | Paralogous to G1482 |
| 1892 | G1930 | DNA | *Arabidopsis thaliana* | Predicted polypeptide sequence is paralogous to G867 |
| 1893 | G1930 | PRT | *Arabidopsis thaliana* | Paralogous to G867 |
| 1894 | G1995 | DNA | *Arabidopsis thaliana* | Predicted polypeptide sequence is paralogous to G361 |
| 1895 | G1995 | PRT | *Arabidopsis thaliana* | Paralogous to G361 |
| 1896 | G1998 | DNA | *Arabidopsis thaliana* | Predicted polypeptide sequence is paralogous to G325 |
| 1897 | G1998 | PRT | *Arabidopsis thaliana* | Paralogous to G325 |
| 1898 | G2010 | DNA | *Arabidopsis thaliana* | Predicted polypeptide sequence is paralogous to G2347 |
| 1899 | G2010 | PRT | *Arabidopsis thaliana* | Paralogous to G2347 |
| 1900 | G2106 | DNA | *Arabidopsis thaliana* | Predicted polypeptide sequence is paralogous to G979 |
| 1901 | G2106 | PRT | *Arabidopsis thaliana* | Paralogous to G979 |
| 1902 | G2107 | DNA | *Arabidopsis thaliana* | Predicted polypeptide sequence is paralogous to G912 |
| 1903 | G2107 | PRT | *Arabidopsis thaliana* | Paralogous to G912 |
| 1904 | G2131 | DNA | *Arabidopsis thaliana* | Predicted polypeptide sequence is paralogous to G979 |
| 1905 | G2131 | PRT | *Arabidopsis thaliana* | Paralogous to G979 |
| 1906 | G2153 | DNA | *Arabidopsis thaliana* | Predicted polypeptide sequence is paralogous to G1069 |
| 1907 | G2153 | PRT | *Arabidopsis thaliana* | Paralogous to G1069 |
| 1908 | G2156 | DNA | *Arabidopsis thaliana* | Predicted polypeptide sequence is paralogous to G1073 |
| 1909 | G2156 | PRT | *Arabidopsis thaliana* | Paralogous to G1073 |
| 1910 | G2345 | DNA | *Arabidopsis thaliana* | Predicted polypeptide sequence is paralogous to G482 |
| 1911 | G2345 | PRT | *Arabidopsis thaliana* | Paralogous to G482 |
| 1912 | G2347 | DNA | *Arabidopsis thaliana* | Predicted polypeptide sequence is paralogous to G2010 |
| 1913 | G2347 | PRT | *Arabidopsis thaliana* | Paralogous to G2010 |
| 1914 | G2421 | DNA | *Arabidopsis thaliana* | Predicted polypeptide sequence is paralogous to G663 |
| 1915 | G2421 | PRT | *Arabidopsis thaliana* | Paralogous to G663 |
| 1916 | G2422 | DNA | *Arabidopsis thaliana* | Predicted polypeptide sequence is paralogous to G663 |
| 1917 | G2422 | PRT | *Arabidopsis thaliana* | Paralogous to G663 |

TABLE 10-continued

Homologous relationships found within the Sequence Listing

| SEQ ID NO: | GID No. | DNA or Protein (PRT) | Species from Which Homologous Sequence is Derived | Relationship of SEQ ID NO: to Other Genes |
|---|---|---|---|---|
| 1918 | G2424 | DNA | Arabidopsis thaliana | Predicted polypeptide sequence is paralogous to G1645 |
| 1919 | G2424 | PRT | Arabidopsis thaliana | Paralogous to G1645 |
| 1920 | G2432 | DNA | Arabidopsis thaliana | Predicted polypeptide sequence is paralogous to G736 |
| 1921 | G2432 | PRT | Arabidopsis thaliana | Paralogous to G736 |
| 1922 | G2513 | DNA | Arabidopsis thaliana | Predicted polypeptide sequence is paralogous to G912 |
| 1923 | G2513 | PRT | Arabidopsis thaliana | Paralogous to G912 |
| 1924 | G2535 | DNA | Arabidopsis thaliana | Predicted polypeptide sequence is paralogous to G961 |
| 1925 | G2535 | PRT | Arabidopsis thaliana | Paralogous to G961 |
| 1926 | G2555 | DNA | Arabidopsis thaliana | Predicted polypeptide sequence is paralogous to G1134 |
| 1927 | G2555 | PRT | Arabidopsis thaliana | Paralogous to G1134 |
| 1928 | G2583 | DNA | Arabidopsis thaliana | Predicted polypeptide sequence is paralogous to G975 |
| 1929 | G2583 | PRT | Arabidopsis thaliana | Paralogous to G975 |
| 1930 | G2701 | DNA | Arabidopsis thaliana | Predicted polypeptide sequence is paralogous to G1634 |
| 1931 | G2701 | PRT | Arabidopsis thaliana | Paralogous to G1634 |
| 1932 | G2718 | DNA | Arabidopsis thaliana | Predicted polypeptide sequence is paralogous to G226, G682, G1816 |
| 1933 | G2718 | PRT | Arabidopsis thaliana | Paralogous to G226, G682, G1816 |
| 1934 | G2826 | DNA | Arabidopsis thaliana | Predicted polypeptide sequence is paralogous to G361 |
| 1935 | G2826 | PRT | Arabidopsis thaliana | Paralogous to G361 |
| 1936 | G2838 | DNA | Arabidopsis thaliana | Predicted polypeptide sequence is paralogous to G361 |
| 1937 | G2838 | PRT | Arabidopsis thaliana | Paralogous to G361 |
| 1938 | G3010 | DNA | Arabidopsis thaliana | Predicted polypeptide sequence is paralogous to G987 |
| 1939 | G3010 | PRT | Arabidopsis thaliana | Paralogous to G987 |
| 1940 | bnCBF1 | DNA | Brassica napus | Predicted polypeptide sequence is orthologous to G40, G41, G42, G912, G2107, G2513 |
| 1941 | bnCBF1 | PRT | Brassica napus | Orthologous to G40, G41, G42, G912, G2107, G2513 |
| 1971 | Soy MADS 1 | PRT | Glycine max | Predicted polypeptide sequence is orthologous to G157, G859, G1842, G1843 |
| 1973 | Soy MADS 3 | PRT | Glycine max | Predicted polypeptide sequence is orthologous to G157, G859, G1842, G1843 |

Molecular Modeling

Another means that may be used to confirm the utility and function of transcription factor sequences that are orthologous or paralogous to presently disclosed transcription factors is through the use of molecular modeling software. Molecular modeling is routinely used to predict polypeptide structure, and a variety of protein structure modeling programs, such as "Insight II" (Accelrys, Inc.) are commercially available for this purpose. Modeling can thus be used to predict which residues of a polypeptide can be changed without altering function (Crameri et al. (2003) U.S. Pat. No. 6,521,453). Thus, polypeptides that are sequentially similar can be shown to have a high likelihood of similar function by their structural similarity, which may, for example, be established by comparison of regions of superstructure. The relative tendencies of amino acids to form regions of superstructure (for example, helixes and β-sheets) are well established. For example, O'Neil et al. (1990) Science 250: 646-651) have discussed in detail the helix forming tendencies of amino acids. Tables of relative structure forming activity for amino acids can be used as substitution tables to predict which residues can be functionally substituted in a given region, for example, in DNA-binding domains of known transcription factors and equivalogs. Homologs that are likely to be functionally similar can then be identified.

Of particular interest is the structure of a transcription factor in the region of its conserved domain, such as those identified in Table 5. Structural analyses may be performed by comparing the structure of the known transcription factor around its conserved domain with those of orthologs and paralogs. Analysis of a number of polypeptides within a transcription factor group or lade, including the functionally or sequentially similar polypeptides provided in the Sequence Listing, may also provide an understanding of structural elements required to regulate transcription within a given family.

EXAMPLES

The invention, now being generally described, will be more readily understood by reference to the following examples, which are included merely for purposes of illustration of certain aspects and embodiments of the present invention and are not intended to limit the invention. It will be recognized by one of skill in the art that a transcription factor that is associated with a particular first trait may also be associated with at least one other, unrelated and inherent second trait which was not predicted by the first trait.

The complete descriptions of the traits associated with each polynucleotide of the invention are fully disclosed in Table 4 and Table 6. The complete description of the transcription factor gene family and identified conserved domains of the polypeptide encoded by the polynucleotide is fully disclosed in Tables 5A and 5B.

Example I

Full Length Gene Identification and Cloning

Putative transcription factor sequences (genomic or ESTs) related to known transcription factors were identified in the Arabidopsis thaliana GenBank database using the tblastn sequence analysis program using default parameters and a P-value cutoff threshold of −4 or −5 or lower, depending on the length of the query sequence. Putative transcription factor sequence hits were then screened to identify those containing particular sequence strings. If the sequence hits contained such sequence strings, the sequences were confirmed as transcription factors.

Alternatively, Arabidopsis thaliana cDNA libraries derived from different tissues or treatments, or genomic libraries were screened to identify novel members of a transcription family using a low stringency hybridization approach. Probes were synthesized using gene specific primers in a standard PCR reaction (annealing temperature 60° C.) and labeled with $^{32}P$ dCTP using the High Prime DNA Labeling Kit (Boehringer Mannheim Corp. (now Roche Diagnostics Corp., Indianapolis, Ind.). Purified radiolabelled probes were added to filters immersed in Church hybridization medium (0.5 M $NaPO_4$ pH 7.0, 7% SDS, 1% w/v bovine serum albumin) and hybridized overnight at 60° C. with shaking. Filters were washed two times for 45 to 60 minutes with 1×SCC, 1% SDS at 6° C.

To identify additional sequence 5' or 3' of a partial cDNA sequence in a cDNA library, 5' and 3' rapid amplification of cDNA ends (RACE) was performed using the MARATHON cDNA amplification kit (Clontech, Palo Alto, Calif.). Generally, the method entailed first isolating poly(A) mRNA, performing first and second strand cDNA synthesis to generate double stranded cDNA, blunting cDNA ends, followed by ligation of the MARATHON Adaptor to the cDNA to form a library of adaptor-ligated ds cDNA.

Gene-specific primers were designed to be used along with adaptor specific primers for both 5' and 3' RACE reactions. Nested primers, rather than single primers, were used to increase PCR specificity. Using 5' and 3' RACE reactions, 5' and 3' RACE fragments were obtained, sequenced and cloned. The process can be repeated until 5' and 3' ends of the full-length gene were identified. Then the full-length cDNA was generated by PCR using primers specific to 5' and 3' ends of the gene by end-to-end PCR.

Example II

Construction of Expression Vectors

The sequence was amplified from a genomic or cDNA library using primers specific to sequences upstream and downstream of the coding region. The expression vector was pMEN20 or pMEN65, which are both derived from pMON316 (Sanders et al. (1987) Nucleic Acids Res. 15:1543-1558) and contain the CaMV 35S promoter to express transgenes. To clone the sequence into the vector, both pMEN20 and the amplified DNA fragment were digested separately with SalI and NotI restriction enzymes at 37° C. for 2 hours. The digestion products were subject to electrophoresis in a 0.8% agarose gel and visualized by ethidium bromide staining. The DNA fragments containing the sequence and the linearized plasmid were excised and purified by using a QIAQUICK gel extraction kit (Qiagen, Valencia, Calif.). The fragments of interest were ligated at a ratio of 3:1 (vector to insert). Ligation reactions using T4 DNA ligase (New England Biolabs, Beverly Mass.) were carried out at 16° C. for 16 hours. The ligated DNAs were transformed into competent cells of the E. coli strain DH5alpha by using the heat shock method. The transformations were plated on LB plates containing 50 mg/l kanamycin (Sigma Chemical Co. St. Louis Mo.). Individual colonies were grown overnight in five milliliters of LB broth containing 50 mg/l kanamycin at 37° C. Plasmid DNA was purified by using Qiaquick Mini Prep kits (Qiagen, Valencia Calif.).

Example III

Transformation of Agrobacterium with the Expression Vector

After the plasmid vector containing the gene was constructed, the vector was used to transform Agrobacterium tumefaciens cells expressing the gene products. The stock of Agrobacterium tumefaciens cells for transformation were made as described by Nagel et al. (1990) FEMS Microbiol Letts. 67: 325-328. Agrobacterium strain ABI was grown in 250 ml LB medium (Sigma) overnight at 28° C. with shaking until an absorbance over 1 cm at 600 nm ($A_{600}$) of 0.5-1.0 was reached. Cells were harvested by centrifugation at 4,000×g for 15 min at 4° C. Cells were then resuspended in 250 µl chilled buffer (1 mM HEPES, pH adjusted to 7.0 with KOH). Cells were centrifuged again as described above and resuspended in 125 µl chilled buffer. Cells were then centrifuged and resuspended two more times in the same HEPES buffer as described above at a volume of 100 µl and 750 µl, respectively. Resuspended cells were then distributed into 40 µl aliquots, quickly frozen in liquid nitrogen, and stored at −80° C.

Agrobacterium cells were transformed with plasmids prepared as described above following the protocol described by Nagel et al. (supra). For each DNA construct to be transformed, 50-100 ng DNA (generally resuspended in 10 mM Tris-HCl, 1 mM EDTA, pH 8.0) was mixed with 40 µl of Agrobacterium cells. The DNA/cell mixture was then transferred to a chilled cuvette with a 2 mm electrode gap and subject to a 2.5 kV charge dissipated at 25 µF and 200 µF using a Gene Pulser II apparatus (Bio-Rad, Hercules, Calif.). After electroporation, cells were immediately resuspended in 1.0 ml LB and allowed to recover without antibiotic selection for 2-4 hours at 28° C. in a shaking incubator. After recovery, cells were plated onto selective medium of LB broth containing 100 µg/ml spectinomycin (Sigma) and incubated for 24-48 hours at 28° C. Single colonies were then picked and inoculated in fresh medium. The presence of the plasmid construct was verified by PCR amplification and sequence analysis.

Example IV

Transformation of *Arabidopsis* Plants with *Agrobacterium tumefaciens* with Expression Vector After transformation of *Agrobacterium tumefaciens* with plasmid vectors containing the gene, single *Agrobacterium* colonies were identified, propagated, and used to transform *Arabidopsis* plants. Briefly, 500 ml cultures of LB medium containing 50 mg/l kanamycin were inoculated with the colonies and grown at 28° C. with shaking for 2 days until an optical absorbance at 600 nm wavelength over 1 cm ($A_{600}$) of >2.0 is reached. Cells were then harvested by centrifugation at 4,000×g for 10 min, and resuspended in infiltration medium (1/2 X Murashige and Skoog salts (Sigma), 1× Gamborg's B-5 vitamins (Sigma), 5.0% (w/v) sucrose (Sigma), 0.044 1µM benzylamino purine (Sigma), 200 µl/l Silwet L-77 (Lehle Seeds) until an $A_{600}$ of 0.8 was reached.

Prior to transformation, *Arabidopsis thaliana* seeds (ecotype Columbia) were sown at a density of ~10 plants per 4" pot onto Pro-Mix BX potting medium (Hummert International) covered with fiberglass mesh (18 mm×16 mm). Plants were grown under continuous illumination (50-75 µE/m²/sec) at 22-23° C. with 65-70% relative humidity. After about 4 weeks, primary inflorescence stems (bolts) are cut off to encourage growth of multiple secondary bolts. After flowering of the mature secondary bolts, plants were prepared for transformation by removal of all siliques and opened flowers.

The pots were then immersed upside down in the mixture of *Agrobacterium* infiltration medium as described above for 30 sec, and placed on their sides to allow draining into a 1'×2' flat surface covered with plastic wrap. After 24 h, the plastic wrap was removed and pots are turned upright. The immersion procedure was repeated one week later, for a total of two immersions per pot. Seeds were then collected from each transformation pot and analyzed following the protocol described below.

Example V

Identification of *Arabidopsis* Primary Transformants

Seeds collected from the transformation pots were sterilized essentially as follows. Seeds were dispersed into in a solution containing 0.1% (v/v) Triton X-100 (Sigma) and sterile water and washed by shaking the suspension for 20 min. The wash solution was then drained and replaced with fresh wash solution to wash the seeds for 20 min with shaking. After removal of the ethanol/detergent solution, a solution containing 0.1% (v/v) Triton X-100 and 30% (v/v) bleach (CLOROX; Clorox Corp. Oakland Calif.) was added to the seeds, and the suspension was shaken for 10 min. After removal of the bleach/detergent solution, seeds were then washed five times in sterile distilled water. The seeds were stored in the last wash water at 4° C. for 2 days in the dark before being plated onto antibiotic selection medium (1×Murashige and Skoog salts (pH adjusted to 5.7 with 1M KOH), 1×Gamborg's B-5 vitamins, 0.9% phytagar (Life Technologies), and 50 mg/l kanamycin). Seeds were germinated under continuous illumination (50-75 µE/m²/sec) at 22-23° C. After 7-10 days of growth under these conditions, kanamycin resistant primary transformants ($T_1$ generation) were visible and obtained. These seedlings were transferred first to fresh selection plates where the seedlings continued to grow for 3-5 more days, and then to soil (Pro-Mix BX potting medium).

Primary transformants were crossed and progeny seeds ($T_2$) collected; kanamycin resistant seedlings were selected and analyzed. The expression levels of the recombinant polynucleotides in the transformants varies from about a 5% expression level increase to a least a 100% expression level increase. Similar observations are made with respect to polypeptide level expression.

Example VI

Identification of *Arabidopsis* Plants with Transcription Factor Gene Knockouts

The screening of insertion mutagenized *Arabidopsis* collections for null mutants in a known target gene was essentially as described in Krysan et al. (1999) *Plant Cell* 11: 2283-2290. Briefly, gene-specific primers, nested by 5-250 base pairs to each other, were designed from the 5' and 3' regions of a known target gene. Similarly, nested sets of primers were also created specific to each of the T-DNA or transposon ends (the "right" and "left" borders). All possible combinations of gene specific and T-DNA/transposon primers were used to detect by PCR an insertion event within or close to the target gene. The amplified DNA fragments were then sequenced which allows the precise determination of the T-DNA/transposon insertion point relative to the target gene. Insertion events within the coding or intervening sequence of the genes were deconvoluted from a pool comprising a plurality of insertion events to a single unique mutant plant for functional characterization. The method is described in more detail in Yu and Adam, U.S. application Ser. No. 09/177,733 filed Oct. 23, 1998.

Example VII

Identification of Modified Phenotypes in Overexpression or Gene Knockout Plants

Experiments were performed to identify those transformants or knockouts that exhibited modified biochemical characteristics. Among the biochemicals that were assayed were insoluble sugars, such as arabinose, fucose, galactose, mannose, rhamnose or xylose or the like; prenyl lipids, such as lutein, betacarotene, xanthophyll-1, xanthophyll-2, chlorophylls A or B, or alpha-, delta- or gamma-tocopherol or the like; fatty acids, such as 16:0 (palmitic acid), 16:1 (palmitoleic acid), 18:0 (stearic acid), 18:1 (oleic acid), 18:2 (linoleic acid), 20:0, 18:3 (linolenic acid), 20:1 (eicosenoic acid), 20:2, 22:1 (erucic acid) or the like; waxes, such as by altering the levels of C29, C31, or C33 alkanes; sterols, such as brassicasterol, campesterol, stigmasterol, sitosterol or stigmastanol or the like, glucosinolates, protein or oil levels.

Fatty acids were measured using two methods depending on whether the tissue was from leaves or seeds. For leaves, lipids were extracted and esterified with hot methanolic $H_2SO_4$ and partitioned into hexane from methanolic brine. For seed fatty acids, seeds were pulverized and extracted in methanol:heptane:toluene:2,2-dimethoxypropane:$H_2SO_4$ (39:34:20:5:2) for 90 minutes at 80° C. After cooling to room temperature the upper phase, containing the seed fatty acid esters, was subjected to GC analysis. Fatty acid esters from both seed and leaf tissues were analyzed with a SUPELCO SP-2330 column (Supelco, Bellefonte, Pa.).

Glucosinolates were purified from seeds or leaves by first heating the tissue at 95° C. for 10 minutes. Preheated ethanol:water (50:50) is added and after heating at 95° C. for a further 10 minutes, the extraction solvent is applied to a DEAE Sephadex column (Pharmacia) which had been previously equilibrated with 0.5 M pyridine acetate. Desulfoglucosinolates were eluted with 300 ul water and analyzed by reverse phase HPLC monitoring at 226 nm.

For wax alkanes, samples were extracted using an identical method as fatty acids and extracts were analyzed on a HP 5890 GC coupled with a 5973 MSD. Samples were chromatographically isolated on a J&W DB35 mass spectrometer (J&W Scientific Agilent Technologies, Folsom, Calif.).

To measure prenyl lipid levels, seeds or leaves were pulverized with 1 to 2% pyrogallol as an antioxidant. For seeds, extracted samples were filtered and a portion removed for tocopherol and carotenoid/chlorophyll analysis by HPLC. The remaining material was saponified for sterol determination. For leaves, an aliquot was removed and diluted with methanol and chlorophyll A, chlorophyll B, and total carotenoids measured by spectrophotometry by determining optical absorbance at 665.2 nm, 652.5 nm, and 470 nm. An aliquot was removed for tocopherol and carotenoid/chlorophyll composition by HPLC using a Waters µBondapak C18 column (4.6 mm×150 mm). The remaining methanolic solution was saponified with 10% KOH at 80° C. for one hour. The samples were cooled and diluted with a mixture of methanol and water. A solution of 2% methylene chloride in hexane was mixed in and the samples were centrifuged. The aqueous methanol phase was again re-extracted 2% methylene chloride in hexane and, after centrifugation, the two upper phases were combined and evaporated. 2% methylene chloride in hexane was added to the tubes and the samples were then extracted with one ml of water. The upper phase was removed, dried, and resuspended in 400 ul of 2% methylene chloride in hexane and analyzed by gas chromatography using a 50 m DB-5 ms (0.25 mm ID, 0.25 µm phase, J&W Scientific).

Insoluble sugar levels were measured by the method essentially described by Reiter et al. (1999), *Plant J.* 12: 335-345. This method analyzes the neutral sugar composition of cell wall polymers found in *Arabidopsis* leaves. Soluble sugars were separated from sugar polymers by extracting leaves with hot 70% ethanol. The remaining residue containing the insoluble polysaccharides was then acid hydrolyzed with allose added as an internal standard. Sugar monomers generated by the hydrolysis were then reduced to the corresponding alditols by treatment with NaBH4, then were acetylated to generate the volatile alditol acetates which were then analyzed by GC-FID. Identity of the peaks was determined by comparing the retention times of known sugars converted to the corresponding alditol acetates with the retention times of peaks from wild-type plant extracts. Alditol acetates were analyzed on a Supelco SP-2330 capillary column (30 m×250 µm×0.2 µm) using a temperature program beginning at 180° C. for 2 minutes followed by an increase to 220° C. in 4 minutes. After holding at 220° C. for 10 minutes, the oven temperature is increased to 240° C. in 2 minutes and held at this temperature for 10 minutes and brought back to room temperature.

To identify plants with alterations in total seed oil or protein content, 150 mg of seeds from T2 progeny plants were subjected to analysis by Near Infrared Reflectance Spectroscopy (NIRS) using a Foss NirSystems Model 6500 with a spinning cup transport system. NIRS is a non-destructive analytical method used to determine seed oil and protein composition. Infrared is the region of the electromagnetic spectrum located after the visible region in the direction of longer wavelengths. 'Near infrared' owns its name for being the infrared region near to the visible region of the electromagnetic spectrum. For practical purposes, near infrared comprises wavelengths between 800 and 2500 nm. NIRS is applied to organic compounds rich in O—H bonds (such as moisture, carbohydrates, and fats), C—H bonds (such as organic compounds and petroleum derivatives), and N—H bonds (such as proteins and amino acids). The NIRS analytical instruments operate by statistically correlating NIRS signals at several wavelengths with the characteristic or property intended to be measured. All biological substances contain thousands of C—H, O—H, and N—H bonds. Therefore, the exposure to near infrared radiation of a biological sample, such as a seed, results in a complex spectrum which contains qualitative and quantitative information about the physical and chemical composition of that sample.

The numerical value of a specific analyte in the sample, such as protein content or oil content, is mediated by a calibration approach known as chemometrics. Chemometrics applies statistical methods such as multiple linear regression (MLR), partial least squares (PLS), and principle component analysis (PCA) to the spectral data and correlates them with a physical property or other factor, that property or factor is directly determined rather than the analyte concentration itself. The method first provides "wet chemistry" data of the samples required to develop the calibration.

Calibration of NIRS response was performed using data obtained by wet chemical analysis of a population of *Arabidopsis* ecotypes that were expected to represent diversity of oil and protein levels.

The exact oil composition of each ecotype used in the calibration experiment was performed using gravimetric analysis of oils extracted from seed samples (0.5 g or 1.0 g) by the accelerated solvent extraction method (ASE; Dionex Corp, Sunnyvale, Calif.). The extraction method was validated against certified canola samples (Community Bureau of Reference, Belgium). Seed samples from each ecotype (0.5 g or 1 g) were subjected to accelerated solvent extraction and the resulting extracted oil weights compared to the weight of oil recovered from canola seed that has been certified for oil content (Community Bureau of Reference). The oil calibration equation was based on 57 samples with a range of oil contents from 27.0% to 50.8%. To check the validity of the calibration curve, an additional set of samples was extracted by ASE and predicted using the oil calibration equation. This validation set counted 46 samples, ranging from 27.9% to 47.5% oil, and had a predicted standard error of performance of 0.63%. The wet chemical method for protein was elemental analysis (% N X 6.0) using the average of 3 representative samples of 5 mg each validated against certified ground corn (NIST). The instrumentation was an Elementar Vario-EL III elemental analyzer operated in CNS operating mode (Elementar Analysensysteme GmbH, Hanau, Germany).

The protein calibration equation was based on a library of 63 samples with a range of protein contents from 17.4% to 31.2%. An additional set of samples was analyzed for protein by elemental analysis (n=57) and scanned by NIRS in order to validate the protein prediction equation. The protein range of the validation set was from 16.8% to 31.2% and the standard error of prediction was 0.468%.

NIRS analysis of *Arabidopsis* seed was carried out on between 40-300 mg experimental sample. The oil and protein contents were predicted using the respective calibration equations.

Data obtained from NIRS analysis was analyzed statistically using a nearest-neighbor (N—N) analysis. The N—N analysis allows removal of within-block spatial variability in a fairly flexible fashion, which does not require prior knowledge of the pattern of variability in the chamber. Ideally, all hybrids are grown under identical experimental conditions within a block (rep). In reality, even in many block designs, significant within-block variability exists. Nearest-neighbor procedures are based on assumption that environmental effect of a plot is closely related to that of its neighbors. Nearest-neighbor methods use information from adjacent plots to adjust for within-block heterogeneity and so provide more precise estimates of treatment means and differences. If there is within-plot heterogeneity on a spatial scale that is larger than a single plot and smaller than the entire block, then yields from adjacent plots will be positively correlated. Information from neighboring plots can be used to reduce or remove the unwanted effect of the spatial heterogeneity, and hence improve the estimate of the treatment effect. Data from neighboring plots can also be used to reduce the influence of competition between adjacent plots. The Papadakis N—N analysis can be used with designs to remove within-block variability that would not be removed with the standard split plot analysis (Papadakis (1973) Inst. d'Amelior. Plantes Thessaloniki (Greece) Bull. Scientif. No. 23; Papadakis (1984) *Proc. Acad. Athens* 59: 326-342.

Experiments were performed to identify those transformants or knockouts that exhibited modified sugar-sensing. For such studies, seeds from transformants were germinated on media containing 5% glucose or 9.4% sucrose which normally partially restrict hypocotyl elongation. Plants with altered sugar sensing may have either longer or shorter hypocotyls than normal plants when grown on this media. Additionally, other plant traits may be varied such as root mass.

Experiments may be performed to identify those transformants or knockouts that exhibited an improved pathogen tolerance. For such studies, the transformants are exposed to biotropic fungal pathogens, such as *Erysiphe orontii*, and necrotropic fungal pathogens, such as *Fusarium oxysporum*. *Fusarium oxysporum* isolates cause vascular wilts and damping off of various annual vegetables, perennials and weeds (Mauch-Mani and Slusarenko (1994) *Molec Plant-Microbe Interact.* 7: 378-383). For *Fusarium oxysporum* experiments, plants are grown on Petri dishes and sprayed with a fresh spore suspension of *F. oxysporum*. The spore suspension is prepared as follows: A plug of fungal hyphae from a plate culture is placed on a fresh potato dextrose agar plate and allowed to spread for one week. Five ml sterile water is then added to the plate, swirled, and pipetted into 50 ml Armstrong *Fusarium* medium. Spores are grown overnight in *Fusarium* medium and then sprayed onto plants using a Preval paint sprayer. Plant tissue is harvested and frozen in liquid nitrogen 48 hours post-infection.

*Erysiphe orontii* is a causal agent of powdery mildew. For *Erysiphe orontii* experiments, plants are grown approximately 4 weeks in a greenhouse under 12 hour light (20° C., –30% relative humidity (rh)). Individual leaves are infected with *E. orontii* spores from infected plants using a camel's hair brush, and the plants are transferred to a Percival growth chamber (20° C., 80% rh.). Plant tissue is harvested and frozen in liquid nitrogen 7 days post-infection.

*Botrytis cinerea* is a necrotrophic pathogen. *Botrytis cinerea* is grown on potato dextrose agar under 12 hour light (20° C., –30% relative humidity (rh)). A spore culture is made by spreading 10 ml of sterile water on the fungus plate, swirling and transferring spores to 10 ml of sterile water. The spore inoculum (approx. 105 spores/ml) is then used to spray 10 day-old seedlings grown under sterile conditions on MS (minus sucrose) media. Symptoms are evaluated every day up to approximately 1 week.

*Sclerotinia sclerotiorum* hyphal cultures are grown in potato dextrose broth. One gram of hyphae is ground, filtered, spun down and resuspended in sterile water. A 1:10 dilution is used to spray 10 day-old seedlings grown aseptically under a 12 hour light/dark regime on MS (minus sucrose) media. Symptoms are evaluated every day up to approximately 1 week.

*Pseudomonas syringae* pv *maculicola* (*Psm*) strain 4326 and pv *maculicola* strain 4326 was inoculated by hand at two doses. Two inoculation doses allows the differentiation between plants with enhanced susceptibility and plants with enhanced resistance to the pathogen. Plants are grown for 3 weeks in the greenhouse, then transferred to the growth chamber for the remainder of their growth. *Psm* ES4326 may be hand inoculated with 1 ml syringe on 3 fully-expanded leaves per plant (4½ wk old), using at least 9 plants per overexpressing line at two inoculation doses, OD=0.005 and OD=0.0005. Disease scoring is performed at day 3 post-inoculation with pictures of the plants and leaves taken in parallel.

In some instances, expression patterns of the pathogen-induced genes (such as defense genes) may be monitored by microarray experiments. In these experiments, cDNAs are generated by PCR and resuspended at a final concentration of ~100 ng/μl in 3×SSC or 150 mM Na-phosphate (Eisen and Brown (1999) *Methods Enzymol.* 303: 179-205). The cDNAs are spotted on microscope glass slides coated with polylysine. The prepared cDNAs are aliquoted into 384 well plates and spotted on the slides using, for example, an x-y-z gantry (OmniGrid) which may be purchased from GeneMachines (Menlo Park, Calif.) outfitted with quill type pins which may be purchased from Telechem International (Sunnyvale, Calif.). After spotting, the arrays are cured for a minimum of one week at room temperature, rehydrated and blocked following the protocol recommended by Eisen and Brown (1999; supra).

Sample total RNA (10 μg) samples are labeled using fluorescent Cy3 and Cy5 dyes. Labeled samples are resuspended in 4×SSC/0.03% SDS/4 μg salmon sperm DNA/2 μg tRNA/50 mM Napyrophosphate, heated for 95° C. for 2.5 minutes, spun down and placed on the array. The array is then covered with a glass coverslip and placed in a sealed chamber. The chamber is then kept in a water bath at 62° C. overnight. The arrays are washed as described in Eisen and Brown (1999, supra) and scanned on a General Scanning 3000 laser scanner. The resulting files are subsequently quantified using IMAGENE, software (BioDiscovery, Los Angeles Calif.).

RT-PCR experiments may be performed to identify those genes induced after exposure to biotropic fungal pathogens, such as *Erysiphe orontii*, necrotropic fungal pathogens, such as *Fusarium oxysporum*, bacteria, viruses and salicylic acid, the latter being involved in a nonspecific resistance response in *Arabidopsis thaliana*. Generally, the gene expression patterns from ground plant leaf tissue is examined.

Reverse transcriptase PCR was conducted using gene specific primers within the coding region for each sequence identified. The primers were designed near the 3' region of each DNA binding sequence initially identified.

Total RNA from these ground leaf tissues was isolated using the CTAB extraction protocol. Once extracted total RNA was normalized in concentration across all the tissue types to ensure that the PCR reaction for each tissue received the same amount of cDNA template using the 28S band as reference. Poly(A+) RNA was purified using a modified protocol from the Qiagen OLIGOTEX purification kit batch protocol. cDNA was synthesized using standard protocols. After the first strand cDNA synthesis, primers for Actin 2 were used to normalize the concentration of cDNA across the tissue types. Actin 2 is found to be constitutively expressed in fairly equal levels across the tissue types being investigated.

For RT PCR, cDNA template was mixed with corresponding primers and Taq DNA polymerase. Each reaction consisted of 0.2 µl cDNA template, 2 µl 10×Tricine buffer, 2 µl 10×Tricine buffer and 16.8 µl water, 0.05 µl Primer 1, 0.05 µl, Primer 2, 0.3 µl Taq DNA polymerase and 8.6 µl water.

The 96 well plate is covered with microfilm and set in the thermocycler to start the reaction cycle. By way of illustration, the reaction cycle may comprise the following steps:

STEP 1: 93° C. FOR 3 MIN;
Step 2: 93° C. for 30 sec;
Step 3: 65° C. for 1 min;
Step 4: 72° C. for 2 min;
Steps 2, 3 and 4 are repeated for 28 cycles;
Step 5: 72° C. for 5 min; and
Step 6 4° C.

To amplify more products, for example, to identify genes that have very low expression, additional steps may be performed: The following method illustrates a method that may be used in this regard. The PCR plate is placed back in the thermocycler for 8 more cycles of steps 2-4.

Step 2 93° C. for 30 sec;
Step 3 65° C. for 1 min;
Step 4 72° C. for 2 min, repeated for 8 cycles; and
Step 5 4° C.

Eight microliters of PCR product and 1.5 µl of loading dye are loaded on a 1.2% agarose gel for analysis after 28 cycles and 36 cycles. Expression levels of specific transcripts are considered low if they were only detectable after 36 cycles of PCR. Expression levels are considered medium or high depending on the levels of transcript compared with observed transcript levels for an internal control such as actin2. Transcript levels are determined in repeat experiments and compared to transcript levels in control (e.g., non-transformed) plants.

Experiments were performed to identify those transformants or knockouts that exhibited an improved environmental stress tolerance. For such studies, the transformants were exposed to a variety of environmental stresses. Plants were exposed to chilling stress (6 hour exposure to 4-8° C.), heat stress (6 hour exposure to 32-37° C.), high salt stress (6 hour exposure to 200 mM NaCl), drought stress (168 hours after removing water from trays), osmotic stress (6 hour exposure to 3 M mannitol), or nutrient limitation (nitrogen: all components of MS medium remained constant except N was reduced to 20 mg/l of $NH_4NO_3$; phosphate: all components of MS medium except $KH_2PO_4$, which was replaced by $K_2SO_4$; potassium: all components of MS medium except removal of $KNO_3$ and $KH_2PO_4$, which were replaced by $NaH_4PO_4$).

Experiments were performed to identify those transformants or knockouts that exhibited a modified structure and development characteristics. For such studies, the transformants were observed by eye to identify novel structural or developmental characteristics associated with the ectopic expression of the polynucleotides or polypeptides of the invention.

Flowering time was measured by the number of rosette leaves present when a visible inflorescence of approximately 3 cm is apparent. Rosette and total leaf number on the progeny stem are tightly correlated with the timing of flowering (Koornneef et al. (1991) *Mol. Gen. Genet.* 229: 57-66). The vernalization response was also measured. For vernalization treatments, seeds were sown to MS agar plates, sealed with micropore tape, and placed in a 4° C. cold room with low light levels for 6-8 weeks. The plates were then transferred to the growth rooms alongside plates containing freshly sown non-vernalized controls. Rosette leaves were counted when a visible inflorescence of approximately 3 cm was apparent.

Modified phenotypes observed for particular overexpressor or knockout plants are provided in Table 4. For a particular overexpressor that shows a less beneficial characteristic, it may be more useful to select a plant with a decreased expression of the particular transcription factor. For a particular knockout that shows a less beneficial characteristic, it may be more useful to select a plant with an increased expression of the particular transcription factor.

The sequences of the Sequence Listing or those in Tables 4-8, or those disclosed here, can be used to prepare transgenic plants and plants with altered traits. The specific transgenic plants listed below are produced from the sequences of the Sequence Listing, as noted. Table 4 provides exemplary polynucleotide and polypeptide sequences of the invention.

Example VIII

Examples of Genes that Confer Significant Improvements to Plants

A number of genes and homologs that confer significant improvements to knockout or overexpressing plants were noted below. Experimental observations made with regard to specific genes whose expression was modified in overexpressing or knockout plants, and potential applications based on these observations, were also presented.

G8 (SEQ ID NO: 11)

Published Information

G8 corresponds to gene At2g28550 (AAD21489). The gene has also been described as RAP2.7 (Okamuro et al. (1997) *Proc. Natl. Acad. Sci. U.S.A.* 94: 7076-7081). No functional information is available about G8.

Experimental Observations

The function of G8 was studied using transgenic plants in which the gene was expressed under the control of the 35S promoter. Overexpression of G8 caused alterations in plant development, the most consistent one being a delay in flowering time.

This phenotype was observed in approximately 25% of the primary transformants. These individuals showed a relatively strong phenotype and typically made 30-50 leaves (versus 10-12 the wild-type controls) prior to bolting under 24-hour light. This phenotype was reproduced in some, but not all, of the T2 progeny plants from each one of the lines. Additionally, a further T2 population was found to flower later than wild type in 12-hour light conditions. Thus, late flowering was observed in both the T1 and T2 generations, and in different photoperiodic conditions.

It should also be noted that many 35S::G8 plants appeared smaller than controls, particularly at early stages. Accordingly, in the T2 lines used for physiological analyses it was observed that seedlings were smaller and showed reduced vigor when germinated on MS plates. However, not all 35S::G8 lines showed these effects.

G8 was ubiquitously expressed, at higher levels in rosette leaves, and did not appear to be induced by any of the conditions tested.

Utilities

G8 could potentially be used to alter flowering time.

G19 (SEQ ID NO: 21)

Published Information

G19 belongs to the EREBP subfamily of transcription factors, i.e., it contains only one AP2 domain. G19 corresponds to the previously described gene RAP2.3 (Okamuro et al. (1997) *Proc. Natl. Acad. Sci. U.S.A.* 94: 7076-7081). Close inspection of the *Arabidopsis* cDNA sequences of RAP2.3 (AF003096; Okamuro et al. (1997) supra), AtEBP (Y09942; Buttner and Singh (1997) *Proc. Natl. Acad. Sci. U.S.A.* 94: 5961-5966), and ATCADINP (Z37504) suggests that they may correspond to the same gene (Riechmann and Meyerowitz, (1998) *Biol. Chem.* 379: 633-646). G19/RAP2.3 is ubiquitously expressed (Okamuro et al. (1997) supra). AtEBP was isolated by virtue of the protein-protein interaction between AtEBP and OBF4, a basic-region leucine zipper transcription factor (Buttner and Singh (1997) supra). AtEBP expression levels in seedlings were increased after treatment with ethylene (ethephon) (Buttner and Singh (1997) supra). AtEBP was found to bind to GCC-box containing sequences, like that of the PRB-1b promoter (Buttner and Singh (1997) supra). It has been suggested that the interaction between AtEBP and OBF4 reflects cross-coupling between EREBP and bZIP transcription factors which might be important in regulating gene expression during the plant defense response (Buttner and Singh (1997) supra).

Experimental Observations

Transgenic plants in which G19 was expressed under the control of the 35S promoter were morphologically similar to control plants. G19 was constitutively expressed in the different tissues examined; however G19 expression was significantly repressed by methyl jasmonate (MeJ) and induced by ACC (this latter result correlates with the previously described increase in G19 expression levels in seedlings after treatment with ethylene (ethephon); Buttner and Singh (1997) supra). G19 was significantly induced upon infection by the fungal pathogen *Erysiphe orontii*. In addition, G19 overexpressing plants were more tolerant to infection with a moderate dose of *Erysiphe orontii*.

Both the jasmonic acid and the ethylene signal transduction pathways are involved in the regulation of the defense response and the wound response, and the two pathways have been found to interact synergistically. The regulation of G19 expression by both hormones, its induction upon *Erysiphe orontii* infection, as well as the preliminary data indicating that increased tolerance to that pathogen is conferred by G19 overexpression, suggested that G19 might play a role in the control of the defense and/or wound response.

Utilities

G19 can be used to manipulate the plant defense wound or insect-response, as well as the jasmonic acid and ethylene signal transduction pathways themselves.

G22 (SEQ ID NO: 27)

Published Information

G22 has been identified in the sequence of BAC T13E15 (gene T13E15.5) by The Institute of Genomic Research (TIGR) as a "TINY transcription factor isolog". G22 belongs to the EREBP subfamily, i.e., it contains only one AP2 domain, and phylogenetic analyses place G22 relatively close to other EREBP subfamily genes, like TINY and ATDL4400C (Riechmann and Meyerowitz (1998) *Biol. Chem.* 379: 633-646). No functional information is available about G22.

Experimental Observations

G22 was constitutively expressed at medium levels. There appeared to be no phenotypic alteration on plant morphology upon G22 overexpression. Plants ectopically overexpressing G22 were more tolerant to high NaCl-containing media in a root growth assay compared to wild-type controls.

Utilities

G22 could be used to increase plant tolerance to soil salinity during germination, at the seedling stage, or throughout the plant life cycle.

G24 (SEQ ID NO: 29)

Published Information

G24 corresponds to gene At2g23340 (AAB87098). No information is available about the function(s) of G24.

Closely Related Genes from Other Species

G24 is highly related to a *Descurainia sophia* AP2/EREBP gene represented by cDNA clone: BG321374 (BG321374 Ds01_6d08_R Ds01_AAFC_ECORC_cold_stressed_Flixweed_seedlings *Descurainia sophia* cDNA clone Ds01_06d08, mRNA sequence).

Experimental Observations

The function of G24 was studied using transgenic plants in which the gene was expressed under the control of the 35S promoter. Overexpression of G24 caused alterations in plant growth and development. Most notably, 35S::G24 seedlings often developed black necrotic tissue patches on cotyledons and leaves, and many died at that stage. Some 35S::G24 seedlings exhibited a weaker phenotype, and although necrotic patches were visible on the cotyledons, they did not die. These seedlings developed into plants that were usually small, slow growing, and poorly fertile in comparison to wild type controls. The leaves of older 35S::G24 plants were also observed to become yellow and senesce prematurely compared to wild type. For those lines that could be assayed in biochemical and physiological assays, no differences were observed with respect to wild type controls.

G24 is ubiquitously expressed, at apparently lower levels in germinating seedlings, and is not significantly induced by any of the conditions tested.

The AP2 domain of G24 is nearly identical to that of other *Arabidopsis* EREBP proteins, such as G12, G1379, and G1277. Whether all these proteins share related functions remains to be determined.

Utilities

G24 or its equivalogs can be used to trigger cell death and influence or control processes in which cell death plays a role. G24 can be used to block pathogen infection by triggering it in infected cells and blocking spread of the disease.

G28 (SEQ ID NO: 37)

Published Information

G28 corresponds to AtERF1 (GenBank accession number AB008103) (Fujimoto et al. (2000) *Plant Cell* 12: 393-404). G28 appears as gene AT4g17500 in the annotated sequence of *Arabidopsis* chromosome 4 (AL161546.2).

AtERF1 has been shown to have GCC-box binding activity [some defense-related genes that were induced by ethylene were found to contain a short cis-acting element known as the GCC-box: AGCCGCC (Ohme et al. (1990) *Plant Mol. Biol.* 15: 941-946)]. Using transient assays in *Arabidopsis* leaves, AtERF1 was found to be able to act as a GCC-box sequence specific transactivator (Fujimoto et al. (2000) supra).

AtERF1 expression has been described to be induced by ethylene (two- to three-fold increase in AtERF1 transcript levels 12 h after ethylene treatment) (Fujimoto et al. (2000) supra). In the ein2 mutant, the expression of AtERF1 was not induced by ethylene, suggesting that the ethylene induction of AtERF1 is regulated under the ethylene signaling pathway (Fujimoto et al. (2000) supra). AtERF1 expression was also induced by wounding, but not by other abiotic stresses (such as cold, salinity, or drought) (Fujimoto et al. (2000) supra).

It has been suggested that AtERFs, in general, may act as transcription factors for stress-responsive genes, and that the GCC-box may act as a cis-regulatory element for biotic and abiotic stress signal transduction in addition to its role as an ethylene responsive element (ERE) (Fujimoto et al. (2000) supra), but there is no data available on the physiological functions of AtERF1.

Experimental Observations

The function of G28 was analyzed using transgenic plants in which this gene was expressed under the control of the 35S promoter. G28 overexpressing lines were more tolerant to infection with a moderate dose of the fungal pathogen *Erysiphe orontii*. G28 overexpression did not seem to have detrimental effects on plant growth or vigor, since plants from most of the lines were morphologically wild-type. In addition, no difference was detected between those lines and the corresponding wild-type controls in all the biochemical assays that were performed. G28 was ubiquitously expressed.

G28 overexpressing lines were also more tolerant to *Sclerotinia sclerotiorum* and *Botrytis cinerea*. In a repeat experiment using individual lines, all three lines analyzed showed tolerance to *S. sclerotiorum*, and two of the three lines tested were more tolerant to *B cinerea*.

Utilities

G28 transgenic plants had an altered response to fungal pathogens, in that those plants were more tolerant to the pathogens. Therefore, G28 or its equivalogs can be used to manipulate the defense response in order to generate pathogen-resistant plants.

G46 (SEQ ID NO: 53)

Published Information

G46 was first identified in the sequence of P1 clone MBK20 (GenBank accession number AB010070, gene MBK20.1). No information is available about the function(s) of G46.

Experimental Observations

RT-PCR experiments revealed that G46 is ubiquitously expressed, but is apparently induced by stress conditions such as auxin, heat, salt and *Erysiphe*.

The function of G46 was first studied by analyzing knockout mutants with a line homozygous for a T-DNA insertion in the gene. G46 knockout mutant plants were indistinguishable from wild-type in all assays performed.

The function of G46 was also analyzed using transgenic plants in which a cDNA clone of the gene was expressed under the control of the 35S promoter. A small number of lines were larger than wild-type plants, developed more rapidly, and yielded an increased quantity of seed compared to wild-type controls.

In the physiological analysis, all three 35S::G46 lines tested showed more resistance to severe water deprivation stress. Seedlings are generally larger and greener than the control plants exposed to the same conditions.

Utilities

The increased size and growth rate seen in some of the lines, indicates that the gene could be used to increase crop productivity.

The reduced sensitivity of 35S::G46 lines in the dehydration stress assay indicates that the gene may also be used to engineer crops with increased tolerance to drought, salt, freezing and/or chilling stress, or increased water use efficiency.

G153 (SEQ ID NO: 65)

Published Information

G153 corresponds to the *Arabidopsis* ANR1 gene. This locus was identified by Zhang and Forde ((1998) *Science* 279: 407-409) as a MADS box gene that is rapidly induced in the roots of nitrogen starved seedlings, following exposure to a nitrate source. Additionally, it was shown that transgenic lines in which an antisense clone of ANR1 is overexpressed, show an altered sensitivity to nitrate and, unlike wild-type plants, do not exhibit lateral root proliferation in response to nitrate treatments. From these data, it was concluded that ANR1 is a key regulator of nutrient-induced changes in root architecture (Zhang and Forde (1998) supra).

However, Wang et al. ((2000) *Plant Cell* 12: 1491-1509) have published data which contradicts the results of Zhang and Forde. These authors found that ANR1 is actually repressed, rather than induced, following treatment of nitrogen starved seedlings (grown on 10 mM ammonium succinate as the sole nitrogen source) with 5 mM nitrate.

A phylogenetic analysis of the *Arabidopsis* MADS box gene family situated ANR1 in same clade as three other MADS box genes: AGL16 (G860), AGL17 (G152) and AGL21 (61760) (Alvarez-Buylla et al. (2000) Proc Natl Acad Sci USA. 97: 5328-5333). Two of the genes, AGL17 and AGL21 were recently shown to be expressed in specific zones of the root, suggesting that different members of the ANR1 clade may play distinct regulatory roles during root development (Burgeff et al. (2002) *Planta* 214: 365-372).

The ANR1 sequence (GenBank accession AX507709) has also been included in a patent publication (WO0216655) as a stress-regulated plant.

Experimental Observations

RT-PCR experiments revealed that G153 was up-regulated in leaves in response to heat and *Fusarium* treatments. Lower levels of induction were also observed following auxin, ABA, and cold treatments, indicating that G153 might have a role in a variety of stress responses.

To further assess the function of the gene, 35S::G153 lines were generated and subjected them to various assays. Around a third of the lines showed a marked acceleration in the onset of flowering, suggesting that the gene might impinge on genetic pathways that regulate flowering time. In addition to the effects on flowering, 35S::G153 lines displayed an enhanced performance in an assay intended to reveal alterations in C:N sensing. 35S::G153 seedlings contained less anthocyanins (and in some cases were larger) than wild-type controls grown on high sucrose/N— plates. Seedlings were also larger and greener on high sucrose/N— plates that had been supplemented with glutamine. Together, these data indicated that overexpression of G153 alters the ability to modulate carbon and/or nitrogen uptake and utilization.

A closely related gene, G1760 (SEQ ID NO: 937), was analyzed and like 35S::G153 transformants, 35S::G1760 lines also exhibited early flowering and RT-PCR studies showed G1760 to be predominantly expressed in roots and to be stress responsive. Thus, G1760 and G153 likely have similar and/or overlapping functions.

Utilities

The response of G153 expression to different physiological treatments indicated that the gene or its equivalogs could be used to improve resistance to a variety of different stresses. In particular, the enhanced performance of 35S::G153 lines under low nitrogen conditions indicated that G153 might be used to engineer crops that could thrive in environments with reduced nitrogen availability.

Given the early flowering seen in the 35S::G153 transformants, the gene or its equivalogs might also be applied to manipulate the flowering time of commercial species. In particular, G153 could be used to accelerate flowering, or eliminate any requirement for vernalization. Conversely, it might be possible to modify the activity of G1153 or its equivalogs to delay flowering in order to achieve an increase in biomass and yield.

G156 (SEQ ID NO: 67)

Published Information

G156 corresponds to gene MKD15.12 (GenBank accession number BAB11181.1). G156 has also been described as AGL32 (Alvarez-Buylla et al. (2000) Proc. Natl. Acad. Sci. 97:5328-5333). Phylogenetic analyses of the Arabidopsis MADS box gene family indicate that G156/AGL32 is a Type II MADS-box gene, but it does not belong to any of the well-characterized Type II MADS gene clades (Alvarez-Buylla et al. 2000 supra).

Experimental Observations

The complete cDNA sequence of G156 was determined. The function of this gene was analyzed using both transgenic plants in which G1156 was expressed under the control of the 35S promoter and a line homozygous for a T-DNA insertion in the gene. The T-DNA insertion lies in the second intron, and was expected to result in a strong loss-of-function or null mutation.

G156 knockout mutant plants produced yellow seed that showed more variation in shape than wild type, implying a function (direct or indirect) for G156 in seed development. G156 mutant plants were otherwise normal at all other developmental stages. Expression of G156 was determined to be specific to floral tissues. Although expression was detected by RT-PCR in flowers, siliques, and embryos, it could well be that G156 was specifically expressed in embryo/seed during development, in light of the many MADS box genes that have been shown to be expressed in specific floral organs or cell types, and of the G156 knockout mutant phenotype. In situ RNA hybridization experiments will determine more precisely G156 expression pattern.

The coloration phenotype of the G156 knockout mutant seed resembles that of ttg1 and the transparent testa mutants. TTG1, which is localized in Chromosome 5, but approximately 0.5 Mb away from the clone that contains G156 (MKD15), codes for a WD40 repeat protein (Walker et al. (1999) Plant Cell 11: 1337-1350). The transparent testa (tt) loci were identified in screens for mutations that result in yellow or pale brown seeds (Koornneef (1990) Arabidopsis Inf. Ser. 27:1-4). Many of the "TT" genes have been mapped, and several of them have been cloned and shown to be involved in the anthocyanin pathway (Debeaujon et al. (2001) Plant Cell 13:853-872)

None of the TT genes corresponds to G156. TT3, TT4, TT5, and TT7 code for dihydroflavol 4reductase, chalcone synthase, chalcone flavanone isomerase, and flavonoid 3'-hydroxylase, respectively (Shirley et al. (1992) Plant Cell 4:333-347; Shirley et al. (1995) Plant J. 8:659-671). TT12 encodes a multidrug secondary transporter-like protein required for flavonoid sequestration in vacuoles of the seed coat endothelium (Debeaujon et al. (2001) supra). TT6 and TT9 map on Chromosome 3, and TT1 maps on Chromosome 1. TT2 and TT10 map on Chromosome 5, but far away from the position of G156 (Shirley et al. (1995) supra). TT8 has also been cloned and shown to encode a transcription factor of the basic helix-loop-helix class (Nesi et al. (2000) Plant Cell 12:1863-1878), providing further evidence for the regulation of the anthocyanin pathway at the transcriptional level.

The similarity of the G156 knockout and tt seed coloration phenotypes, and the involvement of at least some of the TT genes in the anthocyanin pathway, suggested that G156 is involved in its regulation.

In addition to the seed coloration phenotype, the G156 knockout mutant showed a significant increase in the percentage of seed 18:1 fatty acids.

G156 overexpressing plants showed a variety of morphological alterations, largely uninformative. The most severely affected transformants were extremely dwarfed, had aberrant branching, and sometimes possessed terminal flowers. These phenotypic alterations were frequently observed when MADS box genes that were involved in flower development were overexpressed in Arabidopsis (for instance, AG, AP1, and AP3+PI; Mizukami et al. (1992) Cell 71:119-131; Mandel et al. (1995) Nature 377:522-524; Krizek et al. (1996) Development 122:11-22).

Both G 156 knockout mutant plants and G 156 overexpressing lines behaved like the wild-type controls in the physiological assays performed.

Utilities

G156 or its equivalogs can be used to manipulate the anthocyanin biosynthetic pathway, such as for altering seed coloration. In addition, the promoter of G156 may be used to confer seed-specific expression to genes of interest.

G157 (SEQ ID NO: 69)

Published Information

G157 was first identified in the sequence of BAC F22K20 (GenBank accession number AC002291; gene F22K20.15).

Experimental Observations

G1157 was recognized as a gene highly related to Arabidopsis FLOWERING LOCUS C (FLC; Michaels et al. (1999) Plant Cell 11:949-956; Sheldon et al. (1999) Plant Cell 11:445-458). FLC acts as a repressor of flowering. Late flowering vernalization responsive ecotypes and mutants have high steady state levels of FLC transcript, which decrease during the promotion of flowering by vernalization. FLC therefore has a central role in regulating the response to vernalization (Michaels (1999) supra; Sheldon et al. (1999) supra; Sheldon et al. (2000) Proc. Natl. Acad. Sci. 97:3753-3758).

The function of G157 was studied using transgenic plants in which this gene was expressed under the control of the 35S promoter. Over-expression of G157 modifies flowering time, and it appears to do so in a quantitative manner: a modest level of over-expression triggers early flowering, whereas a larger increase delays flowering. G157 over-expression promoted flowering in the Arabidopsis late-flowering vernalization-dependent ecotypes Stockholm and Pitztal.

In contrast to FLC, G157 transcript levels showed no correlation with the vernalization response, and over-expression of G157 did not influence FLC transcript levels. Thus, G157 likely acts downstream or independently of FLC transcription. In addition, a cluster of four additional FLC-like and G157-like genes were identified, raising the possibility that a whole sub-group of proteins within the MADS family regulates flowering time.

G157 overexpressing plants did not show any other morphological, physiological, or biochemical alteration in the assays that were performed. Overexpression of G157 was not observed to have deleterious effects: 35S::G157 plants were healthy and attained a wild-type stature when mature.

For many crops, high yielding winter strains can only be grown in regions where the growing season is sufficiently cold and prolonged to elicit vernalization. A system that could trigger flowering at higher temperatures would greatly expand the acreage over which winter varieties can be cultivated. The finding that G1157 overexpression caused early flowering in Arabidopsis Stockholm and Pitztal plants, indicated that the gene can overcome the high level of FRIGIDA and FLC activity present in those lateecotypes. That the effects were similar to those caused by vernalization implied that G157 might be applicable to winter strains of crop species. To date, a substantial number of genes have been found to promote flowering. Many, however, including those encoding the transcription factors, APETALA1, LEAFY, and CONSTANS, produce extreme dwarfing and/or shoot termination when over-expressed. Overexpression of G157 was not observed to have deleterious effects. 35S::G157 Arabidopsis plants were healthy and attained a wild-type stature when mature. Irrespective of the mode of G157 action, and whether its true biological role is as an activator or a repressor of flowering, the results suggested that G157 may produce either early or late flowering, according to the level of over-expression.

G162 (SEQ ID NO: 71)

Published Information

G162 corresponds to gene At2g34440 (AAC26702), and it has also been referred to as AGL29.

Experimental Observations

The function of G162 was studied using transgenic plants in which the gene was expressed under the control of the 35S promoter. 35S::G162 plants were wild-type in morphology and development. Overexpression of G1162 resulted in a significant increase in oil content in seeds, as measured by NIR.

Utilities

G162 or its equivalogs may be used to increase seed oil content and manipulate seed protein content in crop plants.

G180 (SEQ ID NO: 87)

Published Information

G180 was identified in the sequence of BAC F16B22 (GenBank accession number AC003672).

Experimental Observations

The complete sequence of G180 was determined. G180 was not annotated in the sequence of Arabidopsis thaliana chromosome II section 239 of 255 of the complete sequence (AC003672.2), where it resides between At2g44740 and At2g44750.

The function of G180 was analyzed using transgenic plants in which this gene was expressed under the control of the 35S promoter.

G1180 overexpressing plants were early flowering, but did not exhibit other major developmental alterations. A number of Arabidopsis genes have already been shown to accelerate flowering when constitutively expressed. These include LEAFY, APETALA1 and CONSTANS. In these cases, however, the early flowering plants showed undesirable side effects such as extreme dwarfing, infertility, or premature termination of shoot meristem growth (Mandel et al. (1995) Nature 377:522-524; Weigel et al. (1995) 377: 495-500; Simon et al. (1996) Nature 384:59-62). It appeared that G180 induced flowering without these toxic pleiotropic effects.

G180 overexpressing lines also showed a decrease in seed oil content. That decrease was accompanied increased seed protein content in one of the three lines analyzed.

Utilities

G180 overexpression appeared to alter flowering time by accelerating the transition from vegetative to reproductive state. Therefore, G180 or its equivalogs may be used to manipulate flowering time in plants. In addition, G180 or its equivalogs can also have utility in modifying seed traits, particularly in modifying seed oil and protein levels in crop plants.

G188 (SEQ ID NO: 97)

Published Information

G188 corresponds to gene MXC20.3, first identified in the sequence of clone MXC20 (released by the Arabidopsis Genome Initiative; GenBank accession number AB009055). No published information is available about the function(s) of G188.

Experimental Observations

The annotation of G188 in BAC AB009055 was experimentally confirmed. G188 appeared to be expressed in all tissues and under all conditions examined.

A line homozygous for a T-DNA insertion in G188 was initially used to characterize the function of this gene. The T-DNA insertion in G188 was localized in the second intron of the gene, which is located in the middle of the conserved WRKY box. This insertion resulted in a null mutation. G1188 mutant plants displayed several phenotypic alterations in physiological assays. G1188 knockout mutant seed germinated slightly better than wild-type controls under several kinds of osmotic stress. G1188 knockout plants also showed higher susceptibility to the necrotroph fungal pathogen Fusarium oxysporum compared to control plants; more disease spread after infection. No significant morphological changes were observed in G188 knockout plants.

Utilities

G188 or its equivalogs can be used to enhance seed germination under adverse osmotic conditions. G188 or equivalogs may also be used to manipulate a plant's response to *Fusarium oxysporum*, and perhaps other pathogens.

G192 (SEQ ID NO: 101)

Published Information

G192 corresponds to gene A_IG002N01.6, first identified in the sequence of BAC clone A_IG002NO1 (released by the *Arabidopsis* Genome Initiative; GenBank accession number AF007269).

Experimental Observations

The annotation of G192 in BAC AF007269 was experimentally confirmed. G192 was expressed in all plant tissues and under all conditions examined. Its expression was induced upon infection by *Fusarium*.

The function of G192 was analyzed using transgenic plants in which this gene was expressed under the control of the 35S promoter. G192 overexpressors were late flowering under 12 hour light and had more leaves than control plants. This phenotype was manifested in the three T2 lines analyzed. In addition, one line showed a decrease in seed oil content. No other differences between G192 overexpressing lines and control plants were noted in the assays performed.

A decrease in seed oil observed previously in one transgenic line was replicated in an independent experiment.

Utilities

G192 overexpression delayed flowering. A wide variety of applications exist for genes or their equivalogs that either lengthen or shorten the time to flowering, or for systems of inducible flowering time control. In particular, in species where the vegetative parts of the plants constitute the crop and the reproductive tissues were discarded, it would be advantageous to delay or prevent flowering. Extending vegetative development may bring about large increases in yields.

G192 or its equivalogs can be used to manipulate seed oil content, which might be of nutritional value.

G196 (SEQ ID NO: 105)

Published Information

G196 corresponds to gene At2g34830 (AAC12823).

Experimental Observations

The function of G196 was studied using transgenic plants in which the gene was expressed under the control of the 35S promoter. 35S::G196 plants show more tolerance to salt stress in a germination assay. Overexpression of G196 also produced a range of effects on plant morphology including a reduction in overall size, lowered fertility and changes in leaf shape. T1 seedlings were typically small, often had abnormal shaped cotyledons, and the rosette leaves produced by these plants were often undersized, contorted and darker green compared with wild type. Later in development, during the reproductive stage, the plants formed thin inflorescences bearing poorly fertile flowers with underdeveloped organs. 35S::G196 primary transformants were obtained at a relatively low frequency, suggesting that the gene might have lethal effects if overexpressed at very high levels.

35S::G196 plants were wild-type in the biochemical analyses that were performed. G196 was ubiquitously expressed (and different levels among the various tissues).

Utilities

G1196 or its equivalogs may be used to improve plant performance under conditions of salt stress. Evaporation from the soil surface causes upward water movement and salt accumulation in the upper soil layer where the seeds were placed. Thus, germination normally takes place at a salt concentration that is higher than the mean salt concentration in the whole soil profile. Increased salt tolerance during the germination stage of a crop plant may impact survivability and yield.

G211 (SEQ ID NO: 121)

Published Information

G211 corresponds to AtmybS (U26935; Li et al. (1996) *FEBS Lett* 379:117-121). *Arabidopsis* plants transgenic for a chimeric AtmybS promoter/GUS gene expressed the enzyme in developing leaf trichomes, stipules, epidermal cells on the margins of young rosette and cauline leaves, and in immature seeds. In immature seeds, Atmyb5 expression occurs between fertilization and the 16 cell stage of embryo development and persists beyond the heart stage.

Experimental Observations

The function of G211 was investigated using a homozygous mutant line in which a T-DNA was inserted into the coding region of the gene as well as using transgenic lines in which G211 is expressed under the control of the 35S promoter. The phenotype of the G211 knockout mutant plants was wild-type in all respects. Overexpression of G211, however, had marked effects on leaf and inflorescence development. 35S::G211 plants were generally small, slow developing, and produced rounded, slightly serrated leaves, with very short petioles. Additionally these plants were dark green in coloration, and in some cases, appeared to have reduced trichome density. Following the switch to reproductive growth, 35S::G211 inflorescences had short internodes and showed a general reduction in apical dominance, leading to a bushy appearance. In many cases, due to the small size, seed yield was reduced compared with wild-type controls. These effects were highly penetrant and were apparent in the majority of T1 lines and, to some extent, in each of the three T2 populations. An increase in leaf xylose in two lines was also observed in the T2 35S::G211 transgenics.

As determined by RT-PCR, expression of G211 was found primarily in embryos and siliques. G211 expression in leaf tissue was unaffected by any environmental stress-related condition tested.

Utilities

G211 overexpression resulted in plants with altered leaf insoluble sugar content. Transcription factors such as G211 or their equivalogs that alter plant cell wall composition have several potential applications including altering food digestibility, plant tensile strength, wood quality, pathogen resistance and in pulp production.

In particular, hemicellulose is not desirable in paper pulps because of its lack of strength compared with cellulose. Thus, modulating the amounts of cellulose vs. hemicellulose in the plant cell wall is desirable for the paper/lumber industry. Increasing the insoluble carbohydrate content in various fruits, vegetables, and other edible consumer products will result in enhanced fiber content. Increased fiber content would not only provide health benefits in food products, but might also increase digestibility of forage crops. In addition, the hemicellulose and pectin content of fruits and berries affects the quality of jam and catsup made from them. Changes in hemicellulose and pectin content could result in a superior consumer product.

G214 (SEQ ID NO: 127)

Published Information

G214 (CCA1) was published by Wang et al. (1997) *Plant Cell* 9: 491-507. CCA1 is involved in phytochrome induction of CAB genes. The transcript is transiently induced by phytochrome and oscillates with a circadian rhythm. It feedback-regulates its own expression at the transcriptional level. Overexpressing CCA1 abolished circadian rhythm of several genes and results in plants that were late flowering, and have elongated hypocotyls.

Experimental Observations

G214 overexpressing lines were late bolting, show larger biomass (increased leaf number and size), and were darker green in vegetative and reproductive tissues due to a higher chlorophyll content in the later stages of development. In these later stages, the overexpressors also have higher insoluble sugar, leaf fatty acid, and carotenoid content per unit area. One line also showed a significant, repeatable increase in lutein levels in seeds. Microarray data was consistent with the morphological and biochemical data in that the genes that were highly induced included chloroplast localized enzymes, and light regulated genes such as Rubisco, carbonic anhydrase, and the photosystem 1 reaction center subunit precursor. A chlorophyll biosynthetic enzyme was also highly induced, consistent with the dark green color of the adult leaves and perhaps a higher photosynthetic rate. A measurement of leaf fatty acid in the older overexpressors suggested that the overall levels were higher than wild-type levels (except for the percent composition of 16:3 in one line). Percent composition of 16:1 and 16:3 fatty acids (found primarily in plastids) is similar to wild type arguing against an increase in chloroplast number as an explanation for increase chlorophyll content in the leaves. Three G214-overexpressing lines were sensitive to germination on high glucose showing less cotyledon expansion and hypocotyl elongation suggesting the late bolting and dark green phenotype could be tied into carbon sensing which has been shown to regulate phytochrome A signaling (Dijkwel et al. (1997) *Plant Cell* 9:583-595; Van Oosten et al. (1997) *Plant J.* 12:1011-1020). Sugars are key regulatory molecules that affect diverse processes in higher plants including germination, growth, flowering, senescence, sugar metabolism and photosynthesis. Glucose-specific hexose-sensing has also been described in plants and implicated in cell division and the repression of famine genes (photosynthetic or glyoxylate cycles).

Utilities

Potential utilities of this gene or its equivalogs include increasing chlorophyll content allowing more growth and productivity in conditions of low light. With a potentially higher photosynthetic rate, fruits can have higher sugar content. Increased carotenoid content may be used as a nutraceutical to produce foods with greater antioxidant capability. G214 or its equivalogs can also be used to manipulate seed composition, which is very important for the nutritional value and production of various food products.

G214 overexpression delayed flowering time in transgenic plants, and thus this gene or its equivalogs would be useful in modifying flowering time. In a sizeable number of species, for example, root crops, where the vegetative parts of the plants constitute the crop and the reproductive tissues were discarded, it is advantageous to identify and incorporate transcription factor genes that delay or prevent flowering in order to prevent resources being diverted into reproductive development. Extending vegetative development can thus bring about large increases in yields.

G225 (SEQ ID NO: 139)

Published Information

G225 is equivalent to the *Arabidopsis* gene CPC, or CAPRICE (Wada et al. (1997) *Science* 277:1113-1116; U.S. Pat. No. 5,831,060). G225 or CAPRICE is involved in epidermal cell differentiation. Mutations in the gene result in plants with very few root hairs and the overexpression of the gene causes an increase in the number of root hairs and a near trichome-less leaf phenotype (Wada, (1997) supra).

Experimental Observations

The function of G225 was analyzed through its ectopic overexpression in plants. G225 overexpressors showed more root growth and were larger than wild-type controls on nitrogen-limiting media. In addition, the seedlings lacked anthocyanin production in response to several stress treatments. G225 overexpressors were glabrous and produced ectopic root hairs. The overexpressors also had more root hairs than wild-type controls on MS media (without treatment), but under conditions of low nitrogen these overexpressors produced even more root hairs. In addition, G225 overexpressors germinated better at 32° C. under heat stress. It is possible that better germination in the heat could be related to tolerance to water deficiency or drought tolerance. The nitrogen and heat tolerant phenotypes have not been reported for this gene.

Consistent with the tolerance to low nitrogen, this line showed an ammonium transporter induced 3.3-fold as well as a nitrate transporter (CHL1) 2.2-fold over wild-type. It is possible that the greater number of root hairs could account for the increase in transcript levels of these two genes and could also account for the phenotype we observe. The nitrate transporter is localized to root hairs (Huang et al. (1999) *Plant Cell* 11: 1381-1392.

Utilities

G225 may be used to produce plants that are more tolerant to conditions of low nitrogen and heat.

G226 (SEQ ID NO: 141)

Published Information

G226 was identified from the *Arabidopsis* BAC sequence, AC002338, based on its sequence similarity within the conserved domain to other Myb family members in *Arabidopsis*. To date, there is no published information regarding the function of this gene.

Experimental Observations

The function of G226 was analyzed through its ectopic overexpression in plants. G226 overexpressors were more tolerant to low nitrogen and high salt stress. They showed more root growth and possibly more root hairs under conditions of nitrogen limitation compared with wild-type controls. Many plants were glabrous and lacked anthocyanin production when under stress such as growth conditions of low nitrogen and high salt. Several G226 overexpressors were glabrous and produce less anthocyanin under stress; these effects might be due to binding site competition with other Myb family transcription factors involved in these functions and not directly related to the primary function of this gene.

Results from the biochemical analysis of G226 overexpressors suggested that one line had higher amounts of seed protein, which could have been a result of increased nitrogen uptake by these plants.

A microarray experiment was done on a separate G226 overexpressing line. The G226 sequence itself was overexpressed 16-fold above wild type, however, very few changes in other gene expression were observed in this line. On the array, a chlorate/nitrate transporter DNA sequence was induced 2.7fold over wild type, which could explain the low nitrogen tolerant phenotype of the plants and the increased amounts of seed protein in one of the lines. The same DNA sequence was present several times on the array and in all cases the DNA sequence showed induction, adding more validity to the data. Five other genes/DNA sequences induced but had unknown function. A methyltransferase, a pollen-specific protein, and a zinc binding peroxisomal membrane protein encoding sequences were also induced, however their role in regard to the phenotype of the plants is not known.

Utilities

The utilities of a gene or its equivalogs conferring tolerance to conditions of low nitrogen include: (1) Cost savings to the farmer by reducing the amounts of fertilizer needed; (2) Environmental benefits of reduced fertilizer runoff; (3) Improved yield and stress tolerance. In addition, G226 can be used to increase seed protein amounts and/or composition, which may impact yield as well as the nutritional value and production of various food products.

G226 or its equivalogs can be used to alter trichome number and distribution in plants. Trichome glands on the surface of many higher plants produce and secrete exudates, which give protection from the elements and pests such as insects, microbes and herbivores. These exudates may physically immobilize insects and spores, may be insecticidal or antimicrobial or they may allergens or irritants to protect against herbivores. It has also been suggested that trichomes may decrease transpiration by decreasing leaf surface airflow, and by exuding chemicals that protect the leaf from the sun.

G241 (SEQ ID NO: 163)

Published Information

G241 is equivalent to Y19 (X90384), a putative light regulated Myb that was identified by Quaedvlieg et al. (1996) *Plant Mol. Biol.*32:987-993. The Myb Consortium renamed this gene MYB15 and found that it was constitutively expressed at a low level with expression higher in etiolated seedlings (Kranz et al. (1998) *Plant J.* 16:263-276).

Experimental Observations

The function of G241 was analyzed through its ectopic overexpression in plants as well as through the analysis of a line homozygous for a knockout mutation in G241. The knockout mutant plants were wild-type in all assays performed. G241 overexpressors had a glucose germination phenotype suggesting these plants could be involved in glucose-specific sugar sensing.

Results from the biochemical analysis of G241 knockouts showed that a lower amount of seed oil and an increase in seed protein.

RT-PCR analysis of the endogenous levels of G241 showed the gene is expressed in all tissue types tested.

Results from an array experiment using a G241 overexpressor line were consistent with expression in seeds. Several gene sequences were induced that could be involved in osmotic stress tolerance or desiccation tolerance, which are important for germinating seeds. In this experiment, the G241 DNA sequence itself was induced 38-fold. Many of the induced genes were transcription factors with unknown function. Both CBF1 and CBF2 (involved in freezing tolerance) were up-regulated. As mentioned above, several genes indicative of osmotic stress tolerance were also up-regulated. These same gene sequences were up-regulated on arrays of plants treated with mannitol as an osmotic stress, in a CBF2 overexpressor, and in cold-acclimated plants. A glucose transporter sequence was also upregulated, however, this gene sequence is not up-regulated in any of the other arrays mentioned above. The phenotype of the overexpressor was reduced seedling growth on high glucose. It is possible that the plants were taking up more glucose. In such a scenario, the gene is not likely to be involved in sugar sensing but rather the high glucose condition is inhibiting their growth. The G241 overexpressors were tested for osmotic stress tolerance using mannitol. It is possible the glucose transporter is increasing mannitol uptake and increasing its toxicity to the plant as well. Polyethylene glycol (PEG) is an alternative osmoticum that can be tested at various concentrations.

Utilities

One potential utility of this gene or its equivalogs can be to engineer plants that are tolerant to stress. This can greatly impact yield. Alternatively, if this gene is involved in sugar sensing, the potential utility of a gene involved in glucose-specific sugar sensing is to alter energy balance, photosynthetic rate, biomass production, and senescence. Sugars are key regulatory molecules that affect diverse processes in higher plants including germination, growth, stress responses, flowering, senescence, sugar metabolism and photosynthesis. Glucose-specific hexose-sensing has been described in plants and implicated in cell division, and repression of famine genes (photosynthetic or glyoxylate cycles). This gene may also be used to alter oil and protein production in seeds, which may be very important for the nutritional quality and caloric content of foods.

G248 (SEQ ID NO: 171)

Published Information

G248 was identified at Mendel Biotechnology. Kranz et al. ((1998) *Plant J.* 16:263-276) published a cDNA sequence corresponding to G248, naming it MYB22.

Experimental Observations

The function of G248 was analyzed using transgenic plants in which the gene was expressed under the control of the 35S promoter. The phenotype of these transgenic plants was wild-type with respect to their morphology. However, overexpression of G248 in *Arabidopsis* was found to confer greater sensitivity to disease, particularly following infection by *Botrytis cinerea*. All three lines show the susceptible phenotype.

As determined by RT-PCR, G248 appears to be expressed at low levels in embryo and silique tissue. No expression was detected in other tissues. G248 appears to be induced in response to salicylic acid (SA) treatment. It is well know that both synergistic and antagonistic crosstalk between growth regulator controlled defense pathways occurs in response to disease.

Utilities

Since G248 transgenic plants had an altered response to the fungal pathogen *Botrytis cinerea*, G248 or its equivalogs can be used to manipulate the defense response in order to generate pathogen-resistant plants.

G254 (SEQ ID NO: 179)

Published Information

G254 was identified from the *Arabidopsis* BAC sequence, AF007269, based on its sequence similarity within the conserved Myb domain to other Myb family members in *Arabidopsis*.

Experimental Observations

The function of G254 was analyzed through the ectopic overexpression of the gene in plants. Overexpression of G254 resulted in a reduction of germination and reduced seedling growth on glucose containing media. G254 may be involved in sugar sensing.

RT-PCR analysis of the endogenous levels of G254 indicated that this gene was expressed in all tissues tested. A cDNA microarray experiment supported the tissue distribution data by RT-PCR. There was no induction of G254 above its basal level in response to environmental stress treatments. G254 was constitutively expressed.

Utilities

The potential utility of G254 or its equivalogs is to alter source-sink relationships in the plant. Sugars are key regulatory molecules that affect diverse processes in higher plants including germination, growth, flowering, senescence, sugar metabolism, and photosynthesis. Sucrose is the major transport form of photosynthate and its flux through cells has been shown to affect gene expression and alter storage compound accumulation in seeds (source-sink relationships). The potential utilities of a gene involved in glucose-specific sugar sensing are to alter energy balance, photosynthetic rate, carbohydrate accumulation, biomass production, source-sink relationships, and senescence. Glucose-specific hexose-sensing has been described in plants and implicated in cell division and the repression of 'famine' genes (photosynthetic or glyoxylate cycles).

G256 (SEQ ID NO: 183)

Published Information

G256 is equivalent to Y13, a gene that was identified by Quaedvlieg et al. ((1996) *Plant Mol. Biol.* 32:987-093) as being induced in etiolated seedlings one hour after being exposed to light. The Myb consortium has renamed this gene MYB3 1. Quaedvlieg et al. (1996, supra) found a low level of expression in stem and silique tissue with no induction in etiolated seedlings after being exposed to light. However, there was also a slight induction of G256 following cold treatment.

Experimental Observations

The function of G256 was analyzed through its ectopic overexpression in plants. G256 overexpressors had enhanced seedling vigor during cold germination. These overexpressing lines were more tolerant to chilling conditions compared to wild-type controls, as seen in 12-day-old seedlings that were transferred to cold temperatures (8° C.). There was no difference in germination rate under normal growth conditions. The chilling tolerant phenotype is most noticeable with respect to enhanced root growth although the cotyledons show less anthocyanin production than wild-type controls.

Plants overexpressing G256 were also small and early bolting. In the T2, one line lacked the waxy surface on the bolts. Three lines were tolerant to cold germination and therefore co-suppression was not a likely cause of the morphological change observed in one line. An array experiment was performed on this G256 overexpressing line. The gene itself was induced 3.5-fold over wild-type levels. Very few additional gene sequences were significantly induced in response to G256 overexpression. Induced genes included four gene sequences of unknown function, a sugar carrier sequence, a cell wall degrading enzyme (BGL2) sequence, pectinesterase sequence, and a proteasome subunit protein sequence. Expression of gene sequences such as allene oxidase sequence (which could mean downregulation of the associated jasmonate synthesis pathway), and endochitinase were repressed.

RT-PCR analysis of the endogenous levels of G256 indicated that this gene sequence was expressed primarily in shoots, flowers, and siliques. A cDNA microarray experiment confirmed this tissue distribution data by RT-PCR. There was no induction of G256 in leaves or in seedlings in response to environmental stress treatments.

Utilities

The potential utility of this gene or its equivalogs is to confer better germination and growth in the cold. The germination of many crops is very sensitive to cold temperatures. A gene that would allow germination and seedling vigor in the cold would have tremendous utility in allowing seeds to be planted earlier in the season with a high rate of survivability.

G291 (SEQ ID NO: 209)

Published Information

G291 is referred to in the public literature as the *Arabidopsis* AJH 1, a plant homolog of the c-Jun coactivator. AJH1 was isolated by peptide sequencing of a subunit of the COP9 complex, an important component in light-mediated signal transduction in *Arabidopsis*. It is postulated that the COP9 complex may modulate the activities of transcription factors in response to environmental stimuli. Localization experiment reveals that AJH1 was present in monomeric form, which suggested a possible involvement in other developmentally regulated processes (Kwok et al. (1998) *Plant Cell* 10:1779-1790). G291 is found in the sequence of the chromosome 1 BAC F 19G 10 (GenBank accession AF000657.1 GI:2098816), released by the *Arabidopsis* Genome Initiative. The start and stop codons were correctly predicted.

Experimental Observations

The expression profile of G291 revealed a low, but constitutive, expression of G291 transcripts in all tissues examined. G291 transcript levels were similar to the wild-type controls in all the physiological treatments examined as determined by RT-PCR analysis.

G291 overexpressors produced significantly more seed oil than wild-type plants.

Utilities

G291 or its equivalogs can be used to increase seed oil content, which may be of nutritional value for food for human consumption as well as animal feeds.

G325 (SEQ ID NO: 223)

Published Information

G325 was identified as a gene in the sequence of chromosome 4, ESSA I FCA contig fragment No. 3 (GenBank Accession number Z97338), released by the European Union *Arabidopsis* Sequencing Project.

Experimental Observations

The function of G325 was analyzed using transgenic plants in which G325 was expressed under the control of the 35S promoter. G325 overexpressing plants had more tolerance to osmotic stress in a germination assay in three separate experiments. They had more seedling vigor than wild-type control when germinated on plates containing high salt and high sucrose. No altered morphological phenotypes or altered phenotypes in the biochemical assays were observed.

G325 was expressed at high levels in flowers and cauline leaves, and at lower levels in shoots, rosette leaves, and seedlings. G325 was induced by auxin, cold- and heat-stress. The expression of G325 also was reduced in response to Fusarium infection or salicylic acid treatment.

Utilities

G325 or its equivalogs may be useful for enhancing seed germination under high salt conditions or other conditions of osmotic stress. Evaporation from the soil surface causes upward water movement and salt accumulation in the upper soil layer where the seeds are placed. Thus, germination normally takes place at a salt concentration much higher than the mean salt concentration in the whole soil profile. Increased salt tolerance during the germination stage of a crop plant would impact survivability and yield.

G325 or its equivalogs can also be used to engineer plants with enhanced tolerance to drought, salt stress, and freezing, at later stages.

G361 (SEQ ID NO: 237)

Published Information

G361 was first isolated by Tague et al. ((1995) *Plant Mol. Biol.* 28:267-279) in an effort to study the sequence and the expression pattern of $C_2H_2$ zinc finger protein encoding genes in *Arabidopsis* (Takatsuji (1998) *Cell. Mol. Life Sci.* 54:582-596). The latter study showed that G361 (ZFP6) was mostly expressed in roots and shoots based on Northern analysis.

Experimental Observations

A full-length cDNA was isolated and used to transform plants. G361 overexpressors were small and very late bolting. The plants did not show any physiological phenotype. G361 overexpressing plants had increased levels of polyunsaturated fatty acids. The phenotype could be related to the darker green color of the plants and their possible higher chlorophyll content (repeat of analysis also in progress). Higher 16:3 fatty acid content, in particular, could be a reflection of a higher chloroplast number or more chloroplast membranes. RT-PCR data showed that the gene was expressed mostly in shoots and in roots at low levels.

Utilities

The late-flowering phenotype of G361 or its equivalogs is useful in that late flowering is desirable in crops where the vegetative portion of the plant is harvested (often vegetative growth stops when plants make the transition to flowering). In this case, it can be advantageous to prevent or delay flowering in order to increase yield. Also, prevention of flowering can be useful in these same crops in order to prevent the spread of transgenic pollen and/or to prevent seed set. In any case, the overexpressors were clearly smaller, an undesirable phenotype which has to be corrected before overexpression of the gene can lead to any useful crop product.

G390 (SEQ ID NO: 249)

Published Information

G390 was isolated by Ruzza et al. (GenBank Accession: CAD29544, gi:20069421) using degenerate oligonucleotides corresponding to a conserved 6 amino acid sequence from the helix-3 region of athb-1 and athb-2. It was named athb-9. The published Northern blot showed slightly higher level of expression in stems, and lower levels in leaves, flowers, roots, and siliques. The G390 protein shares very extensive amino acid identity with other HD-ZIP class III proteins that exist in *Arabidopsis* (for example, G391 and G438). HD-ZIP class III proteins are known to have complex roles in determining meristem development, vascular tissue formation, and stem lignification (Baima et al. (1995) *Development* 12:4171-4182; Baima et al. (2001) *Plant Physiol.* 126:643-655; Talbert et al. (1995) *Development* 121:2723-2735; Zhong et al. (1997) *Plant Cell* 9:2159-2170; Sessa et al. (1998) *Plant Mol. Biol.* 38:609-622; Zhong et al. (1999) *Plant Cell* 11:2139-2152; Ratcliffe et al. (2000) *Plant Cell* 12:315317; and Otsuga et al. (2001) *Plant J.* 25:223-236).

Experimental Observations

Fourteen 35S::G390 Ti lines were obtained which displayed a consistent morphological phenotype; the majority of these plants were slightly small, had abnormal phyllotaxy, and exhibited stem bifurcations in which shoot meristems split to form two or three separate shoots. Additionally, a significant number of these extra T1 lines flowered earlier than controls. Comparable effects were obtained by overexpression of G391.

Utilities

The overexpression data suggest that G390 or its equivalogs has utility in the manipulation of shoot architecture. Additionally, since a number of the 35S::G390 lines flowered early, this gene or its equivalogs can be used to manipulate flowering time.

G409 (SEQ ID NO: 261)

Published Information

G409, also named Athb-1, was one of the earliest plant homeodomain leucine (HD-ZIP) zipper genes cloned. It was isolated from a cDNA library by highly degenerate oligonucleotides corresponding to a conserved eight amino acid sequence from the helix-3 region of the homeodomain. The protein was found to transactivate a promoter linked to a specific DNA binding site (CAATTATTG) by transient expression assays. Overexpression of Athb-1 affected the development of palisade parenchyma under normal growth conditions, resulting in light green sectors in leaves and cotyledons, whereas other organs in the transgenic plants remained normal.

Experimental Observations

G409 was induced by drought and repressed by NaCl. Plants overexpressing G409 were more tolerant to infection by the fungal pathogen *Erysiphe orontil*. In addition to the *Erysiphe* tolerant phenotype, the overexpressors were slightly early flowering.

Utilities

The expression of transcription factors such as G409 or its equivalogs involved in plant/pathogen interaction can be modulated to manipulate the plant defense wound or insect-response in order to generate pathogen resistant plants.

G438 (SEQ ID NO: 283)

Published Information

G438 was identified as a homeobox gene (MUP 24.4) within P1 clone MUP 24 (GenBank accession number AB005246). G438 was identified as the *Arabidopsis* REVOLUTA (REV) gene (Ratcliffe et al. (2000) *Plant Cell* 12:315-317). Based on its mutant phenotype, REVhad previously been identified as having a key role in regulating the relative growth of apical versus non-apical (cambial) meristems (Alvarez (1994) in *Arabidopsis: An Atlas of Morphology and Development* (ed. J. Bowman), pp.188-189, New York, N.Y.: Springer-Verlag; Talbert et al. (1995) *Development* 121:2723-2735). The revoluta phenotype was highly pleiotropic but was characterized by a failure in development of all types of apical meristem: lateral shoot meristems in the axils of cauline and rosette leaves were often completely absent, or replaced by a solitary leaf. These effects were most evident in higher order shoots, but in some cases, the primary shoot meristem also failed and terminated growth in a cluster of filamentous structures. Rev floral meristems often failed to complete normal development and form incomplete or abortive filamentous structures. In contrast to apical meristems, structures formed by nonapical meristems, such as leaves, stems, and floral organs often became abnormally large and contorted in the rev mutant.

The features of rev mutants were similar to those of the interfascicular fiberless I (ifl1) mutant. Ifl1 was isolated during screens for mutants lacking normal stem fiber differentiation (Zhong et al. (1997) *Plant Cell* 9:2159-2170). Wild-type *Arabidopsis* plants form interfascicular fibers which became lignified and added support to the inflorescence stem (Aloni (1987) *Annu. Rev. Plant Physiol.* 38:179-204); Zhong et al. (1997) supra; Zhong et al. (1999) *Plant Cell* 11:2139-2152). In the ifl1 mutant, normal interfascicular fibers were absent and the differentiation of both xylary fibers and vessel elements was disrupted. In addition to these internal features, ifl1 mutants had secondary morphological features very similar to those of rev. Recently the IFL1 gene was cloned by Zhong et al. (1999 supra). It was found that the IFL1 sequence and map position were identical to those of the REV gene cloned, demonstrating that REV and IFL1 are the same gene. (Ratcliffe et al. (2000) supra).

It had been suggested that REV promotes the growth of apical meristems (including floral meristems) at the expense of non-apical meristems (Talbert et al. (1995) supra). It is not yet clear, however, whether expression data support such a role: strong expression of REV has been detected in interfascicular regions and developing vascular tissue, but in-situ expression analysis of apical meristems has not yet been reported. (Zhong et al. (1999) supra). REV is a group III HD-ZIP protein and shares high sequence similarity (and organization) with the proteins encoded by three other *Arabidopsis* genes: Athb8, Athb9, and Athb14 (Sessa et al. (1998) *Plant Mol. Biol.* 38:609-622). It is possible, therefore, that these genes act together in the same developmental process. Supporting this suggestion, Athb8 had a similar expression pattern to REV and was transcribed in the procambial regions of vascular bundles (Baima et al. (1995) *Development* 12:4171-4182).

Experimental Observations (Knockout)

G438 was initially identified as MUP24.4, a novel putative homeobox gene within P1 clone MUP24 (GenBank Accession AB005246). Annotation was confirmed by isolation of the G438 cDNA: the cDNA had an in-frame stop codon immediately 5' to the predicted start codon and comprised 18 exons that had been predicted within the genomic sequence.

Plants homozygous for a T-DNA insertion in the G438 sequence were obtained by PCR based screening of DNA pools from the Jack Collection of insertional mutants (Campisi et al. (1999) Plant Journal 17:699-707). The T-DNA insertion was located 466 bp downstream of the putative start codon, and was predicted to create a null mutation. The mutation was recessive and produced a revoluta phenotype. Complementation crosses and sequencing of a known revoluta allele demonstrated that G438 was REVOLUTA.

RT-PCR analyses detected G438 expression at medium to high levels in all tissues and conditions tested. Further expression analysis was possible since the T-DNA insertion contained an enhancer trap construct (Campisi et al. (1999) supra). GUS staining could therefore be used to reveal the expression pattern of genes within which insertions occurred. GUS staining of seedlings homozygous and heterozygous for the G438 T-DNA insertion revealed very strong expression within axillary shoots. This expression data correlates with the marked effects of the rev mutation on outgrowth of higher order shoots.

Experimental Observations (Overexpressor)

A full-length clone was amplified from cDNA derived from mixed tissue samples, and 35S::G438 transformants were generated. These lines appeared wild-type in the physiological assays, but showed differences in morphology compared with control plants. At early stages, a small number of T1 plants displayed aberrant phyllotaxy and were rather dwarfed, but these effects were inconsistent, and the majority of lines appeared wild-type. At later stages, however, around half of the primary transformants, from two of the three T1 sowings, developed slightly larger flatter leaves than wild type at late stages. The progeny of four lines that had shown these phenotypes were examined in the T2 generation. At late stages, plants from two of these T2 populations again displayed slightly broad flat leaves, but plants from the other two T2 populations appeared wild-type at all stages.

A single T1 plant line out of a total of 37 lines had highly aberrant shoot meristem development. At the early seedling stage, it appeared as though the primary shoot apex of this individual had developed into a terminal leaf-like structure. Subsequent growth then continued from an axillary shoot meristem that initiated from the base of a cotyledon petiole. However, this effect became silenced between generations and was not observed in the T2 progeny from one line. Given that this effect was observed in only a single line, it could have been the result of an activation tagged locus at the T-DNA insertion site, rather than due to G438 expression. However, the phenotype would fit with a role for REV in regulating apical meristem development.

Utilities

The mutant phenotypes indicated that REV/IFL1 or its equivalogs have an important role in determining overall plant architecture and the distribution of lignified fiber cells within the stem. A number of utilities can be envisaged based upon these functions.

Modifying the activity of REVOLUTA orthologs from tree species can offer the potential for modulating lignin content. This can allow the quality of wood used for furniture or construction to be improved. Lignin is energy rich; increasing lignin composition could therefore be valuable in raising the energy content of wood used for fuel. Conversely, the pulp and paper industries seek wood with a reduced lignin content. Currently, lignin must be removed in a costly process that involves the use of many polluting chemicals. Consequently, lignin is a serious barrier to efficient pulp and paper production (Tzira et al. (1998) *TIBTECH* 16:439-446; Robinson (1999) *Nature Biotechnology* 17:27-30). In addition to forest biotechnology applications, changing lignin content might increase the palatability of various fruits and vegetables.

In *Arabidopsis*, reduced REV activity results in a reduction of higher-order shoot development. Reducing activity of REV orthologs may generate trees that lack side branches, and have fewer knots in the wood. Altering branching patterns can also have applications amongst ornamental and agricultural crops. For example, applications might exist in any species where secondary shoots currently have to be removed manually, or where changes in branching pattern could increase yield or facilitate more efficient harvesting.

G464 (SEQ ID NO: 291)

Published Information

G464 is IAA 12, a member of the Aux/IAA class of small, short-lived nuclear proteins that contain four conserved domains. IAA12 was found as one of a group of *Arabidopsis* IAA genes that was isolated based on homology to early auxin-induced genes of pea. IAA12 transcripts were modestly (2 to 4-fold) induced by auxin, with optimal induction at 10 µM auxin (Abel et al. (1995) *J. Mol. Biol.* 251:533-549).

Experimental Observations

G464 overexpressing *Arabidopsis* lines showed enhanced germination in high heat conditions. In addition, one *Arabidopsis* line overexpressing G464 showed an increase in total seed protein and a decrease in total seed oil by NIR in one assay.

Utilities

G464 or its equivalogs in native or altered form is useful to produce plants that germinate better in hot conditions.

G470 (SEQ ID NO: 295)

Published Information

A partial cDNA clone corresponding to G470 was isolated in a two-hybrid screen for proteins that interact with ARF1, a transcription factor that binds to auxin response elements, and this clone was named ARF1 Binding Protein (Ulmasov et al. (1997) *Science* 276:1865-1868). A full-length clone was later isolated, and the gene was renamed ARF2 (Ulmasov et al. (1999a) *Proc. Natl. Acad. Sci.* 96:5844-5849). ARF2 was shown to bind to an auxin response element (Ulmasov et al. (1999b) *Plant J.* 19:309-319).

Co-transfection of ARF2 and a reporter construct with an auxin response element into carrot protoplasts did not result in either activation or repression of transcription of the reporter gene (Ulmasov et al. (1999a) supra). ARF2 binding to palindromic auxin response elements is thought to be facilitated by dimerization mediated by the carboxy-terminal domain of ARF2 (Ulmasov et al. (1999b) supra). It is possible that ARF2 regulates gene expression through heterodimerization with other ARF proteins or with IAA proteins. ARF2 was found to be expressed uniformly in roots, rosette leaves, cauline leaves, flowers, and siliques (Ulmasov et al. (1999b) supra).

Experimental Observations

Expression of a truncated G470 clone in the antisense orientation under the 35S promoter caused infertility in *Arabidopsis*. In primary transformants expressing the G470 clone, the stamens failed to elongate properly. Pollen was produced, but was not deposited on the stigma. The transformants appeared otherwise morphologically normal. Because of the infertility of the primary transformants, no material was available for biochemical and physiological analyses. The truncated clone corresponds to the carboxy-terminal portion of the ARF2 protein, and lacks the DNA binding domain.

Utilities

G470 or its equivalogs are useful in engineering infertility in self-pollinating plants.

G475 (SEQ ID NO: 301)

Published Information

G475 was identified from an *Arabidopsis thaliana* cDNA library using two cDNAs from *Antirrhinum majus*, SPB1 and SPB2, as probes (Cardon et al. (1997) *Plant J.* 12: 367-377). The *Arabidopsis* cDNA, SPL3, which corresponds to G475, is the presumed ortholog of SPB1. In *Antirrhinum majus*, SPB1 was identified as a transcription factor that binds to the promoter of the floral meristem identity gene, SQUAMOSA and is therefore implicated in a plant's transition to flowering. The over-expression of SPL3 (G475) in *Arabidopsis* resulted in plants that were early bolting, with fewer leaves, and plants that often an extra bract subtending the first flower (Cardon et al. (1997) supra). SPL3 antisense plants produced by these authors had no phenotypic differences from wild type.

Closely Related Genes from Other Species

The closest relative to G475 is its homolog in *A. majus*, SPPB1.

Experimental Observations

The function of G475 was analyzed through its ectopic overexpression in plants. The morphological phenotype of the G475 overexpressors confirmed the published phenotype. An array experiment was performed on a G475 overexpressing line. The gene itself was overexpressed six-fold on this array. G475 overexpressors had a flowering phenotype: they were early bolting and had an abnormal inflorescence structure. There were two genes induced on the array that were consistent with this flowering phenotype. One was AGL8, a gene expressed in the inflorescence meristem, stem, cauline leaves and developing fruits (Mandel et al. (1995) *Plant Cell.* 7:1763-1771), whose function appears to be in fruit development (Gu et al.(1998) *Development* 125: 1509-1517). The other gene that was consistent with the abnormal inflorescence structure phenotype was a gene MFP2 (fatty acid multi-functional protein) that is involved in beta-oxidation of fatty acids. Alterations in the MPF2 protein have been reported to cause alterations in inflorescence development in plants.

Utilities

The potential utility of plants with an early bolting phenotype includes: (1) early flowering could accelerate many conventional breeding programs, (2) early flowering without an impact on yield could shorten generation time and allow for multiple harvests per season, and (3) an inducible system that would allow rapid triggering of flowering would allow synchronization of flowering time, which is important in the horticulture industry as well as for any crop that is mechanically harvested.

G477 (SEQ ID NO: 303)

Published Information

G477 corresponds to SPL6 (AJ011643, Cardon et al. (1999) *Gene* 237:91-104), a member of the SBP family of transcription factors. G477 is expressed constitutively throughout the development of *Arabidopsis*. Outside the SBP-domain, G477 has a putative myc-like helix-loop-helix dimerization domain (Cardon et al. (1999) supra).

Experimental Observations

The complete sequence of G477 was determined. The function of this gene was analyzed using transgenic plants in which G477 was expressed under the control of the 35S promoter. The phenotype of these transgenic plants was wild-type in all morphological and biochemical assays performed.

Plants overexpressing G477 were slightly more sensitive to the herbicides glyphosate and acifluorfen and to oxidative stress caused by rose bengal compared with wild-type controls. Plants overexpressing G477 also develop more disease symptoms following inoculation with a moderate dose of *Sclerotinia sclerotiorum* compared with control plants. It is well known that oxidative stress is a component of a plant defense response to pathogen and therefore the disease susceptibility phenotype could be related to a general sensitivity to oxidative stress.

G477 was expressed in all tissues and under all conditions tested in RT-PCR and cDNA microarray experiments.

Utilities

G477 activity was shown to affect the response of transgenic plants to the fungal pathogen *Sclerotinia sclerotiorum* and oxidative stress tolerance. Therefore, G477 or its equivalogs can be used to manipulate the defense response in order to generate pathogen-resistant plants.

G482 (SEQ ID NO: 305)

Published Information

G482 is equivalent to AtHAP3b which was identified by Edwards et al. ((1998) *Plant Physiol.* 117:1015-1022) as an EST with homology to the yeast gene HAP3b. Edwards' northern blot data suggests that AtHAP3b is expressed primarily in roots. No other functional information regarding G482 is publicly available.

Experimental Observations

G482 function was analyzed through its ectopic overexpression in plants under the control of a 35S promoter. G482 overexpressors were more tolerant to high NaCl in a germination assay.

RT-PCR analysis of endogenous levels of G482 transcripts indicated that this gene was expressed constitutively in all tissues tested. A cDNA array experiment supported the RT-PCR derived tissue distribution data. G482 was not induced above basal levels in response to any environmental stress treatments tested.

Utilities

The utilities of this gene or its equivalogs include the ability to confer salt tolerance during the germination stage of a crop plant. This would most likely impact survivability and yield. Evaporation of water from the soil surface causes upward water movement and salt accumulation in the upper soil layer, where the seeds were placed. Thus, germination normally takes place at a salt concentration much higher than the mean salt concentration in the whole soil profile.

G489 (SEQ ID NO: 309)

Published Information

G489 was identified from a BAC sequence that showed high sequence homology to AtHAP5-like transcription factors in *Arabidopsis*. No published information is available regarding the function of this gene.

Experimental Observations

The function of G489 was analyzed through its ectopic overexpression in plants. G489 overexpressors were more tolerant to high NaCl stress, showing more root growth and leaf expansion compared with the controls in culture. Two well characterized ways in which NaCl toxicity is manifested in the plant is through general osmotic stress and potassium deficiency due to the inhibition of its transport. These G489 overexpressor lines were more tolerant to osmotic stress in general, showing more root growth on mannitol containing media.

RT-PCR analysis of endogenous levels of G489 transcripts indicated that this gene was expressed constitutively in all tissues tested. A cDNA array experiment confirmed the RT-PCR derived tissue distribution data. G489 was not induced above basal levels in response to the stress treatments tested.

Utilities

The utilities of this gene or its equivalogs include the ability to confer salt tolerance during the growth and developmental stages of a crop plant. This would impact yield and or biomass.

G509 (SEQ ID NO: 317)

Published Information

G509 was identified in the sequence of BAC F2009, GenBank accession number AL021749, released by the *Arabidopsis* Genome Initiative.

Experimental Observations

The function of G509 was analyzed using transgenic plants in which G509 was expressed under the control of the 35S promoter, as well as using a line homozygous for a T-DNA insertion in G509. The T-DNA insertion of G509 at nucleotide position +1583 with respect to the start ATG codon was approximately half way into the coding sequence of the gene and therefore was likely to result in a null mutation. G509 primary transformants showed no significant morphological differences from control plants, though one T2 line was noted to be small and sickly at the seedling and rosette stages, and pale and late flowering at the flowering stage. Knockout plants showed no consistent morphological differences from controls. G509 knockout plants may be more susceptible to infection with a moderate dose of the fungal pathogen *Erysiphe orontii*; 8 out of 8 plants tested showed more fungal growth compared with the wild-type controls. G509 lines had significantly higher levels of chlorophyll a, and lower levels of chlorophyll b in seeds.

G509 knockout mutants produced more seed oil and more seed protein than wild-type control plants.

Endogenous G509 was expressed constitutively in all tissues tested, with the highest levels of expression in shoots, roots, flowers and siliques.

Utilities

G509 or its equivalogs can be used to produce plants with altered seed oil and seed protein content.

G509 or its equivalogs can be used to manipulate the defense response in order to generate pathogen-resistant plants.

In addition, G509 or its equivalogs can be used to regulate the levels of chlorophyll in seeds.

G545 (SEQ ID NO: 345)

Published Information

G545 was discovered independently by two groups. Lippuner et al. (1996) *J. Biol. Chem.* 271:12859-12866) identified G545 as an *Arabidopsis* cDNA (STZ), which increases the tolerance of yeast to Li+ and Na+. They found that STZ expression is most abundant in leaves and roots, and that its level of expression increases slightly upon exposure of the plant to salt. The second group (Meissner et al (1997) *Plant Mol. Biol.* 33:615-624), identified G545 (ZAT10) in a group of *Arabidopsis* C2H2 zinc finger protein-encoding cDNAs that they isolated by degenerate PCR. According to their data, ZAT10 is expressed in roots, shoots and stems.

Closely Related Genes from Other Species

A closely related non-*Arabidopsis* sequence is a cDNA from the nitrogen-fixing species *Datisca glomerata* (AF119050). The similarity of this sequence with G545 extends beyond the conserved domain.

Experimental Observations

Plants overexpressing G545 flowered early, and in extreme cases were infertile. G545 overexpression conferred tolerance of transgenic plants to phosphate deficiency. This could be the result of insensitivity to phosphate, higher rates of phosphate assimilation or larger stores of phosphate. G545 overexpressors also appeared to be more sensitive to NaCl than wild-type plants. This result was unexpected, since yeast cells overexpressing G545 are more tolerant to salt stress than control cells. There may be a dominant negative effect in plants, triggered by the over-accumulation of the G545 protein, which does not exist in yeast.

G545 overexpressing plants appeared to be significantly more susceptible to pathogens than control plants. This implied a role for the G545 in the control of defense mechanisms.

Utilities

G545 or equivalog overexpression may result in tolerance to phosphate deficiency. Young plants have a rapid intake of phosphorous, so it is important that seed beds have high enough content in phosphate to sustain their growth. Also, root crops such as carrot, potato and parsnip will all decrease in yield if there is insufficient phosphate available. Phosphate costs represent a relatively small but significant portion of farmers' operating costs (3-4% of total costs to a corn farmer in the US, higher to a vegetable grower). Plants that are tolerant to phosphate deficiency can represent a cost saving for farmers, especially in areas where soils are very poor in phosphate.

Another desirable phenotype, salt tolerance, may arise from G545 or equivalog silencing rather than overexpression. Additionally, G545 appeared to be induced by cold, drought, salt and osmotic stresses, which was in agreement with a potential role of the genes in protecting the plant in such adverse environmental conditions.

G545 also appears to be involved in the control of defense processes. However, overexpression of G545 made *Arabidopsis* plants more susceptible to disease. This negative effect will have to be corrected before G545 can be used in a crop to induce tolerance to low phosphate, such as by restricting overexpression of G545 or its equivalogs to roots.

G561 (SEQ ID NO: 359)

Published Information

G561 is the *Arabidopsis* gene GBF2 (Schindler et al (1992) *EMBO J.* 111:1261-1273), which was cloned by hybridization to GBF1. GBF2 is constitutive in both light and dark grown leaves, expressed in roots, and the nuclear import of GBF1 may be light regulated (Terzaghi et al (1997) *Plant J.* 11: 967-982).

Closely Related Genes from Other Species

Close relatives of G561 include a G-box binding protein from *Sinapis alba* (Y16953; unpublished) and a G-Box binding protein from *Raphanus sativus* (X92102, unpublished).

Experimental Observations

The function of G561 was analyzed using transgenic plants in which this gene was expressed under the control of the 35S promoter. Plants over-expressing G561 showed more root growth on potassium free media. Expression of G561 also appears to be constitutive, and may be preferentially expressed in siliques and moderately inducible with heat stress.

An important aspect of the potassium root growth assay is that plants were firstly germinated on media with potassium and then transferred onto potassium-free media. G561 overexpressors may have be able to somehow cope with less potassium, and it is also possible that G561 overexpressors accumulated more potassium before they were transferred, which allowed the roots to grow more vigorously after transfer.

As measured by NIR, G561 overexpressors were found to have increased seed oil content compared to wild-type plants.

Utilities

G561 or its equivalogs could be used to increase seedling vigor or plant growth in soils that are low in potassium. Potassium is a macronutrient required for a variety of basic plant functions which is commonly added to soil as a fertilizer. The ability to grow plants on low potassium soils may save the ecological and material cost of soil fertilization.

G561 or its equivalogs may also be used to manipulate sterol composition., and may be used to modify seed oil content in plants, which may be very important for the nutritional value and production of various food products.

G562 (SEQ ID NO: 361)

Published Information

G562 is the published *Arabidopsis* transcription factor GBF3, which was cloned through its hybridization with GBF1 (Schindler et al. (1992) *EMBO J.* 11: 1261-1273). GBF3, like GBF1 and GBF2, can bind G-box elements as a homodimer, or as a heterodimer with other bZIP family members. GBF3 appears to be highly expressed in roots in comparison to leaves, and repressed by light. GBF3 binds to Gbox elements in the *Arabidopsis* ADH promoter in vitro, is induced by ABA in suspension cultures, and is proposed to be the transcription factor responsible for the ABA regulated ADH gene expression (Lu et al. (1996) *Plant Cell.* 8:847-857).

Closely Related Genes from Other Species

Similar genes to G562 include the *B. napus* proteins BnGBF1 and BnGBF2 (U27107 and U27108) which are strikingly similar to G562 for their entire lengths. An unpublished *Catharanthus roseus* G-box binding protein 1 protein (AF084971) also has significant homology to G562 outside of the conserved domain.

Experimental Observations

G562 appeared to be preferentially expressed in root and flower tissues by RT-PCR analysis, and expressed at lower levels in other tissues of the plant. G562 was induced by heat, drought and osmotic stress in seedlings. The function of G562 was analyzed using transgenic plants in which G562 was expressed under the control of the 35S promoter. Plants overexpressing G562 were consistently and significantly later flowering, with more crinkled leaves than wild-type plants.

Utilities

G562 or its equivalogs could be used to manipulate flowering time in plants.

G567 (SEQ ID NO: 369)

Published Information

G567 was discovered as a bZIP gene in BAC T10P11, accession number AC002330, released by the *Arabidopsis* genome initiative.

Closely Related Genes from Other Species

G567 is similar to two bZIP factors from *Petroselinum crispum* (1806261) and *Glycine max* (1905785). Similarity between these two proteins and the protein encoded by G567 extends beyond the conserved domains and thus they may have a function and utility to G567.

Experimental Observations

The annotation of G567 in BAC AC002330 was experimentally confirmed and the function of G567 was analyzed using transgenic plants in which G567 was expressed under the control of the 35S promoter.

Seedlings overexpressing G567 had slowly opening cotyledons and very short roots when grown on MS plates containing glucose. G567 is thus likely to be involved in sugar sensing or metabolism during germination.

As measured by NIR analysis, plants overexpressing G567 had an increase in total combined seed oil and seed protein content.

G567 appears to be constitutively expressed, and induced in leaves in a variety of conditions.

Utilities

G567 or its equivalogs may be useful in manipulating seed oil and protein content.

G567 or its equivalogs may be used to modify sugar sensing.

In addition to their important role as an energy source and structural component of the plant cell, sugars are central regulatory molecules that control several aspects of plant physiology, metabolism and development. It is thought that this control is achieved by regulating gene expression and, in higher plants, sugars have been shown to repress or activate plant genes involved in many essential processes such as photosynthesis, glyoxylate metabolism, respiration, starch and sucrose synthesis and degradation, pathogen response, wounding response, cell cycle regulation, pigmentation, flowering and senescence.

Because sugars are important signaling molecules, the ability to control either the concentration of a signaling sugar or how the plant perceives or responds to a signaling sugar could be used to control plant development, physiology or metabolism. For example, the flux of sucrose (a disaccharide sugar used for systemically transporting carbon and energy in most plants) has been shown to affect gene expression and alter storage compound accumulation in seeds. Manipulation of the sucrose signaling pathway in seeds may therefore cause seeds to have more protein, oil or carbohydrate, depending on the type of manipulation. Similarly, in tubers, sucrose is converted to starch which is used as an energy store. It is thought that sugar signaling pathways may partially determine the levels of starch synthesized in the tubers. The manipulation of sugar signaling in tubers could lead to tubers with a higher starch content.

Thus, manipulating the sugar signal transduction pathway may lead to altered gene expression to produce plants with desirable traits. In particular, manipulation of sugar signal transduction pathways could be used to alter source-sink relationships in seeds, tubers, roots and other storage organs leading to increase in yield.

G584 (SEQ ID NO: 385)

Published Information

G584 was identified in chromosome IV BAC T6K21 sequence (gene T6K21.10) by the EU *Arabidopsis* sequencing project as "bHLH protein-like".

Closely Related Genes from Other Species

A related gene to G584 is *Phaseolus vulgaris* phaseolin G-box binding protein PG1 (U18348). Similarity between G584 and PG1 extends beyond the signature motif of the family. No functional information is available for gene PG1 other than that the protein binds to a G-box motif CACGTG of the bean seed storage protein beta-phaseolin gene.

Experimental Observations

The function of G584 was analyzed using transgenic plants in which G584 was expressed under the control of the 35S promoter. G584 transgenic plants seemed to produce seed of a larger size than control plants. Analysis of G584 overexpressors revealed no apparent physiological or biochemical changes when compared to wild-type control plants. Analysis of the endogenous expression level of G584, as determined by RT-PCR, revealed a moderate and constitutive expression level in all *Arabidopsis* tissues examined. G584 transcript level remained similar to wild-type controls in all the treatments examined.

Utilities

G584 or its equivalogs could be used to produce larger seed size and/or altered seed morphology, which may positively influence seed storage characteristics, appearance and yield.

G590 (SEQ ID NO: 387)

Published Information

The sequence of G590 was obtained from the *Arabidopsis* genome sequencing project, GenBank accession number Z99707, based on its sequence similarity within the conserved domain to other bHLH/Myc related proteins. A knockout mutant in G590, named as SPATULA, has also been isolated and characterized (Heisler et al. (2000) *Development* 128:1089-1098).

Experimental Observations

The function of this gene was studied by knockout analysis and by using transgenic plants in which G590 was expressed under the control of the 35S promoter.

G590 knockout plants produced more seed oil than wild-type controls.

Overexpression of G590 resulted in a reduction in flowering time and a shorter generation time. Under continuous light conditions, G590 overexpressing plants typically produced visible flower buds approximately one week earlier than wild-type controls. At the time of bolting, these plants had 4-8 rosette leaves compared with 8-11 in wild type. Additionally, G590 overexpressor had rather pointed leaves at early stages of development. The plants also appeared slightly small, yellow, and later, had elongated leaf petioles. No other physiological and biochemical alterations were observed in the overexpression transgenic plants when compared to wild-type controls.

Gene expression profiling using RT-PCR shows that G590 was relatively expressed at higher levels in flowers, siliques and roots. Its expression level was unaffected by any of the conditions tested.

Utilities

G590 or its equivalogs could be used to increase seed oil content, which would be of nutritional value for food for human consumption as well as animal feeds.

Based on the current analysis of G590 overexpressing plants, G590 or its equivalogs could be used to manipulate flowering time. A wide variety of applications exist for systems that shorten the time to flowering.

G592 (SEQ ID NO: 391)

Published Information

The genomic sequence of G592 has been determined as part of the *Arabidopsis* Genome Initiative (BAC clone T24P15, gene T24P15.19, GenBank accession number AC002561). There is no other published information available regarding the function of G592.

Experimental Observations

The function of G592 was analyzed using transgenic plants in which G592 was expressed under the control of the 35S promoter. Plants overexpressing G592 were marginally early flowering. Many of the T1 plants were smaller than wild-type controls. Analysis of G592 overexpressors revealed no apparent physiological or biochemical changes when compared to wild-type control plants. Analysis of the endogenous expression levels of G592, as determined by RT-PCR, revealed a moderate and constitutive expression level in all *Arabidopsis* tissues examined, although expression in roots was slightly higher. G592 expression appeared to be repressed by ABA, cold and salt treatments.

Utilities

Based on the current analysis of G592 overexpressing plants, G592 could be used to manipulate flowering time.

G598 (SEQ ID NO: 393)

Published Information

G598 was identified in chromosome II BAC T6D20 sequence (gene T6D20.23) by The Institute for Genomic Research as an "unknown protein".

Experimental Observations cDNAs representing two splice variants of G598 were identified. These splice variants differ in the 3' end region and would produce proteins with different C-termini. The function of G598 was analyzed using transgenic plants in which splice variant number 1 of G598 was expressed under the control of the 35S promoter. G598 overexpressors had higher seed oil content in all three lines tested when measured by NIR. These three lines also showed increased galactose levels when insoluble sugar composition was determined. Otherwise, G598 overexpressors behaved similarly to wild-type controls in all biochemical assays performed. The characterization of G598 overexpressors revealed no apparent morphological or physiological changes when compared to wild-type control plants. Analysis of the endogenous expression level of G598, as determined by RT-PCR, revealed a moderate and constitutive expression level in all tissues and conditions examined.

One transgenic line showed a reproducible increase in galactose in leaves.

Utilities

On the basis of the biochemical analyses performed to date, G598 or its equivalogs may play a role in the accumulation or regulation of leaf insoluble sugars. Insoluble sugars are among the building blocks of plant cell walls. Transcription factors that alter plant cell wall composition such as galactose have several potential applications including altering food digestibility, plant tensile strength, wood quality, pathogen resistance and in pulp production. In particular, increasing the insoluble carbohydrate content in various fruits, vegetables, and other edible consumer products will result in enhanced fiber content. Increased fiber content would not only provide health benefits in food products, but might also increase digestibility of forage crops.

G598 or its equivalogs could be used to increase seed oil content, which would be of nutritional value for food for human consumption as well as animal feeds.

G624 (SEQ ID NO: 403)

Published Information

G624 was identified in the sequence of BAC F18E5, GenBank accession number AL022603, released by the *Arabidopsis* Genome Initiative. No further public or published information is available about the function of G624.

Experimental Observations

Overexpression of G624 produced a moderate delay in the onset of flowering (approximately one week under continuous light conditions). A number of the late flowering 35S:: G624 transformants also displayed a marked increase in vegetative biomass compared to controls. No altered phenotypes were detected in any of the physiological assays.

Intriguingly, overexpression lines containing a truncated form of the cDNA (see sequence comments) exhibited wild-type morphology but displayed enhanced tolerance to both high sodium chloride and low phosphate growth conditions. It is possible that this effect represents a dominant negative phenotype.

Utilities

The delayed flowering displayed by 35S::G624 transformants suggests that the gene might be used to manipulate the flowering time of commercial species. In particular, an extension of vegetative growth or an increase in leaf size can significantly increase biomass and result in substantial yield increases.

Based on the increased salt tolerance exhibited by the 35S::G624 lines in physiology assays, this gene might be used to engineer salt tolerant crops and trees that can flourish in salinified soils, or under drought conditions.

The response of 35S::G624 seedlings to low phosphate conditions suggests that the gene could be used to manipulate nutrient uptake, or the ability to grow in poor nutrient soils.

G627 (SEQ ID NO: 405)

Published Information

G627 corresponds to AGAMOUS-LIKE 19 (AGL19) which was isolated by Alvarez-Buylla et al. (2000) *Plant J.* 24, 457-466). No genetic characterization of AGL19 has been reported, but it was found to be specifically expressed in the outer layers of the root meristem (lateral root cap and epidermis) and in the central cylinder cells of mature roots (Alvarez-Buylla et al. (2000) supra).

Experimental Observations

RT-PCR expression studies failed to detect G627 in any of the tissue types analyzed. This result partially agreed with the data of Alvarez-Buylla et al. (2000) supra, who found that the gene is expressed only in specific regions of the root. It is possible that such regions were not sufficiently represented for G627 transcripts to be detected in the whole root samples analyzed in our expression studies.

In later experiments, however, a G627 clone was isolated by high cycle PCR from a cDNA sample derived from mixed tissues, and transgenic lines were generated in which this clone was expressed from a 35S promoter. A substantial proportion of the 35S::G627 lines flowered markedly earlier than control plants. Such effects were observed in both the T1 and T2 generations and indicated that the gene plays a role in the regulation of flowering time.

Utilities

Given the early flowering seen amongst the 35S::G627 transformants, the gene might be used to manipulate the flowering time of commercial species. In particular, G627 could be used to accelerate flowering or eliminate any requirement for vernalization. In some instances, a faster cycling time might allow additional harvests of a crop to be made within a given growing season. Shortening generation times could also help speed-up breeding programs, particularly in species such as trees, which typically grow for many years before flowering. Conversely, it might be possible to modify the activity of G627 or its orthologs to delay flowering in order to achieve an increase in biomass and yield.

G634 (SEQ ID NO: 415)

Published Information

G634 was initially identified as public partial cDNAs sequences for GTL1 and GTL2 which are splice variants of the same gene (Smalle et al (1998) Proc. Natl. Acad. Sci. USA 95:3318-3322). The published expression pattern of GTL1 shows that G634 is highly expressed in siliques and not expressed in leaves, stems, flowers or roots.

Closely Related Genes from Other Species

A close non-Arabidopsis relative of G634 is O. sativa the gt-2 gene (2) which is proposed to bind and regulate the phyA promoter. In addition, the pea DNA-binding protein DFI (13786451) shows strong homology to G634. The homology of these proteins to G634 extends to outside of the conserved domains and thus these genes are likely to be orthologs of G634.

Experimental Observations

The boundaries of G634 were experimentally determined and the function of G634 was investigated by constitutively expressing G634 using the CaMV 35S promoter.

Three constructs were made for G634: P324, P1374 and P1717. P324 was found to encode a truncated protein. P1374 and P1717 represent full length splice variants of G634; P1374, the shorter of the two splice variants was used for the experiments described here and the coding sequence of the P1374 clone is provided as the cDNA sequence for G634 in the Sequence Listing. The longest available cDNA (P1717), confirmed by RACE, had the same ATG and stop codons as the genomic sequence. Only data for P1374 are presented here.

Plants overexpressing G634 from construct P1374 had a dramatic increase the density of trichomes, which were also larger in size. The increase in trichome density was most noticeable on later arising rosette leaves, cauline leaves, inflorescence stems and sepals with the stem trichomes being more highly branched than controls. Approximately half of the primary transformants and two of three T2 lines showed the phenotype. Apart from slight smallness, there did not appear to be any other clear phenotype associated with the overexpression of G634. However, a reduction in germination was observed in T2 seeds grown in culture.

RT PCR data showed that G634 was preferentially expressed in flowers and germinating seedlings, and induced by auxin.

Utilities

G634 or its equivalogs may be used to alter trichome structure, function or density. Trichome glands on the surface of many higher plants produce and secrete exudates that give protection from the elements and pests such as insects, microbes and herbivores. These exudates may physically immobilize insects and spores, may be insecticidal or antmicrobial or they may allergens or irritants to protect against herbivores. Trichomes have also been suggested to decrease transpiration by decreasing leaf surface air flow, and by exuding chemicals that protect the leaf from the sun.

Depending on the plant species, varying amounts of diverse secondary biochemicals (often lipophilic terpenes) are produced and exuded or volatilized by trichomes. These exotic secondary biochemicals, which are relatively easy to extract because they are on the surface of the leaf, have been widely used in such products as flavors and aromas, drugs, pesticides and cosmetics. One class of secondary metabolites, the diterpenes, can effect several biological systems such as tumor progression, prostaglandin synthesis and tissue inflammation. In addition, diterpenes can act as insect pheromones, termite allomones, and can exhibit neurotoxic, cytotoxic and antimitotic activities. As a result of this functional diversity, diterpenes have been the target of research several pharmaceutical ventures. In most cases where the metabolic pathways are impossible to engineer, increasing trichome density or size on leaves may be the only way to increase plant productivity.

Thus, the use of G634 and its homologs to increase trichome density, size or type may therefore have profound utilities in so called molecular farming practices (i.e. the use of trichomes as a manufacturing system for complex secondary metabolites), and in producing resistant insect and herbivore resistant plants.

G636 (SEQ ID NO: 417)

Published Information

G636 was identified through partial EST AA395524, released by Michigan State University. The entire sequence of G636 was later identified in BAC F7012, accession number F7012, released by the Arabidopsis genome initiative.

Closely Related Genes from Other Species

G636 is closely related to the Pisum sativum DNA-binding protein DF 1, accession number AB052729, which may bind to light regulatory elements.

Experimental Observations

The 5' boundary of G636 was determined and the function of G636 was analyzed by constitutively expressing the gene using the CaMV 35S promoter. Overexpression of G636 resulted in premature senescence of leaves and reduced plant size and fertility. No other phenotypic alterations were noted as a result of physiological or biochemical analyses.

G636 was constitutively expressed.

Utilities

G636 or its equivalogs may be used to alter senescence responses in plants. Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. Delayed flower senescence may also generate plants that retain their blossoms longer and this may be of potential interest to the ornamental horticulture industry.

G638 (SEQ ID NO: 419)

Published Information

G638 was identified in the sequence of BAC F17C15, GenBank accession number AL162506, released by the Arabidopsis Genome Initiative. During the course of its functional analysis, G638 was identified as the PETAL LOSS gene (Griffith et al. (1999) Development: 126:5635-5644). The PETAL LOSS knockout mutant displays a variety of flower phenotypes, most strikingly characterized by a reduction in the number of petals. In addition to flower organ number, organ identity, shape and orientation, particularly of petals, is altered.

Closely Related Genes from Other Species

A relative of G638 is a Medicago truncatula gene represented by the EST BF646615, which was isolated from an elicited cell culture cDNA library.

Experimental Observations

The boundaries of G638 were experimentally determined and the function of G638 was analyzed using transgenic plants in which this gene was expressed under the control of the 35S promoter. Expression of G638 causes severe alterations of plant development. The most striking feature of these overexpressor plants was that they have multipetallate flowers. In early flowers, some homeotic conversion had occurred between some organs of the flower. In all flowers made after these early flowers, petal number had been altered. Up to eight petals were consistently observed on plants that flowered, and as the plants grew older, the number of petals on new flowers was reduced from eight to about five. This phenotype was somewhat opposite to the phenotype observed with PETAL LOSS knockout plants and confirms a role for G638 in counting or maintaining petal number within the Arabidopsis flower. In addition to the flower phenotype, G638 caused alterations in phyllotaxy, leaf shape and caused plants to be sterile. G638 appears to be constitutively expressed.

Utilities

G638 or its equivalogs could be used to manipulate plant architecture and leaf shape, in particular this gene could be used to increase or decrease petal number in flowers. Overexpression of G638 also causes sterility, indicating there may be some use for this gene in engineering sterility into commercially relevant species.

G663 (SEQ ID NO: 435)

Published Information

G663 was identified from the Arabidopsis EST sequence, H76020, based on its sequence similarity within the conserved domain to other Myb family members in Arabidopsis. This gene was named MYB90 (Kranz et al. (1998) Plant J. 16:263-276). Reverse Northern data suggested G663 is expressed highly in leaves, siliques, and flowers and is induced by ethylene treatment.

Experimental Observations

The function of G663 was analyzed by its ectopic overexpression in plants. G663 overexpressors had constitutive anthocyanin production in seeds and roots. One line had higher anthocyanin production in leaf tissue as well. In other overexpressing lines, constitutive anthocyanin production was noted in trichomes and leaf margins. The overproduction of pigment in select tissues suggests there may be another transcription factor with which G663 interacts to activate the pathway. Using the corn system as a model, the interacting protein may be a bZIP like transcription factor.

RT-PCR analysis of the endogenous levels of G663 indicated that this gene was expressed primarily in siliques and seedlings. Array data confirmed the high levels in silique and also detected high levels of G663 in germinating seed tissue. G663 transcripts were also induced above basal levels by all stress treatments tested except by infection with Erysiphe orontii. These data were consistent with G663 being involved in the anthocyanin biosynthetic pathway, which is part of a common multi-stress response pathway.

Utilities

The potential utilities of this gene or its equivalogs includes alterations in pigment production for horticultural purposes, and possibly increasing stress resistance in combination with another transcription factor. Flavonoids have antimicrobial activity and could be used to engineer pathogen resistance. Several flavonoid compounds have health promoting effects such as the inhibition of tumor growth and cancer, prevention of bone loss and the prevention of the oxidation of lipids. Increasing levels of condensed tannins, whose biosynthetic pathway is shared with anthocyanin biosynthesis, in forage legumes is an important agronomic trait because they prevent pasture bloat by collapsing protein foams within the rumen. For a review on the utilities of flavonoids and their derivatives, refer to Dixon et al. ((1999) Trends Plant Sci. 10: 394-400).

G664 (SEQ ID NO: 437)

Published Information

G664 was identified from the Arabidopsis EST sequence, N38154, based on its sequence similarity within the conserved domain to other Myb family members in Arabidopsis. The Myb consortium named this gene MYB4 (Kranz et al. (1998) Plant J. 16: 263-276). Reverse Northern data suggested G664 is expressed highly in silique tissue with a low level of expression detected in all other tissues.

Closely Related Genes from Other Species

G664 shows extensive homology to the tomato gene THM27 (X95296) and the barley gene (X70877).

Experimental Observations

The function of G664 was analyzed through its ectopic overexpression in plants. G664 overexpressors germinated better and then developed more rapidly in cold conditions (8° C.) than wildtype controls. No differences in germination rates were observed on control MS media or in response to any other stress. Array data indicated that G664 was normally expressed primarily in root, shoot and silique.

Utilities

The potential utility of this gene or its equivalogs is to confer improved cold germination and/or growth. The germination of many crops like cotton is very sensitive to cold temperatures, a gene that would allow germination and seedling vigor in the cold would have tremendous utility in allowing seeds to be planted earlier in the season with a high rate of survivability.

G676 (SEQ ID NO: 457)

Published Information

G676 was identified from an Arabidopsis EST, N96391, based on its sequence similarity to other members of the Myb family within the conserved domain. The Myb consortium named this gene MYB66 (Kranz H D, et al.(1998) *Plant J.* 16:263-276) and in a report by Lee et al ((1999) *Cell* 1999 24;99:473-483) a detailed functional analysis of G676, or "werewolf", is described. Werewolf (WER) is involved in position-dependent patterning of epidermal cell types. Transcripts were localized to root epidermal cells that will develop into non-hair cells. WER was shown to regulate the position-dependent expression of GLABRA2, to interact with the maize R gene, and to act as an antagonist to the myb protein CAPRICE (G225). These authors do not report altered trichome positioning in their 35S:wer overexpressors.

Experimental Observations

The function of G676 was analyzed through its ectopic overexpression in plants. Morphologically, the plants are small, and partially glabrous on the upper surface of the leaf. Ectopic trichomes developed on the underside of the leaf in one line. Lee et al (1999) *Cell* 99: 473-483) fail to report altered trichome phenotypes in the leaves of the 35S:were overexpression lines. The present lines showed a higher degree of overexpression, which could explain the small stature of the plants as well.

RT-PCR analysis of the endogenous levels of G676 indicated that this gene was expressed primarily in roots with a low level of expression in siliques and seedlings. G676 transcripts were not induced significantly above basal levels by any stress-related treatments tested. In disease-related treatments where whole seedlings were harvested, transcripts were detectable but not above basal levels. This may be related to the gene's root expression. G676 transcripts were not found in *Fusarium oxysporum* treated seedlings; it is possible this treatment represses G676 expression in the roots.

Utilities

The potential utility of G676 or its equivalogs is the production of ectopic trichomes on the surface of the leaf. It would be of significant agronomic value to have plants that exhibit greater numbers of glandular trichomes producing essential oils for the pharmaceutical and food industries, as well as oils that protect plants against insect and pathogen attack.

G680 (SEQ ID NO: 463)

Published Information

G680 or LHY (late elongated hypocotyl) is an unusual Myb transcription factor in that it contains a single Myb repeat instead of the two repeat sequences found in the majority of plant Myb genes (R2R3 Mybs). There are over 30 members of this single repeat Myb-related subfamily in the *Arabidopsis* genome. Both signature repeats in R2R3 Myb domain are required for sequence specific DNA binding. However, the Myb-related subfamily with a single repeat domain are also able to bind to DNA in a sequence-specific manner (Baranowskij et al. (1994) *EMBO J.* 13: 5383-5392; Feldbrugge et al. (1997) *Plant J.* 11: 1079-1093) and are therefore thought to function as transcription factors.

G680 or LHY overexpression affects many processes associated with the circadian clock including, the rythmicity in both leaf movement, and the expression of CAB and CCR2 genes, as well as photoperiodic control of flowering time (Schaffer et al. (1998) *Cell* 93: 1219-1229). Other reported picitropic effects include elongated hypocotyls, elongated petioles, and pale leaves (Schaffer et al. (1998) *Cell* 93: 1219-1229). All of these phenotypes could potentially be explained by the impairment of circadian clock function. LHY shows a high degree of homology to CCA1, another protein implicated in circadian clock function (Wang et al. (1997) *Plant Cell* 9: 491-507).

Experimental Observations

The function of G680 was analyzed through its ectopic overexpression in plants. G680 overexpressors were late flowering under both short and long day conditions, however, the late flowering phenotype appeared more consistently under short day conditions. The overexpressors were darker green in color compared to the wild-type controls at later stages of development. This was inconsistent with the published phenotype, which indicates the plants have less chlorophyll, and are pale in color (Schaffer et al. (1998) *Cell* 93: 1219-1229). Preliminary data indicated that a vernalization treatment applied to germinating seedlings partially overcame the delay in flowering in the G680 overexpressors. Vernalized plants showed an approximate 35% reduction in leaf number on average compared to non-vernalized controls. Overexpression of G680 in plants also resulted in sensitivity to media containing high glucose in a germination assay, indicating a potential role for G680 in sugar sensing.

As determined by RT-PCR, G680 was uniformly expressed in all tissues tested. RT-PCR data also indicated a moderate induction of G680 transcripts accumulation upon drought treatment, and *Erysiphe* treatment could repress the expression of this gene.

Utilities

G680 or its equivalogs may be used to alter sugar sensing in plants. Sugars are key regulatory molecules that affect diverse processes in higher plants including germination, growth, flowering, senescence, sugar metabolism and photosynthesis. Sucrose is the major transport form of photosynthate and its flux through cells has been shown to affect gene expression and alter storage compound accumulation in seeds (source-sink relationships). Glucose-specific hexose-sensing has been described in plants and implicated in cell division and repression of 'famine' genes (photosynthetic or glyoxylate cycles). The potential utilities of a gene involved in glucose-specific sugar sensing are to alter energy balance, photosynthetic rate, carbohydrate accumulation, biomass production, source-sink relationships, and senescence.

Potential utilities of G680 or its equivalogs also include the regulation of flowering time. An area in which late flowering might be useful include crops where the vegetative portion of the plant is the marketable portion. In this case, it would be advantageous to prevent or delay flowering in order to increase yield. Prevention of flowering would also be useful in these same crops in order to prevent the spread of transgenic pollen and/or to prevent seed set.

A vernalization treatment applied to germinating G680 seedlings will partially overcome the delay in flowering in the G680 overexpressors. Vernalized plants showed an approximate 35% reduction in leaf number on average compared to non-vernalized controls. Various late flowering mutants are partially rescued by GA applications (Chandler et al. (1994) *J. Exp. Bot.* 45: 1279 1288). Thus it is possible that G680 could be used to increase the vegetative phases of development in order to increase yield and then triggered to flower via a cold treatment or a gibberellic acid application.

G682 (SEQ ID NO: 467)

Published Information

G682 was identified from the *Arabidopsis* BAC, AF007269, based on sequence similarity to other members of the Myb family within the conserved domain.

Experimental Observations

The function of G682 was analyzed through its ectopic overexpression in plants. G682 overexpressors were glabrous, had tufts of more root hairs and germinated better under heat stress conditions. Older plants were not more tolerant to heat stress compared to wild-type controls.

RT-PCR analysis of the endogenous levels of G682 transcripts indicated that this gene was expressed in all tissues tested, however, a very low level of transcript was detected in roots and shoots. Array tissue print data indicated that G682 was expressed primarily, but not exclusively, in flower tissue.

An array experiment was performed on one G682 overexpressing line. The data from this one experiment indicated that this gene could be a negative regulator of chloroplast development and/or light dependent development because the gene Albino3 and many chloroplast genes are repressed. Albino3 functions to regulate chloroplast development (Sundberg et al (1997) *Plant Cell* 9:717-730). The gene G682 was itself induced 20-fold. Other than a few additional transcription factors, very few genes are induced as a result of the ectopic expression of G682.

A number of plants transformed with G682 lacked trichomes.

Plants overexpressing paralogs of G682, including G225, G226, G11816, and G2718, transcription factors within the same clade, have similar traits as plants that overexpress G682. When any of these five transcription factors are overexpressed in plants, the plants show phenotypes related to glabrousness and abiotic stress tolerance, including:

(a) a reduced number or lack of trichomes by overexpressing G682, G225, G226, G1816, and G2718;

(b) increased root hairs, the latter indicating improved resistance to osmotic stress by overexpressing G682, G225, G226, G1816, and G2718;

(c) increased tolerance to nitrogen-limiting conditions by overexpressing G682, G225, G226, G1816 and G2718;

(d) increased heat tolerance by overexpressing G682 and G225;

(e) increased tolerance to salt, by overexpressing G226;

(f) altered sugar sensing, by plants overexpressing G1816;

(g) altered sugar sensing by plants overexpressing G1816 and G2718; and (h) improved root growth, by plants overexpressing G2718.

MYB transcription factors can be subdivided into two classes based on polynucleotide sequence characteristics. The sequences of representative Class I transcription factors (CITFs) and Class II transcription factors (CIITFs), the latter group being the one in which G682 is found, are shown in Table 11. The coordinates for the conserved domains of the transcription factors used to prepare Table 12b may be found in Table 5, and appear as the underlined regions in Table 11.

TABLE 11

Class I transcription factors

G247

MRMTRDGKEHEYKKGLWTVEEDKILMDYVRTHGOGHWNRIAKKTGLKRCGKSCRLRWMNYL
SPNVNRGNFTDQEEDLIIRLHKLLGNRWSLIAKRVPGRTDNQVKNYWNTHLSKKLGLGDHSTAV
KAACGVESPPSMALITTTSSSHQEISGGKNSTLRFDTLVDESKLKPKSKLVHATPTDVEVAATVPN
LFDTFWVLEDDFELSSLTMMDFTNGYCL

G212

MRIRRRDEKENQEYKKGLWTVEEDNILMDYVLNHGTGQWNRIVRKTGLKRCGKSCRLRWMNY
LSPNVNKGNFTEQEEDLIIRLHKLLGNRWSLIAKRVPGRTDNQVKNYWNTHLSKKLVGDYSSAV
KTTGEDDDSPPSLFITAATPSSCHHQQENIYENIAKSFNGVVSASYEDKPKQELAQKDVLMATTN
DPSHYYGNNALWVHDDDFELSSLVMMNFASGDVEYCL

G676

MRKKVSSSGDEGNNEYKKGLWTVEEDKILMDYVKAHGKGHWNRIAKKTGLKRCGKSCRLRW
MNYLSPNVKRGNFTEQEEDLIIRLHKLLGNRWSLIAKRVPGRTDNQVKNYWNTHLSKKLGIKDQ
KTKQSNGDIVYQINLPNPTETSEETKISNIVDNNNILGDEIQEDHQGSNYLSSLWVHEDEFELSTLT
NMMDFIDGHCF

G1332

MECKREEGKSYVKRGLWKPEEDMILKSYVETHGEGNWADISRRSGLKRGGKSCRLRWKNYLRP
NIKRGSMSPQEQDLIIRMHKLLGNRWSLIAGRLPGRTDNEVKNYWNTHLNKKPNSRKQNAPESI
VGATPFTDKPVMSTELRRSHGEGGEEESNTWMEETNHFGYDVHVGSPLPLISHYPDNTLVFDPCF
SFTDFFPLL

Class II transcription factors

G225

MFRSDKAEKMDKRRRRQSKAKASCSEEVSSIEWEAVKMSEEEEDLISRMYKLVGDRWELIAGRI
PGRTPEEIERYWLMKHGVVFANRRRDFFRK

G226

MDNTNRLRLRRGPSLRQTKFTRSRYDSEEVSSIEWEFISMTEQEEDLISRMYRLVGNRWDLIAGR
VVGRKANEIERYWIMRNSDYFSHKRRRLNNSPFFSTSPLNLQENLKL

G682

MDNHRRTKQPKTNSIVTSSSEEVSSLEWEVVNMSQEEEDLVSRMHKLVGDRWELIAGRIPGRTA
GEIERFWVMKN

TABLE 11-continued

G1816

MDNTDRRRRRKQHKIALHDSEVSSIEWEFINMTEQEEDLIFRMYRLVGDRWDLIAGRVPGRQPE
EIERYWIMRNSEGFADKRRQLHSSSHKHTKPHRPRFSIYPS

G2718

MNTQRKSKHLKTNPTIVASSSEEVSSLEWEEIAMAQEEEDLICRMYKLVGERWDLIAGRIPGRTA
EEIERFWVMKNHRRSQLR

Table 12a shows the percent identity in the MYB conserved domains for the sequences included in the Sequence Listing, as originally calculated in U.S. patent application Ser. No. 09/489,376. Table 12b shows the percent identity in the conserved domains for the sequences included in the Sequence Listing, as calculated using revised amino acid residue coordinates for the conserved domains (Table 5, and below) of the respective polypeptides, and also includes percent identity comparisons with G11816 and G2718.

surface of many higher plants produce and secrete exudates, which give protection from the elements and pests such as insects, microbes and herbivores. These exudates may physically immobilize insects and spores, may be insecticidal or ant-microbial or they may allergens or irritants to protect against herbivores. Trichomes have also been suggested to decrease transpiration by decreasing leaf surface air flow, and by exuding chemicals that protect the leaf from the sun.

TABLE 12a

| GID No. | SEQ ID NO: | G212 | G247 | G676 | G1332 | G682 | G226 | G225 |
|---|---|---|---|---|---|---|---|---|
| G212 | 124 | 100% | 42% | 41% | 31% | 36% | 40% | 36% |
| G247 | 170 | 42% | 100% | 92% | 74% | 16% | 17% | 15% |
| G676 | 458 | 41% | 92% | 100% | 68% | 15% | 17% | 15% |
| G1332 | 856 | 31% | 74% | 68% | 100% | 18% | 18% | 18% |
| G682 | 468 | 36% | 16% | 15% | 18% | 100% | 56% | 81% |
| G226 | 142 | 40% | 17% | 17% | 18% | 56% | 100% | 65% |
| G225 | 140 | 36% | 15% | 15% | 18% | 81% | 65% | 100% |

TABLE 12b

| GID No. | SEQ ID NO: | G212 | G247 | G676 | G1332 | G682 | G226 | G225 | G1816 | G2718 |
|---|---|---|---|---|---|---|---|---|---|---|
| G212 | 124 | 100% | 91% | 91% | 69% | 52% | 60% | 57% | 60% | 54% |
| G247 | 170 | 91% | 100% | 95% | 70% | 52% | 57% | 55% | 57% | 55% |
| G676 | 458 | 91% | 95% | 100% | 70% | 52% | 60% | 57% | 60% | 54% |
| G1332 | 856 | 69% | 70% | 70% | 100% | 60% | 62% | 64% | 57% | 57% |
| G682 | 468 | 52% | 52% | 52% | 60% | 100% | 63% | 82% | 65% | 78% |
| G226 | 142 | 60% | 57% | 60% | 62% | 63% | 100% | 70% | 82% | 70% |
| G225 | 140 | 57% | 55% | 57% | 64% | 82% | 70% | 100% | 78% | 78% |
| G1816 | 940 | 60% | 57% | 60% | 57% | 65% | 82% | 78% | 100% | 73% |
| G2718 | 960 | 54% | 55% | 54% | 57% | 78% | 70% | 78% | 73% | 100% |

Based on the analyses using the conserved domains shown in Table 11, the CITFs G212, G247, G676, and G1332 show a high degree of sequence identity in the MYB domain with each other (Table 12b; in the range of 69-95%), and CIITFs G682, G225, G226, G1816 and G2718 share a high degree of sequence identity with each other (Table 12b; in the range of 63% to 82%). Comparisons between CITFs and CIITFs reveals a generally lower degree of identity between transcription factors in the different groups (Table 12b; 52% to 64%).

Utilities

The potential utility of this gene or its equivalogs is to confer heat tolerance to germinating seeds.

G682 or its equivalogs could be used to alter trichome number and distribution in plants. Trichome glands on the

G736 (SEQ ID NO: 487)

Published Information

G736 was discovered as a full length EST clone. It was subsequently localized to BAC AC002341.

Experimental Observations

RT-PCR analysis of the endogenous levels of G736 indicated that this gene was expressed at low to medium levels in all tissues tested. In addition, there was no induction of G736 above its basal level in response to environmental stress treatments.

Two out of three G736 overexpressing lines exhibited a severe late flowering phenotype in both the T1 and T2 generation, the third line was late flowering in the TI generation but the phenotype was lost in the subsequent generation, most likely due to silencing of the transgene. All three lines exhibited elongated petioles in both generations, and in two of the Ti lines, failure of the siliques to elongate was also observed. This phenotype was lost in the subsequent generation.

Utilities

Overexpression of G736 and its equivalog may be used to substantially delay flowering. A wide variety of applications exist for genes that either lengthen or shorten the time to flowering, or for systems of inducible flowering time control. In particular, in species where the vegetative parts of the plants constitute the crop and the reproductive tissues are discarded, it would be advantageous to delay or prevent flowering. Extending vegetative development could bring about large increases in yields. Additionally, a major concern is the escape of transgenic pollen from GMOs to wild species or so-called organic crops. Systems that prevent vegetative transgenic crops from flowering would eliminate this worry.

G748 (SEQ ID NO: 497)

Published Information

A cDNA sequence for G748 was deposited in GenBank by Abbaraju and Oliver on Aug. 4, 1998. G748 encodes a protein containing a Dof zinc-finger domain that was found to bind the H-protein promoter. The H protein is a component of the glycine decarboxylase multienzyme complex, that comprises over one-third of the soluble proteins in mitochondria isolated from the leaves of C3 plants (Oliver et al. (1995) *Bioenerg. Biomembr.* 27: 407-414). A published function for G748 is a putative regulatory role in H-protein gene expression, suggested by the promoter-binding data.

Closely Related Genes from Other Species

Close relatives to G748 include a rice gene (GB accession # BAA88190) and a pumpkin gene (GB accession # D45066). In both cases, the similarity extends beyond the conserved DNA-binding domain, which suggests the genes could be orthologs of G748. The pumpkin gene encodes an ascorbate oxidase promoter-binding protein, suggesting that the product of G748 could also bind that promoter.

Experimental Observations

A cDNA sequence was isolated and used to produce transgenic plants overexpressing G748. Overexpression of G748 resulted in a late flowering phenotype. Transgenic plants were generally large and dark green with more rosette leaves. Stems were thicker and more vascular bundles were noticeable in transverse sections. G748 overexpressors also produced more lutein in seeds (consistently observed in three lines). The high lutein phenotype was confirmed in a repeat experiment. The physiology of the plant was similar to that of the controls. In wild-type plants, G748 was constitutively expressed, although at lower levels at the seedling stage. Expression levels were lower upon infection with *E. orontii* and *Fusarium*.

Utilities

Experimental data showed that G748 or its equivalogs can be used to delay flowering in transgenic plants.

*Arabidopsis* plants overexpressing G748 produced more lutein in seeds.

Plants transformed with G748 had modified stem morphology and vascular bundles and may be used to affect overall plant architecture.

G779 (SEQ ID NO: 525)

Published Information

G779 has been previously identified; fruits from a ind1 knockout mutant plants do not show cell differentiation in the dehiscence zone (Liljegren et al. (2000) *Abstracts 11th Intl. Conf. Arabidopsis Res.*, Madison, Wis., pp. 179). These results suggest that G779 may mediate cell differentiation during *Arabidopsis* fruit development.

Closely Related Genes from Other Species

G779 is closely related to a *Brassica rapa* subsp. *Pekinensis* cDNA isolated from flower bud (acc#AT002234).

Experimental Observations

The function of G779 was analyzed using transgenic plants in which G779 was expressed under the control of the 35S promoter. Morphological analysis of overexpressors indicated that primary transformants of G779 had high levels of anthocyanin in seedlings, produced small plants with disorganized rosettes and short internodes, and many had flower abnormalities. The transformants with flower abnormalities showed conversion of sepals to carpels. The most severely affected had full conversion of sepals to carpels with ovules, stigmatic tissue on petals and stamens, and in some cases showed organ fusions. In the severe case of one T1 line, some inflorescences showed no flowers at all. Plants with a weak phenotype showed only small patches of stigmatic tissue on sepals. The floral phenotypes decreased acropetally. The plants showing the strongest phenotypes were essentially sterile, and did not produce T2 progeny for further analysis.

The phenotype produced by overexpressing G779 and G1499 was similar in the aspects of flower structures. Cluster analysis using basic helix-loop-helix motif revealed that both proteins of G779 and G1499 are closely related. The fact that expression of G779 was induced by auxin treatment in the rosette leaves indicates that G779 may play some kind of role in the auxin signal transduction pathway.

Utilities

G779 or its equivalogs could be used to modify plant architecture and development, including flower structure. If expressed under a flower-specific promoter, it might also be useful for engineering male sterility. Because expression of G779 is flower, embryo and silique specific, its promoter could be useful for targeted gene expression in these organs.

G789 (SEQ ID NO: 539)

Published Information

A partial sequence of G789 was identified from an EST clone (GenBank accession number T41998).

Experimental Observations

G789 was initially identified as a public EST (GenBank accession number T41998) and subsequently a full length library clone was identified. The function of G789 was analyzed using transgenic plants in which G789 was expressed under the control of the 35S promoter.

Overexpression of G789 reduced the time to flowering under continuous light conditions; this phenotype was most prevalent in the T2 generation and was noted in all three of the lines analyzed.

Transgenic plants overexpressing G789 were more sensitive to the herbicides glyphosate and acifluorfen and to oxidative stress caused by rose bengal compared to wild-type controls. Furthermore, G789 overexpressing lines were more susceptible to infection with *Sclerotinia sclerotiorum* when tested as mixed lines in two repeat experiments. This disease susceptibility phenotype did not repeat when individual lines were tested. It is well known that oxidative stress is a component of a plant defense response to pathogen and therefore, the disease susceptibility phenotype could thus be related to a general sensitivity to oxidative stress.

Based on the RT-PCR analysis, G789 was constitutively expressed in all tissues; its expression level was unaffected by any of the conditions tested.

Utilities

Based on the current analysis of G789 overexpressing plants, G789 or its equivalogs could be used to manipulate flowering time.

Since G789 activity has been shown to be required for the protection of *Arabidopsis* plants against oxidative stress, G789 or its equivalogs could be used to manipulate defenses against abiotic and biotic stresses such as disease, UV-B radiation, ozone pollution and herbicide application.

G801 (SEQ ID NO: 549)

Published Information

A partial sequence for G801 was identified from EST clones (GenBank accession numbers N97289, H36373 and Z32574).

Experimental Observations

G801 is a proprietary sequence initially identified as three partial public ESTs (GenBank accession numbers N97289, H36373 and Z32574). Subsequently, a full length library clone was identified. The function of G801 was analyzed using transgenic plants in which G801 was expressed under the control of the 35S promoter. Morphological analysis revealed that aminority of primary transformants of G801 were dark green and late flowering. However, T2 lines derived from three lateflowering lines showed no flowering time differences from control plants. Plant overexpressing G801 showed more seedling vigor when germinated on media containing high salt compared to wild-type control plants. All three overexpressing lines showed similar degrees of tolerance. In addition, overexpression of G801 in *Arabidopsis* resulted in an increase in seed oil content. This phenotype was observed in a single line.

Utilities

The potential utilities of this gene or its equivalogs include the ability to confer salt tolerance during the germination stage of a crop plant. This would most likely impact survivability and yield. Evaporation of water from the soil surface causes upward water movement and salt accumulation in the upper soil layer, where the seeds are placed. Thus, germination normally takes place at a salt concentration much higher than the mean salt concentration in the whole soil profile.

In addition, G801 or its equivalogs may be used to increase seed oil in crop plants.

G849 (SEQ ID NO: 565)

Published Information

The transcription factor G849 is an *Arabidopsis* homolog of parsley BPF-1, a pathogen inducible DNA-binding protein. BPF-1, Box-P Binding Factor 1, was reported by da Costa e Silva et al. ((1993) *Plant Journal* 4:125-135) to bind specifically to the P-box sequence motif of the phenylalanine ammonia lyase promoter, a key enzyme of the phenylpropanoid metabolism. G849 is found in the sequence of chromosome 3, BAC T2E22 (GenBank AC069474.4 GI: 12321944), released by the *Arabidopsis* Genome Initiative. The start and stop codons were correctly predicted.

Experimental Observations

NIR analyses performed on G849 knockout plants revealed increased total combined seed oil and protein content.

RT-PCR analysis of the endogenous level of G849 transcripts revealed high constitutive expression in all tissues examined, with the exception of germinated seed. A detectable but low level of G849 transcripts was observed in germinated seeds. G849 transcript level increased significantly upon auxin, ABA, cold, heat and salt treatment, as well as seven days post-inoculation with *Erysiphe orontii*.

Utilities

Based on the knockout analyses, G849 or its equivalogs may be used to modify seed oil and protein content.

The null mutant of G849 had altered seed phytosterol composition, a decease in beta-sitosterol, as well as changes in leaf insoluble sugars. Phytosterols are an important source of precursors for the manufacture of human steroid hormones by semisynthesis. Sitosterols and stigmasterols, not campesterol, are the preferred sources from seed crops. Phytosterols and their hydrogenated derivatives phytostanols also have proven cholesterol-lowering properties.

G859 (SEQ ID NO: 567)

Published Information

G859 corresponds to MXK3.30 (BAB10332). The high level of sequence similarity between G859 and FLOWERING LOCUS C (FLC; Michaels et al. (1999) *Plant Cell* 11, 949-956; Sheldon et al., (1999) *Plant Cell* 11, 445-458) has been described previously (Ratcliffe et al. (2001) *Plant Physiol.* 126:122-132). G859 has also been referred to as AGL31 (Alvarez-Buylla et al. (2000) *Plant J.* 24:457-466).

Experimental Observations

G859 was recognized as a gene highly related to *Arabidopsis* FLC, and to MADS AFFECTING FLOWERING 1. FLC acts as a repressor of flowering (Michaels (1999) *Plant Cell* 11, 949-956; Sheldon et al. (1999) *Plant Cell* 11, 445-458). Similarly, G157/MAF1 can cause a delay in flowering time when overexpressed (Ratcliffe et al. (2001) *Plant Physiol.* 126:122-132).

The function of G859 was studied using transgenic plants in which this gene was expressed under the control of the 35S promoter. Overexpression of G859 modified the timing of flowering, with very high levels of G859 activity delaying the floral transition in the Columbia ecotype. No alterations were detected in 35S::G859 plants in the physiological and biochemical analyses that were performed.

Under continuous light conditions, the majority of 35S::G859 primary transformants (overexpressing a construct containing a full-length cDNA, P1688) were earlier flowering than wild-type controls. This result was observed in multiple independent batches of T1 plants and in either continuous or 12 hour light conditions. However, in each selection of primary transformants, a small number of lines were late flowering. RT-PCR analyses demonstrated that all T1 plants overexpressed the transgene, but that the highest levels of expression were found in the late flowering transformants. Comparable results were also obtained when plants were transformed with a construct (P376) containing a shorter splice-variant of G859. The effects on flowering time caused by overexpression of G859, and the dependence of those effects on the transgene expression levels, mirror results previously obtained for G157/MAF1 (Ratcliffe et al. (2001) *Plant Physiol.* 126:122-132).

Seed was taken for T2 analyses from two late flowering primary transformants, and a T1 plant that had been early flowering. The progeny of the former two lines all appeared markedly late flowering, while the T2 plants from the third line were marginally late flowering. No convincing early flowering was observed in any the three T2 populations. Thus, in the second generation, the predominant effect of G859 activity was delayed flowering. In a follow-up experiment it was found that late flowering 35S::G859 T2 plants were photoperiod responsive, and were not sensitive to extensive vernalization treatments.

Utilities

G859 or its equivalogs could be used to alter flowering time.

G864 (SEQ ID NO: 573)

Published Information

G864 was identified in an *Arabidopsis* EST (H37693). G864 appears as gene AT4g23750 in the annotated sequence of *Arabidopsis* chromosome 4 (AL161560).

Experimental Observations

G864 was discovered and initially identified as a public *Arabidopsis* EST.

The complete sequence of G864 was determined, and G864 was found to be related to two additional *Arabidopsis* AP2/EREBP genes, G1421 and G1755. The function of G864 was analyzed using transgenic plants in which this gene was expressed under the control of the 35S promoter. G864 overexpressing plants exhibited a variety of phenotypic alterations. They were smaller than wild-type plants, and those with the strongest phenotypes were classified as dwarf. However, G864 overexpressing lines showed more seedling vigor in a heat stress tolerance germination assay compared to wild-type controls. Conversely, G864 overexpressing lines were also somewhat more sensitive to chilling. One of the three T2 lines analyzed showed significant increase in fucose and arabinose levels in leaves.

G864 was ubiquitously expressed, and was not significantly induced under any of the conditions tested.

Utilities

The germination of many crops is very sensitive to temperature. A gene that would enhance germination in hot conditions such as G864 or its equivalogs would be useful for crops that are planted late in the season or in hot climates.

G867 (SEQ ID NO: 579)

Published Information

G867 corresponds to RAV1 (Kagaya et al. (1999) *Nucleic Acids Res.* 27: 470-478). G867/RAV1 belongs to a small subgroup within the AP2/EREBP family of transcription factors, whose distinguishing characteristic is that its members contain a second DNA-binding domain, in addition to the conserved AP2 domain, that is related to the B3 domain of VP1/AB13 (Kagaya et al. (1999) supra). It has been shown that the two DNA-binding domains of RAV1 can separately recognize each of two motifs that constitute a bipartite binding sequence and together cooperatively enhance its DNA-binding affinity and specificity (Kagaya et al. (1999) supra).

Experimental Observations

G867 was discovered and initially identified as a public *Arabidopsis* EST. G867 appeared to be constitutively expressed at medium levels.

G867 was first characterized using a line that contained a T-DNA insertion in the gene. The insertion in that line resided immediately downstream of the conserved AP2 domain, and would therefore be expected to result in a severe or null mutation. G867 knockout mutant plants did not show significant changes in overall plant morphology, significant differences between these plants and control plants have not been detected in any of the assays that have been performed so far.

Subsequently, the function of G867 was analyzed using transgenic plants in which this gene was expressed under the control of the 35S promoter. G867 overexpressing lines were morphologically wild-type and no phenotypic alterations in G867 overexpressing lines were detected in the biochemical assays that were performed. However, G867 overexpressing lines showed increased seedling vigor (manifested by increased expansion of the cotyledons) in germination assays on both high salt and high sucrose containing media, compared to wild-type controls.

The *Arabidopsis* paralogs G1930 (SEQ ID NO: 1893) and G9 (SEQ ID NO: 14) also showed stress related phenotypes. G9 exhibited increased root biomass, and thus could be used to produce better plant growth under adverse osmotic conditions. Genetic and physiological evidence indicates that roots subjected to various stresses, including water deficit, alter the export of specific compounds, such as ACC and ABA, to the shoot, via the xylem Bradford et al. (1980) *Plant Physiol.* 65: 322-326; Schurr et al. (1992) *Plant Cell Environ.* 15, 561-567).

G1930 plants responded to high NaCl and high sucrose on plates with more seedling vigor, and root biomass compared to wild-type control plants; this phenotype was identical to that seen in 35S::G867 lines. These results indicate a general involvement of this clade in abiotic stress responses: The polypeptide sequences of G1930 and G9 share 72% (249/345 residues) and 64% (233/364 residues) with G867, respectively. The conserved domains of G1930 and G9 are 86% (56/65 residues) and 86% (56/65 residues) identical with the conserved domain of G867, respectively.

Utilities

G867 or its equivalogs could be used to increase or facilitate seed germination and seedling growth under adverse environmental conditions, in particular salt stress.

G867 or its equivalogs may also be used to modify sugar sensing.

G869 (SEQ ID NO: 581)

Published Information

A partial cDNA sequence of G869 is available as public ESTs N65486. The sequence of G869 later appeared among the *Arabidopsis* sequences released by the *Arabidopsis* Genome Initiative, in BAC T26J14 (GenBank accession number AC011915).

Experimental Observations

The complete cDNA sequence of G869 was determined. The function of this gene was analyzed using transgenic plants in which G869 was expressed under the control of the 35S promoter. Plants overexpressing G869 were small with spindly bolts. G869 transgenic plants showed alterations in leaf and seed fatty acid composition. In leaves, 16:0 levels decreased and 16:3 levels increased. These changes likely reflected alterations in the desaturation state of chloroplast membranes. In seeds, 18:1 levels increased significantly. The increase in the seed 18:1 fatty acid in two lines was observed in a repeat experiment. A decrease in 18:3 and 20:0 was also noted in these lines.

Alterations in the levels of leaf insoluble sugars were also detected, with the increase in fucose determined to be significant. In addition, G869 overexpressors were more tolerant to infection with a moderate dose of the fungal pathogen *Erysiphe orontii*. The increase in resistance phenotype cosegregated with the dwarf phenotype. G869 plants showed additional morphological alterations, including poor fertility due to underdeveloped anthers.

Utilities

G869 or its equivalogs could be useful to manipulate the saturation levels of lipids in seeds. Alteration in seed lipid saturation could be used to improve the heat stability of oils or to improve the nutritional quality of seed oil.

As G869 transgenic plants have an altered response to the fungal pathogen *Erysiphe orontii*, G869 or its equivalogs could be used to manipulate the defense response in order to generate pathogen-resistant plants.

G877 (SEQ ID NO: 583)

Published Information

G877 was identified in an *Arabidopsis* EST (N37131). G877 is contained in P1 clone MXK23 (GenBank accession number AB026656).

Closely Related Genes from Other Species

A non-*Arabidopsis* gene closely related to G877 is the tobacco gene NtWRKY4 (GenBank accession number AB026890). Similarity between these two genes extends beyond the conserved WRKY domain.

Experimental Observations

G877 was first discovered and identified as a public *Arabidopsis* EST. The complete sequence of G877 was determined.

A line was identified that contains a T-DNA insertion in the coding sequence of G877. The insertion likely resulted in a null mutation, since it resided upstream of the conserved WRKY domain sequence. Plants that were hemizygous for that insertion segregate 3 viable: 1 nonviable seeds in the silique, and homozygous G877 knockout mutant plants were never obtained. Therefore, a (null) mutation in G877 results in embryo lethality.

G877 was ubiquitously expressed. G877 is likely to be involved in controlling some essential process(es) required for growth rather than specific aspects of embryo patterning and development. Alternatively, G877 might play different roles throughout the plant life cycle.

Utilities

The embryo lethal phenotype of a G877 mutation indicates that the gene is involved in the control of some essential aspect of growth and development. G877 or its equivalogs could therefore constitute an herbicide target, either by itself or by allowing the identification of other genes or processes essential for plant growth.

G881 (SEQ ID NO: 587)

Published Information

G881 corresponds to gene F28M20.10, first identified in the sequence of BAC clone F28M20 (released by the *Arabidopsis* Genome Initiative; GenBank accession number AL031004).

Experimental Observations

The complete cDNA sequence for G881 was determined. The annotation in GenBank for this gene (BAC AL031004) was found to be inaccurate. G881 was ubiquitously expressed, but appeared to be significantly induced in response to salicylic acid treatment. The function of this gene was analyzed using transgenic plants in which G881 was expressed under the control of the 35S promoter. G881 overexpressors appeared to be more susceptible to infection with a moderate dose of the fungal pathogen *Erysiphe orontii*. Increased susceptibility to *Erysiphe orontii* was confirmed in repeat experiment. The induction of G881 expression by SA also implicated G881 in the disease response.

Utilities

Since G881 transgenic plants appear to have an altered response to the fungal pathogen *Erysiphe orontii*, G881 or its equivalogs could be used to manipulate the defense response in order to generate pathogen-resistant plants.

G896 (SEQ ID NO: 595)

Published Information

G896 was identified in the sequence of BAC T7123, GenBank accession number U89959, released by the *Arabidopsis* Genome Initiative. Part of the G896 sequence was first identified as an MSU EST (T45249). There is no other published or public information about G896

Closely Related Genes from Other Species

G896 is very similar to a peppermint EST (AW255156). Since the homology extends beyond the conserved domain, G896 and the mint gene are likely orthologs.

Experimental Observations

A knock-out mutant was isolated, which contains a T-DNA insertion 40 base pairs downstream of the start codon. G896 knock-out plants were more susceptible to *Fusarium oxysporum*. In addition, G896 knockout plants had lower levels of lutein in seeds as compared to wild-type control plants. Otherwise, the knock-out plants had a wild-type morphological phenotype.

In wild-type plants, G896 was mostly expressed in roots. Changes in environmental conditions did not affect its expression.

Utilities

Since G896 transgenic plants have an altered response to the fungal pathogen *Fusarium oxysporum*, the gene or its equivalogs could be used to manipulate the defense response in order to generate pathogen-resistant plants.

G911 (SEQ ID NO: 613)

Closely Related Genes from Other Species

An EST (GenBank accession A1352907) induced in the defense response of *Brassica napus* to *Leptosphaeria maculans* has extremely high homology both within and external to the conserved RING H2 domain.

Experimental Observations

The function of G9 11 was analyzed through its ectopic overexpression in *Arabidopsis*. RT-PCR of endogenous levels of G911 indicated this gene was expressed in all tissues tested. A cDNA array experiment confirmed this tissue distribution data by RT-PCR. Microarray data confirmed that G911 was overexpressed 23 fold. Other genes that were induced when G911 was overexpressed included RHA1b (another RING C2H3C2 transcription factor), pistilata, and a proline rich protein isolog. Plants overexpressing G911 looked healthier and had longer roots when grown on media lacking potassium compared to wild-type plants.

Utilities

Plants overexpressing G911 or its equivalogs may be able to be grown with fertilizer lacking or containing low potassium.

G912 (SEQ ID NO: 615)

Published Information

G912 was identified in the sequence of P1 clone MSG15 (GenBank accession number AB015478; gene MSG15.6).

Closely Related Genes from Other Species

G912 is closely related to CBF1, CBF2, and CBF3, and also closely related to the members of the CBF-like subgroup of AP2/EREBP proteins from other plants, like AF084185 Brassica napus dehydration responsive element binding protein.

Experimental Observations

G912 was recognized as the AP2/EREBP gene most closely related to Arabidopsis CBF1, CBF2, and CBF3 (Stockinger et al (1997) Proc. Natl. Acad. Sci. USA 94:1035-1040; Gilmour et al.(1998) Plant J. 16:433-442). In fact, G912 is the only other AP2/EREBP transcription factor for which sequence similarity with CBF1, CBF 2, and CBF3 extends beyond the conserved AP2 domain.

The function of G912 was studied using transgenic plants in which this gene was expressed under the control of the 35S promoter. Plants overexpressing G912 were more freezing and drought tolerant than the wild-type controls, but were also small, dark green, and late flowering. There was a positive correlation between the degree of growth impairment and the freezing tolerance. In addition, G912 expression appeared to be induced by cold, drought, and osmotic stress.

These results mirror the extensive body of work that has shown that CBF1, CBF2, and CBF3 are involved in the control of the low-temperature response in Arabidopsis, and that those genes can be used to improve freezing, drought, and salt tolerance in plants (Stockinger et al., (1997) Proc. Natl. Acad. Sci. USA 94:1035-1040; Gilmour et al. (1998) Plant J. 16:433-442; Jaglo-Ottosen et al. (1998) Science. 280:104-106; Liu et al. (1998) Plant Cell. 10:1391-1406, Kasuga et al. (1999) Nat. Biotechnol. 17:287-291).

The polypeptide sequences of G40, G41, and G42 share 71% (140 of 195 residues), 68% (144 of 211 residues), and 65% (147 of 224 residues) identity with G912, respectively. The conserved domains of G40, G41, and G42 share 94% (64 of 68 residues), 92% (63 of 68 residues), and 94% (64 of 68 residues) identity with G912, respectively In addition, G912 overexpressing plants also exhibited a sugar sensing phenotype: reduced seedling vigor and cotyledon expansion upon germination on high glucose media.

Utilities

G912 or its equivalogs could be used to improve plant tolerance to cold, freezing, drought, and salt stress.

G961 (SEQ ID NO: 633)

Published Information

G961 was first identified in the sequence of the BAC clone F19D11, GenBank accession number AC0053 10, released by the Arabidopsis Genome Initiative.

Closely Related Genes from Other Species

The most related gene to G961 is a rice gene in accession number BAA84803.

Experimental Observations

The full length sequence of G961 was experimentally confirmed. The function of this gene was analyzed by knockout analysis. Plants homozygous for a T-DNA insertion in G961 were wild-type for all assays performed.

Gene expression profiling by RT-PCR showed that G961 was primarily expressed in shoots, embryos and siliques at medium levels, and at low levels in flowers. RT-PCR data also indicated an induction of G961 transcripts accumulation upon heat treatment.

G961 knockout mutants were found to have altered seed oil content as compared to wild-type plants.

Utilities

G961 or its equivalog knockout mutants may be used to alter seed oil content in plants, which may be very important for the nutritional value and production of various food products.

G971 (SEQ ID NO: 639)

Published Information

G971 corresponds to gene F28P10.30 (CAB41085).

Experimental Observations

The function of G971 was studied using transgenic plants in which the gene was expressed under the control of the 35S promoter.

Overexpression of G971 produced a marked delay in the transition to flowering. The effect was noted, to varying extents, in approximately half of the 35S::G971 primary transformants. These plants flowered between one and three weeks later than controls under continuous light conditions. At later stages, most of the plants also appeared darker green and developed larger leaves than controls. Two of the three T2 populations selected for further study displayed a comparable, but rather more extreme late flowering phenotype to that seen in the parental plants. At early stages, seedlings from these two lines were relatively small, but recovered as development progressed, and eventually became larger than wild type. No alterations were detected in 35S::G971 plants in the physiological and biochemical analyses that were performed.

G971 was ubiquitously expressed and does not appear to be significantly induced by any of the conditions tested.

Utilities

G971 or its equivalogs could be used to modify flowering time characteristics. A wide variety of applications exist for systems that either lengthen or shorten the time to flowering.

In species such as sugarbeet where the vegetative parts of the plants constitute the crop and the reproductive tissues are discarded, it would be advantageous to delay or prevent flowering. Extending vegetative development could bring about large increases in yields.

G974 (SEQ ID NO: 641)

Published Information

G974 was first identified in a BAC-end sequence (B28553; partial G974 sequence). G974 corresponds to gene F16L1.8 (BAC F16L1, AC024228).

Closely Related Genes from Other Species

Several AP2 proteins from a variety of species (Atriplex hortensis, Lycopersicon esculentum, Glycine max, Populus balsamifera, Medicago truncatula) exhibited sequence similarity with G974 outside of the signature AP2 domain sequence, and bear nearly identical AP2 domains. These proteins may be related.

Experimental Observations

The complete sequence of G974 was obtained and G974 was studied using transgenic plants in which G974 was expressed under the control of the 35S promoter. Constitutive expression of G974 produced deleterious effects: the majority of 35S::G974 primary transformants showed a reduction in overall size and developed rather slowly compared to wild-type controls. These phenotypic alterations were not observed in the T2 generation, perhaps indicating silencing of the transgene. The T2 plants were wild-type in the physiological and biochemical analyses performed. G974 was ubiquitously expressed.

35S::G974 overexpressors had altered seed oil content.

Utilities

G974 or its equivalogs may be used to alter seed oil content in plants, which may be very important for the nutritional value and production of various food products.

G975 (SEQ ID NO: 643)

Published Information

G975 has appeared in the sequences released by the *Arabidopsis* Genome Initiative (BAC F9L1, GenBank accession number AC007591).

Closely Related Genes from Other Species

The non-*Arabidopsis* gene most highly related to G975 is represented by L46408 BNAF1258 Mustard flower buds *Brassica rapa* cDNA clone F1258. The similarity between G975 and the *Brassica rapa* gene represented by EST L46408 extends beyond the conserved AP2 domain that characterizes the AP2/EREBP family. This *Brassica rapa* gene appeared to be more closely related to G975 than *Arabidopsis* G1387, indicating that EST L46408 may represent a true G975 ortholog. The similarity between G975 and *Arabidopsis* G1387 also extends beyond the conserved AP2 domain.

Experimental Observations

G975 was identified as a new member of the AP2/EREBP family (EREBP subfamily) of transcription factors. G975 was expressed in flowers and, at lower levels, in shoots, leaves, and siliques. GC-FID and GC-MS analyses of leaves from G975 overexpressing plants showed that the levels of C29, C31, and C33 alkanes were substantially increased (up to ten-fold) compared with control plants. A number of additional compounds of similar molecular weight, presumably also wax components, also accumulated to significantly higher levels in G975 overexpressing plants. C29 alkanes constituted close to 50% of the wax content in wild-type plants (Millar et al. (1998) *Plant Cell* 11:1889-1902), suggesting that a major increase in total wax content occurred in the G975 transgenic plants. However, the transgenic plants had an almost normal phenotype (although small morphological differences were detected in leaf appearance), indicating that overexpression of G975 was not deleterious to the plant. Overexpression of G975 did not cause the dramatic alterations in plant morphology that had been reported for *Arabidopsis* plants in which the FATTY ACID ELONGATION1 gene was overexpressed (Millar et al. 1998, *Plant Cell* 11: 1889-1902). G975 may regulate the expression of some of the genes involved in wax metabolism. One *Arabidopsis* AP2 sequence (G1387) that is significantly more closely related to G975 than the rest of the members of the AP2/EREBP family is predicted to have a function and a use related to that of G975.

Utilities

G975 or its equivalogs can be used to manipulate wax composition, amount, or distribution, which in turn can modify plant tolerance to drought and/or low humidity or resistance to insects, as well as plant appearance (shiny leaves).

G975 or its equivalogs can also be used to specifically alter wax composition, amount, or distribution in those plants and crops from which wax is a valuable product.

G979 (SEQ ID NO: 649)

Published Information

G979 was first identified in a BAC-end sequence (B25031; partial G979 sequence). G979 corresponds to gene T12E18_20 (BAC T12E18, AL132971). No information is available about the function(s) of G979.

Experimental Observations

The complete sequence of G979 was obtained. The function of this gene was studied using both transgenic plants in which G979 was expressed under the control of the 35S promoter (April 2001), and a line with a T-DNA insertion in the gene. G979 codes for an AP2 protein of the AP2 subfamily, i.e., it contains two AP2 domains. The T-DNA insertion of the KO line lies in an intron, located in between the exons coding for the second AP2 domain of the protein, and is thus expected to result in a strong or null mutation. Whereas constitutive expression of G979 produced deleterious effects, the analysis of G979 KO mutant plants proved informative about the function of the gene. It was suggested that proteins of the AP2 subfamily were more likely to be involved in developmental processes (Riechmann et al. (1998). *Biol. Chem.* 379: 633-646). Fittingly, seeds homozygous for a T-DNA insertion within G979 showed delayed ripening, slow germination, and developed into small, poorly fertile plants, indicating that G979 is involved in seed development processes.

The difficulty in initially isolating, from heterozygous plants, progeny that was homozygous for the T-DNA insertion raised the possibility that homozygosity for that allele was lethal. Siliques of heterozygous plants were examined for seed abnormalities. Approximately 25% of the seeds contained in young green siliques were pale in coloration. In older, brown siliques, approximately 25% of the seeds were green and appeared slow ripening, whereas the remaining seeds were brown. Thus, it seemed likely that the seeds with altered development were homozygous for the T-DNA insertion, whereas the normal seeds were wild-type and heterozygous segregants.

Furthermore, it was observed that approximately 25% of the seed from G979 knockout heterozygous plants showed impaired (delayed) germination. Upon germination, these seeds produced extremely tiny seedlings that often did not survive transplantation. A few small and sickly looking homozygous plants could be grown, which produced siliques that contained seeds that were small and wrinkled compared to wild type.

A second, different, T-DNA insertion allele for G979 was identified as part of a TAIL PCR screen. Progeny of the heterozygous plant carrying that T-DNA insertion was either wild-type or heterozygous for the mutation, providing additional evidence for the disruption of G979 being the cause of the phenotypic alterations detected.

The initial analysis of the gene was performed using overexpressing lines. 35S::G979 transformants were generally smaller than wild type and developed spindly inflorescences that carried abnormal flowers with compromised fertility.

G979 expression was ubiquitous and not induced under any of the conditions tested.

Utilities

On the basis of the results obtained with G979 knockout mutant lines, it is possible that G979 or its equivalogs could be used to alter or modify seed germination, ripening and development properties and performance.

G987 (SEQ ID NO: 653)

Published Information

The genomic sequence of G987 is located on the *Arabidopsis* BAC clone T914 (gene T914.14) (GenBank accession number AC005315).

Experimental Observations

As determined by RT-PCR analysis, G987 was constitutively expressed in all tissues tested. A line homozygous for a T-DNA insertion in G987 was used to determine the function of this gene. The T-DNA insertion in G987 was approximately 4% into the coding sequence of the gene, and therefore is likely to result in a null mutation. G987 mutant plants could only be grown on sucrose-containing medium. Biochemical analyses of leaves from G987 mutants grown on sucrose-containing medium indicate that the mutants had reduced amounts of 16:3 fatty acids, the presence of two xanthophylls which were not present in wild-type leaves, the presence of gamma-tocopherol (which normally accumulates in seed tissue), and reduced levels of chlorophyll a and chlorophyll b.

Utilities

The low amount of 16:3 and dramatic reduction in chlorophyll indicated that the gene controls some aspect of thylakoid membrane development. G987 or its equivalogs may control proplastid to chloroplast development. This could be tested by measuring the expression of some of the genes (e.g. LHCP) that are associated with the transition from proplastid to chloroplast. If this were the case, the gene or its equivalogs may be useful for controlling the transition from proplastid to chromoplast in fruits and vegetables. There may also be some applications where it would be desirable to change the expression of the gene or its equivalogs (e.g., prevent cotyledon greening in *Brassica napus* or campestris to avoid green oil due to early frost).

G1052 (SEQ ID NO: 699)

Published Information

G1052 was identified in the sequence of BAC F9D24, GenBank accession number AL137081, released by the *Arabidopsis* Genome Initiative.

Closely Related Genes from Other Species

G1052 is similar to a rice gene BAA96162. Homology between G1052 and the rice gene extends beyond the conserved domain, thus the two genes may be orthologous.

Experimental Observations

The boundaries of G1052 in BAC AL137081 were experimentally determined and the function of G11052 was analyzed using transgenic plants in which this gene was expressed under the control of the 35S promoter. Plants overexpressing G1052 exhibited a delay in flowering and typically produced flower buds about one week later than controls in continuous light conditions. Additionally, these plants had larger leaves and were generally more sturdy than wild type.

A line homozygous for a T-DNA insertion in G1052 was also used to determine the function of this gene. The T-DNA insertion of G1052 was approximately one third of the way into the coding sequence of the gene and therefore is likely to result in a null mutation. A decrease in the percentage of lutein and increase in the xanthophyll 1 fraction was detected in one line in two experiments.

Utilities

The flowering time phenotype associated with G1052 over-expression indicates a utility for G1052 or its equivalogs as genes that can be used to manipulate flowering time in commercial plants. In addition, if the G1052 can not be transmitted through pollen, G1052 or its equivalogs may be used as a tool for preventing transgenes from escaping from transgenic plants through pollen dispersal.

G1052 or its equivalogs could be used to manipulate seed prenyl lipid composition. Lutein is an important nutraceutical, since lutein-rich diets have been shown to help prevent age-related macular degeneration (ARMD), which is the leading cause of blindness in people over the age of 65. In particular, consumption of dark green leafy vegetables has been shown in clinical studies to reduce the risk of ARMD. In addition, lutein, like other xanthophylls such as zeaxanthin and violaxanthin, is an essential component in the protection of the plant against the damaging effects of excessive light. Specifically, lutein contributes, directly or indirectly, to the rapid rise of nonphotochemical quenching in plants exposed to high light. Crop plants engineered to contain higher levels of lutein could therefore have improved photoprotection, possibly leading to less oxidative damage and better growth under high light.

G1062 (SEQ ID NO: 713)

Published Information

G1062 corresponds to gene MLJ15.14 (BAB01738.1).

Closely Related Genes from Other Species

G11062 protein shares extensive homology in the basic helix loop helix region with a cDNA from developing stem *Medicago truncatula* (AW691174) as well as a tomato shoot/meristem *Lycopersicon esculentum* cDNA (BG123327).

Experimental Observations

G1062 is a proprietary sequence initially identified from a library clone. The function of G1062 was analyzed by knockout analysis. The T-DNA insertion of G1062 was approximately 75% into the coding sequence of the gene and therefore is likely to result in a null mutation.

Homozygotes for a T-DNA insertion in G1062 showed slow growth and produced abnormal seeds. Knockout.G1062 plants displayed a longer leaf plastochron than wild type. Both generated flower buds at the same time, but wild-type plants had produced 9-11 rosette leaves at that point, compared to only 5-9 rosette leaves in the mutant (24 hour light). Following bolting, KO.G1062 inflorescences developed more slowly and were shorter than wild type. Knockout G1062 seeds appeared twisted and wrinkled in comparison to wild-type seed.

Physiological assays revealed that seedlings from a G1062 knockout mutant line have a light grown phenotype in the dark and were more severely stunted in an ethylene insensitivity assay when compared to the wild-type controls. This result indicated that G1062 may be involved in the ethylene triple response pathway. It is well known that ethylene is involved in the seed ripening process and therefore, the abnormal seed phenotype could be related to a general sensitivity to ethylene signal transduction pathway.

RT-PCR analysis indicated that the transcripts of G1062 were predominantly accumulated in the reproductive tissues. Its expression level appeared to be not affected by any treatments tested.

Utilities

G11062 or its equivalogs that alter seed shape are likely to provide ornamental applications.

Since G1062 is involved in the ethylene triple response pathway, G1062 could be used to manipulate seed or fruit ripening process, and to improve seed or fruit quality.

G1069 (SEQ ID NO: 721)

Published Information

The sequence of G1069 was obtained from EU *Arabidopsis* sequencing project, GenBank accession number Z97336, based on its sequence similarity within the conserved domain to other AT-Hook related proteins in *Arabidopsis*.

Closely Related Genes from Other Species

G1069 protein shares a significant homology to a cDNA isolated from *Lotus japonicus* nodule library. Similarity between G1069 and the Lotus cDNA extends beyond the signature motif of the family to a level that would suggest the genes are orthologous. Therefore the gene represented by EST AW720668 may have a function and/or utility similar to that of G1069.

Experimental Observations

The sequence of G1069 was experimentally determined and the function of G1069 was analyzed using transgenic plants in which G1069 was expressed under the control of the 35S promoter.

Plants overexpressing G1069 showed changes in leaf architecture, reduced overall plant size, and retarded progression through the life cycle. This is a common phenomenon for most transgenic plants in which AT-HOOK proteins are overexpressed if the gene is predominantly expressed in root in the wild-type background. G1069 was predominantly expressed in roots, based on analysis of RT-PCR results. To minimize these detrimental effects, G1069 may be overexpressed under a tissue specific promoter such as root- or leaf-specific promoter or under inducible promoter.

One of G1069 overexpressing lines showed more tolerance to osmotic stress when they were germinated in high sucrose plates. This line also showed insensitivity to ABA in a germination assay.

Utilities

The osmotic stress results indicate that G1069 could be used to alter a plant's response to water deficit conditions and, therefore, the gene or its equivalogs could be used to engineer plants with enhanced tolerance to drought, salt stress, and freezing.

G1069 affects ABA sensitivity, and thus when transformed into a plant the gene or its equivalogs may diminish cold, drought, oxidative and other stress sensitivities, and also be used to alter plant architecture, and yield.

G1073 (SEQ ID NO: 723)

Published Information

G1073 has been identified in the sequence of a BAC clone from chromosome 4 (BAC clone F23E12, gene F23E12.50, GenBank accession number AL022604), released by EU *Arabidopsis* Sequencing Project.

Closely Related Genes from Other Species

G1073 has similarity to *Medicago truncatula* cDNA clones (GenBank accession number AW574000 and AW560824) and Glycine max cDNA clones (AW349284 and A1736668) in the database.

Experimental Observations

The function of G1073 was analyzed using transgenic plants in which G1073 was expressed under the control of the 35S promoter. Transgenic plants overexpressing G1073 were substantially larger than wild-type controls, with at least a 60% increase in biomass. The increased mass of 35S::G1073 transgenic plants was attributed to enlargement of multiple organ types including leaves, stems, roots and floral organs. Petal size in the 35S::G1073 lines was increased by 40-50% compared to wild type controls. Petal epidermal cells in those same lines were approximately 25-30% larger than those of the control plants. Furthermore, 15-20% more epidermal cells per petal were produced compared to wild type. Thus, at least in petals, the increase in size was associated with an increase in cell size as well as in cell number. Additionally, images from the stem cross-sections of 35S::G1073 plants revealed that cortical cells are large and that vascular bundles contained more cells in the phloem and xylem relative to wild type Seed yield was increased compared to control plants. 5S::G1073 lines showed an increase of at least 70% in seed yield. This increased seed production was associated with an increased number of siliques per plant, rather than seeds per silique.

Flowering of G1073 overexpressing plants was delayed. Leaves of G1073 overexpressing plants were generally more serrated than those of wild-type plants. Improved drought tolerance was observed in 35S::G1073 transgenic lines.

Utilities

Transgenic plants overexpressing G1073 are large and late flowering with serrated leaves. Large size and late flowering produced as a result of G1073 or equivalog overexpression would be extremely useful in crops where the vegetative portion of the plant is the marketable portion (often vegetative growth stops when plants make the transition to flowering). In this case, it would be advantageous to prevent or delay flowering with the use of this gene or its equivalogs in order to increase yield (biomass). Prevention of flowering by this gene or its equivalogs would be useful in these same crops in order to prevent the spread of transgenic pollen and/or to prevent seed set. This gene or its equivalogs could also be used to manipulate leaf shape.

G1075 (SEQ ID NO: 725)

Published Information

The sequence of G1075 was obtained from the *Arabidopsis* genome sequencing project, GenBank accession number AC004667, based on its sequence similarity within the conserved domain to other ATHook related proteins in *Arabidopsis*.

Closely Related Genes from Other Species

G1075 is homologous to a *Medicago truncatula* cDNA clone (acc#AW574000

Experimental Observations

The function of G1075 was analyzed using transgenic plants in which G1075 was expressed under the control of the 35S promoter. Overexpression of G1075 produced very small, sterile plants. Pointed leaves were noted in some seedlings, and twisted or curled leaves and abnormal leaf serrations were noted in rosette stage plants. Bolts were short and thin with short internodes. Flowers from severely affected plants had reduced or absent petals and stamen filaments that partially or completely fail to elongate. Because of the severe phenotypes of these T1 plants, no T2 seed was produced for physiological and biochemical analysis.

RT-PCR analysis indicated that G1075 transcripts are found primarily in roots. The expression of G1075 appeared to be induced by cold and heat stresses.

Utilities

G1075 or its equivalogs could be used to modify plant architecture and development, including flower structure. If expressed under a flower-specific promoter, the gene or its equivalogs might also be useful for engineering male sterility. Because expression of G1075 is root specific, its promoter could be useful for targeted gene expression in this tissue.

G1089 (SEQ ID NO: 731)

Published Information

G1089 was initially identified as a gene represented by *Arabidopsis* EST H37430. Subsequently, the entire sequence of G1089 was identified in BAC F19K6, GenBank accession number AC037424, released by the *Arabidopsis* genome initiative.

Closely Related Genes from Other Species

The most related gene to G1089 is a rice gene represented by NCBI entry g13124871. Similarity between G1089 and the rice gene extends beyond the signature motif of the family to a level that would suggest the genes are orthologous. Therefore the gene represented by the rice gene may have a function and/or utility similar to that of G1089

Experimental Observations

The boundaries of G1089 were experimentally determined and the function of G1089 was analyzed using transgenic plants in which this gene was expressed under the control of the 35S promoter. G1089 overexpressing plants had reduced seedling vigor and were characterized as being small, yellow and sickly looking. In addition, a T-DNA knockout of G1089 was isolated. G1089 knockout mutant plants showed more tolerance to osmotic stress in a germination assay in two separate experiments. They showed more seedling vigor than wild-type control when germinated on plates containing high sucrose. G1089 appeared to be constitutively expressed.

Utilities

The osmotic stress results indicate that G1089 or its equivalogs could be used to alter a plant's response to water deficit conditions and, therefore, may be used to engineer plants with enhanced tolerance to drought, salt stress, and freezing.

G1134 (SEQ ID NO: 741)

Published Information

A partial sequence of G1134 was identified from an EST clone (GenBank accession number A1099951).

Experimental Observations

A partial sequence of G1134 was identified from an EST clone (GenBank accession number A1099951). The 5' end of the G11134 coding sequence was determined by RACE. The function of G1134 was analyzed using transgenic plants in which G1134 was expressed under the control of the 35S promoter. Primary transformants of G1134 were small with strongly curled leaves. In the T2 generation, two lines had narrow, somewhat curled leaves and siliques with altered shape. A third line segregated for small size. Additionally, plants overexpressing G1134 showed an altered response to the growth hormone ethylene. Seeds that were germinated on ACC plates in the dark had longer hypocotyls than the corresponding controls and occasionally lacked the apical hook that is part of a typical ethylene triple response. In addition, seeds from all lines germinated in the dark have a partial light grown phenotype in that their cotyledons are open and the hypocotyl is straight instead of curled.

The results from morphological and physiological analysis indicated that G1134 protein may play important roles in the regulation of ethylene biosynthesis, ethylene signal transduction pathways, or photomorphogenesis. Analysis of G1134 overexpressors revealed no apparent biochemical changes when compared to wild-type control plants. Analysis of the endogenous expression level of G1134, as determined by RT-PCR, revealed that G1134 was predominantly expressed in flower tissues. Expression of G11134 was not induced by any of the environmental conditions or pathogens tested.

Utilities

G11134 or its equivalogs could be used to alter how plants respond to ethylene and/or light. For example, it could be used to manipulate fruit ripening.

G1198 (SEQ ID NO: 763)

Published Information

The entire sequence of G1198 was reported in BAC T23G18, accession number AC011438, released by the *Arabidopsis* genome initiative.

Closely Related Genes from Other Species

G1198 is very similar to the tobacco bZIP transcription factor TGA2.2 (accession number AF031487). Similarity extends well beyond the conserved domain, suggesting that G1198 and TGA2.2 have similar functions.

Experimental Observations

The boundaries of G1198 were experimentally determined and the function of G1198 was analyzed using transgenic plants in which this gene was expressed under the control of the 35S promoter. G1198 overexpressing plants were reduced in size with smaller, narrower leaves and had significantly increased levels of a glucosinolate as compared to wild type. G1198 did not appear to be expressed in rosette leaves, but was expressed in other tissues.

G1198 overexpressing plants were found to have increased seed oil content, as compared to wild-type plants.

Utilities

G1198 or equivalog overexpression maybe used to alter seed oil content in plants, which may be very important for the nutritional value and production of various food products.

G1242 (SEQ ID NO: 787)

Published Information

The transcription regulator G1242 was identified by amino acid sequence similarity to proteins of the SWI/SNF family of chromatin remodeling factor. G1242 is found in the sequence of the chromosome 5, BAC clone T1A4 (GenBank accession number AC051627.4; nid=8027925), released by the *Arabidopsis* Genome Initiative. No additional public information related to the functional characterization of G1242 is available.

Closely Related Genes from Other Species

Sequence comparison of G1242 with sequences available in GenBank reveals strong similarity with plant proteins of several species, including *Oryza sativa, Glycine max, Gossypium hirsutum, Sorghum bicolor, Zea mays, Solanum tuberosum* and *Hordeum vulgare*.

Experimental Observations

The function of G1242 was analyzed using transgenic plants in which this gene was expressed under the control of the 35S promoter. Morphological characterization of the G11242 overexpressing lines revealed a reduction in flowering time in continuous light conditions. This phenotype was of low penetrance and was observed in a minority of lines.

RT-PCR analysis of the endogenous level of G1242 transcripts showed that G1242 is expressed predominantly in *Arabidopsis* flowers and embryos. A detectable, but low level of G1242 transcripts was observed in all other tissues. G1242 expression increased moderately upon SA treatment and may have been repressed by osmotic and cold treatments.

Utilities

G1242 overexpression appears to alter flowering time by accelerating the transition from vegetative to reproductive state. G1242 or its equivalogs could therefore be used to accelerate flowering time. Most modern crop varieties are the result of extensive breeding programs. Many generations of backcrossing may be required to introduce desired traits. Systems that accelerate flowering could have valuable applications in such programs since they allow much faster generation times. Additionally, in some instances, a faster generation time might allow additional harvests of a crop to be made within a given growing season.

G1255 (SEQ ID NO: 793)

Published Information

G1255 was identified as a gene in the sequence of BAC AC079281, released by the *Arabidopsis* Genome Initiative.

Closely Related Genes from Other Species

G1255 showed strong homology to a putative rice zing finger protein represented by sequence AC087181_3. Sequence identity between these two proteins extends beyond the conserved domain, and therefore, these genes can be orthologs.

Experimental Observations

The sequence of G1255 was experimentally determined and G1255 was analyzed using transgenic plants in which G1255 was expressed under the control of the 35S promoter. Plants overexpressing G1255 had alterations in leaf architecture, a reduction in apical dominance, an increase in seed size, and showed more disease symptoms following inoculation with a low dose of the fungal pathogen *Botrytis cinerea*. G1255 was constitutively expressed and not significantly induced by any conditions tested Utilities On the basis of the phenotypes produced by overexpression of G1255, G1255 or its equivalogs can be used to manipulate the plant's defense response to produce pathogen resistance, alter plant architecture, or alter seed size.

G1266 (SEQ ID NO: 799)

Published Information

G1266 corresponds to ERF1, 'ethylene response factor 1' (GenBank accession number AF076277) (Solano et al. (1998) *Genes Dev.* 12: 3703-3714). ERF1 was isolated in a search for *Arabidopsis* EREBP-like genes using a PCR-based approach. ERF1 expression was shown to be rapidly induced by ethylene, and to be dependent on the presence of functional EIN3 (ETHYLENE-INSENSITIVE3), as no expression was detected in ein3-1 mutants (Solano et al. (1998) supra). Furthermore, ERF1 mRNA showed constitutive high-level expression in 35S::EIN3-expressing transgenic plants, and EIN3 was shown to bind to sequences in the ERF1 promoter in a sequence-specific manner (Solano et al. (1998) supra). All these results indicated that ERF1 is downstream of EIN3 in the ethylene signaling pathway, and that both proteins act sequentially in a cascade of transcriptional regulation initiated by ethylene gas (Solano et al. (1998) supra). ERF1 binds specifically to the GCC element, which is a particular type of ethylene response element that is found in the promoters of genes induced upon pathogen attack (Solano et al., (1998) supra). 35S::ERF1-expressing transgenic plants displayed phenotypes similar to those observed in the constitutive ethylene response mutant ctr1 or in wild-type plants exposed to ethylene; however, expression of only a partial seedling triple response in these lines indicated that ERF1 mediates only a subset of the ethylene responses (Solano et al. (1998) supra). At the adult stage, 35S::ERF1-expressing transgenic plants showed a dwarf phenotype, and some ethylene-inducible genes, like basic-chitinase and PDF1.2 were constitutively activated in those lines (Solano et al. (1998) supra). All these results showed that ERF1 is a downstream ethylene signaling pathway gene.

Closely Related Genes from Other Species

The sequences of *Nicotiana tabacum* S25-XP1 (GenBank accession number AAB38748) and G1266 are very similar, with similarity between the two proteins extending beyond the conserved AP2 domain.

Experimental Observations

The function of G1266 was further analyzed using transgenic plants in which this gene was expressed under the control of the 35S promoter. As expected from the previously published work, G1266 overexpressing plants showed a dwarf phenotype. In physiological assays, it was shown that G1266 overexpressing plants were more tolerant to infection with a moderate dose of the fungal pathogen *Erysiphe orontii*. The resistance phenotype to the fungal pathogen *Erysiphe orontii* has been repeated. This phenotype might be a consequence of ERF1 being a downstream ethylene signaling pathway gene. Constitutive expression of G1266 might accelerate leaf senescence, which in turn might impair infection by *Erysiphe orontii*.

In addition, when analyzed for leaf insoluble sugar composition, three lines showed alterations in rhamnose, arabinose, xylose, and mannose, and galactose when compared with wild-type plants.

Utilities

G1266 has been shown to be a downstream ethylene signaling pathway gene, and experiments implicate this gene in the plant response to the fungal pathogen *Erysiphe orontii*. G1266 or its equivalogs could therefore be used to engineer plants with a modulated response to that and other pathogens, for example, plants showing increased resistance.

G1274 (SEQ ID NO: 805)

Published Information

G1274 is a member of the WRKY family of transcription factors. The gene corresponds to WRKY51 (At5g64810). No information is available about the function(s) of G1274.

Experimental Observations

RT-PCR analysis was used to determine the endogenous expression pattern of G1274. Expression of G1274 was detected in leaf, root and flower tissues. The biotic stress related conditions, *Erysiphe* and SA induced expression of G1274 in leaf tissue. The gene also appeared to be slightly induced by osmotic and cold stress treatments and perhaps by auxin.

The function of G1274 was studied using transgenic plants in which the gene was expressed under the control of the 35S promoter. G1274 overexpressing lines were more tolerant to growth on low nitrogen containing media. In an assay intended to determine whether the transgene expression could alter C:N sensing, 35S::G1274 seedlings contained less anthocyanins than wild-type controls grown on high sucrose/N— and high sucrose/N/Gln plates. These data together suggested that overexpression of G1274 may alter a plant's ability to modulate carbon and/or nitrogen uptake and utilization.

In addition, 35S::G1274 transgenics were more tolerant to chilling compared to the wild-type controls in both germination as well as seedling growth assays.

Overexpression of G1274 produced alterations in leaf morphology and inflorescence architecture. Four out of eighteen 35S::G1274 primary transformants were slightly small and developed inflorescences that were short, and showed reduced internode elongation, leading to a bushier, more compact stature than in wild-type.

In an experiment using T2 populations, it was observed that the rosette leaves from many of the plants were distinctly broad and appeared to have a greater rosette biomass than in wild type.

Utilities

The enhanced performance of 35S::G1274 seedlings under chilling conditions suggested that the gene might be applied to engineer crops that show better growth under cold conditions. In particular, photo-inhibition of photosynthesis (disruption of photosynthesis due to high light intensities) often occurs under clear atmospheric conditions subsequent to cold late summer/autumn nights. Chilling may also lead to yield losses and lower product quality due to poor pollination and delayed ripening. Given that the growth of many crops is very sensitive to cool temperatures, a gene that enhances growth under cool conditions could enhance yields, extend the effective growth range of chilling sensitive crop species, and reduce fertilizer and herbicide usage. Another large impact of chilling occurs during post-harvest storage. For example, some fruits and vegetables do not store well at low temperatures (for example, bananas, avocados, melons, and tomatoes). The normal ripening process of the tomato is impaired if it is exposed to cool temperatures. Genes conferring resistance to chilling temperatures may enhance tolerance during post-harvest storage.

Chilling tolerance could also serve as a model for understanding how plants adapt to water deficit. Both chilling and water stress share similar sensory transduction pathways and tolerance/adaptation mechanisms. For example, acclimation to chilling temperatures can be induced by water stress or treatment with abscisic acid. Genes induced by low temperature include dehydrins (or LEA proteins). Dehydrins are also induced by salinity, abscisic acid, water stress or during the late stages of embryogenesis. Thus, genes that protect the plant against chilling could also have a role in protection against water deficit A secondary consequence of slow growth under cold conditions is poor ground cover (of maize fields) in the spring; resulting in soil erosion, increased occurrence of weeds, and reduced uptake of nutrients. A retarded uptake of mineral nitrogen can then lead to increased losses of nitrate into the ground water.

The enhanced performance of G1274 overexpression lines under low nitrogen conditions indicated that the gene could be used to engineer crops that could thrive under conditions of reduced nitrogen availability. Such a trait would provide cost savings to the farmer by reducing the amount of fertilizer needed provide the environmental benefit of reduced fertilizer run-off into watersheds, and improve stress tolerance and yield.

35S::G1274 overexpressing lines made less anthocyanin on high sucrose plus glutamine, indicating G1274 might be used to modify carbon and nitrogen status, and hence assimilate partitioning.

The morphological phenotype shown by 35S::G1274 lines indicated that the gene might be used to alter inflorescence architecture, to produce more compact dwarf forms that might afford yield benefits.

The effects on leaf size that were observed as a result of G1274 overexpression might also have commercial applications. Increased leaf size or an extended period of leaf growth, could increase photosynthetic capacity, and biomass, and thus have a positive effect on yield.

G1275 (SEQ ID NO: 807)

Published Information

G1275 was first identified in the sequence of BAC T19G15 (GenBank accession number AC005965).

Experimental Observations

The cDNA sequence of G1275 was determined. G1275 was ubiquitously expressed, although expression levels differed among tissues. It is possible that G1275 expression is induced by several stimuli, including infection by *Erysiphe, Fusarium*, and SA treatment.

The function(s) of G1275 were investigated using both knock-out mutants and overexpressing plants in which this gene was expressed under the control of the 35S promoter.

Primary transformants of G1275 were small with reduced apical dominance. The inflorescence stems produced by these plants did not elongate normally. The plants were fertile, but seed yield was reduced because the plants were severely dwarfed.

In the knock-out mutant, the T-DNA insertion in G1275 was localized in the second intron of the gene, which is located within the conserved WRKY-box. Such insertion would result in a null mutation (unless the large fragment of exogenous sequence is perfectly spliced out from the transcribed G1275 pre-mRNA). G1275 knock-out mutant plants were indistinguishable from wild-type controls in all assays performed.

Utilities

G11275 or its equivalogs might be used to alter plant development or architecture.

G1305 (SEQ ID NO: 819)

Published Information

G1305 is a member of the (R1)R2R3 subfamily of myb transcription factors. G1305 corresponds to the gene MYB10 (Kranz et al. (1998) *Plant J.* 16: 263-276).

Experimental Observations

The function of G1305 was analyzed using transgenic plants in which the gene was expressed under the control of the 35S promoter. Overexpression of G1305 in *Arabidopsis* resulted in seedlings that were more tolerant to heat in a germination assay. Seedlings from G1305 overexpressing transgenics were greener than the control seedlings under high temperature conditions. In a repeat experiment, two lines showed the heat tolerant phenotype. In addition, plants from two of the 35S::G1305 T2 lines flowered several days earlier than wild type in each of two independent sowings (24 hour light conditions). The plants had rather flat leaves compared to controls and formed slightly thin inflorescences in some cases.

According to RT-PCR, G1305 was expressed ubiquitously and expression of the gene was unaltered in response to the environmental stress-related conditions tested.

Utilities

On the basis of the analyses performed to date, the potential utility of G1305 or its equivalogs is to regulate a plant's time to flower.

G1305 or its equivalogs may also be used to improve heat tolerance at germination. The germination of many crops is very sensitive to temperature. A gene that would enhance germination in hot conditions may be useful for crops that are planted late in the season or in hot climates.

G1313 (SEQ ID NO: 829)

Published Information

G1313 (At5g06100) corresponds to AtMYB33. Gocal et al. (2001) *Plant Physiol.* 127:1682-1693) showed that G1313 (AtMYB33) could bind to the GA response element and activate the barley alpha-amylase promoter in a transient assay in barley aleurone cells. The gene is ubiquitously expressed in *Arabidopsis*. It was hypothesized that the gene could regulate GA responsive pathways that promote flowering in *Arabidopsis*. To test this hypothesis Gocal et al. (2001) supra, analyzed whether AtMYB33 is capable of binding to the LFY gene promoter. LFY is a floral meristem identity gene that has a GA responsive element in its promoter. AtMYB33 was found to bind to the LFY promoter suggesting that the action of GA on flowering could be mediated through the activity of AtMYB33 (Gocal et al. (2001) supra).

Experimental Observations

The complete sequence of G1313 was determined. The function of this gene was analyzed using transgenic plants in which G1313 was expressed under the control of the 35S promoter. 35S::G1313 transgenics were wild-type in response to all physiological stress treatments performed.

Interestingly, overexpression of G1313 produced an apparent increase in seedling vigor in some of the T1 plants at an early seedling stage, under normal growth conditions, compared to the wild-type controls. This effect was observed in single T2 line in both the morphology and physiology assays. Given that GAs are known to promote seed germination, the increased seedling vigor could be related to a GA response in seeds. The lack on an effect of G1313 on flowering time could result from the fact that an additional factor is required for the activity of the protein. It should be noted that all the assays were performed under continuous light; since GAs are known to be critical for the floral transition to occur under SDs (8-hour light) in *Arabidopsis*, 35S::G1313 lines may have an altered flowering time response under such conditions.

Utilities

The increase in seedling vigor in G1313 transgenics plants suggested this gene could be used to increased survivability and vigor of small seedlings under field conditions potentially leading to a greater yield in crops. Published results suggested that the gene might also be used to modify flowering time in commercial species.

G1322 (SEQ ID NO: 841)

Published Information

G1322 is a member of the (R1)R2R3 subfamily of myb transcription factors. G1322 corresponds to Myb57, a gene identified by Kranz et al. ((1998) *Plant J.* 16: 263-276). The authors used a reverse-Northern blot technique to study the expression of this gene in a variety of tissues and under a variety of environmental conditions. They were unable to detect the expression of G1322 in any tissue or treatments tested (Kranz et al. (1998) *Plant J.* 16: 263-276).

Closely Related Genes from Other Species

G1322 shows sequence similarity with known genes from other plant species within the conserved Myb domain.

Experimental Observations

G1322 was analyzed using transgenic plants in which the gene was expressed under the control of the 35S promoter. 35S::G1322 transgenic plants were wild-type in phenotype with respect to the biochemical analyses performed. Overexpression of G1322 produced changes in overall plant size and leaf development. At all stages, 35S::G1322 plants were distinctly smaller than controls and developed curled dark-green leaves. Following the switch to flowering, the plants formed relatively thin inflorescence stems and had a rather poor seed yield. In addition, overexpression of (G1322 resulted in plants with an altered etiolation response as well as enhanced tolerance to germination under chilling conditions. When germinated in the dark, G11322 overexpressing transgenic plant lines had open, slightly green cotyledons. Under chilling conditions, all three transgenic lines displayed a similar germination response, seedlings were slightly larger and had longer roots. In addition, an increase in the leaf glucosinolate M39480 was observed in all three T2 lines. According to RT-PCR analysis, G1322 was expressed primarily in flower tissue.

Utilities

The utilities of G11322 or its equivalogs include altering a plant's chilling sensitivity and altering a plant's light response. The germination of many crops is very sensitive to cold temperatures. A gene that will enhance germination and seedling vigor in the cold has tremendous utility in allowing seeds to be planted earlier in the season with a higher survival rate.

G1322 or its equivalogs can also be useful for altering leaf glucosinolate composition. Increases or decreases in specific glucosinolates or total glucosinolate content are desirable depending upon the particular application. Modification of glucosinolate composition or quantity can therefore afford increased protection from predators. Furthermore, in edible crops, tissue specific promoters can be used to ensure that these compounds accumulate specifically in tissues, such as the epidermis, which are not taken for consumption.

G1323 (SEQ ID NO: 843)

Published Information

Kranz et al. ((1998) *Plant J.* 16: 263-276) published a partial cDNA sequence corresponding to G1323, naming it MYB58. Reverse-Northern data indicates that this gene is expressed primarily in leaf tissue.

Experimental Observations

The complete sequence of G1323 was determined. As determined by RT-PCR, G1323 was highly expressed in embryos, and was expressed at significantly lower levels in the other tissues tested. G1323 expression was not induced by any stress-related treatments. The function of this gene was analyzed using transgenic plants in which G1323 was expressed under the control of the 35S promoter. Primary transformants of G1323 were uniformly small and dark green, and a few were late flowering. According to the biochemical analysis of G1323 overexpressors, two had higher seed protein. The higher seed protein and lower seed oil content was observed in a repeated experiment.

Utilities

G1323 or its equivalogs could be used to alter seed protein and oil amounts and/or composition, which is very important for the nutritional value and production of various food products.

G1332 (SEQ ID NO: 855)

Published Information

G1332 is a member of the (R1)R2R3 subfamily of myb transcription factors. G1332 corresponds to the gene MYB82 (Kranz et al. (1998) *Plant J.* 16: 263-276).

Experimental Observations

The function of G1332 was analyzed using transgenic plants in which the gene was expressed under the control of the 35S promoter. Overexpression of G1332 produced a reduction in trichome density on leaf surfaces and inflorescence stems in *Arabidopsis*. No other phenotypic alterations were observed in the G1332 overexpressors.

G1332 was expressed ubiquitously and may have been repressed by *Erysiphe* infection.

Utilities

The potential utility of this gene or its equivalogs is to alter trichome initiation and number in a plant. It would be of great agronomic value to have plants that produce greater numbers of glandular trichomes that produce valuable essential oils for the pharmaceutical and food industries, as well as oils that protect plants against insect and pathogen attack.

G1412 (SEQ ID NO: 879)

Published Information

G1412 is a member of the NAC family of transcription factors. G11412 corresponds to gene At4g27410, annotated by the *Arabidopsis* Genome Initiative. The gene corresponds to sequence 1543 from patent application WO0216655 A2 on stress-regulated genes, transgenic plants and methods of use. In this publication, G1412 was reported to be cold, osmotic and salt responsive in microarray analysis. No information is available about the function(s) of G1412.

Experimental Observations

RT-PCR was used to analyze the endogenous expression pattern of G1412. The gene appeared to be constitutively expressed in all tissues tested. Furthermore, induction of G1412 in leaf tissue was observed in response to ABA, heat, drought, and mannitol.

A T-DNA insertion mutant for G1412 was then analyzed. The mutant displayed a wild-type morphology, and was wild-type in its response to the physiological analyses that were performed.

G1412 overexpressing transformants displayed wild-type morphology. However, the 35S::G1412 transgenics were insensitive to ABA and were more tolerant to osmotic stress in a germination assay on media containing high concentrations of sucrose.

Utilities

The phenotypic effects of G1412 overexpression, such as the increase in seedling vigor observed in a germination assay on high sucrose media and insensitivity to germination on ABA media, indicated that the gene could be used to engineer plants with increased tolerance to abiotic stresses such as drought, salt, heat or cold.

G1417 (SEQ ID NO: 881)

Published Information

G1417 corresponds to gene AT4g01720 (CAB77742).

Closely Related Genes from Other Species

G11417 shows sequence similarity, outside of the conserved WRKY domain, with a rice protein (gi8467950).

Experimental Observations

The function of G1417 was studied using a line homozygous for a T-DNA insertion in the gene. The T-DNA insertion lies immediately upstream of the conserved WRKY domain coding sequence, and was expected to result in a null mutation. G1417 knockout mutant plants showed reduced seedling vigor during germination. The G1417 knockout showed alterations in seed fatty acid composition. An increase in 18:2 fatty acid and a decrease in 18:3 fatty acid were observed in two seed batches.

G1417 was ubiquitously expressed and did not appear to be significantly induced by any of the conditions tested.

Utilities

G1417 or its equivalogs could be useful to manipulate the saturation levels of lipids in seeds. Alteration in seed lipid saturation could be used to improve the heat stability of oils or to improve the nutritional quality of seed oil.

G1449 (SEQ ID NO: 891)

Published Information

G1449 is annotated in the sequence of genomic clone MKP6, GenBank accession number AB022219, released by the *Arabidopsis* Genome Initiative.

Experimental Observations

A cDNA clone corresponding to G1449 was isolated from an embryo cDNA library. It was later identified in the sequence of genomic clone MKP6, GenBank accession number AB022219, released by the *Arabidopsis* Genome Initiative.

G1449 was expressed at high levels in embryos and siliques, and at significantly lower levels in roots and seedlings. It was induced by auxin in leaf tissue. Plants overexpressing G1449 showed floral abnormalities. Primary transformants showed changes in floral organ number and identity. Large petals were noted in one plant. Affected lines were also somewhat smaller than controls. These plants produced little seed and it was necessary to bulk seed for analysis. One T3 line produced flowers that were somewhat larger than control flowers with petals that were more open. These flowers often had extra petals. G1449 mutant plants did not show any other phenotypic alterations in any of the physiological or biochemical assays performed.

Utilities Because larger and more open petals are produced in some G1449 overexpressing plants, G1449 or its equivalogs may be useful for modifying flower form and size in ornamental plants. The promoter of G1449 may also be useful to drive gene expression in seeds and seed pods or fruits.

G1451 (SEQ ID NO: 893)

Published Information

G1451 is ARF8, a member of the ARF class of proteins with a VP1-like N-terminal domain and a C-terminal domain with homology to Aux/IAA proteins. ARF8, like several other ARFs, contains a glutamine-rich central domain that can function as a transcriptional activation domain (1). ARF8 was shown to bind to an auxin response element (2). It was also shown that a truncated version of ARF8 lacking the DNA binding domain but containing the activation domain and the C-terminal domain could activate transcription on an auxin responsive promoter, presumably through interactions with another factor bound to the auxin response element (1). ARF8 is closely related in sequence to ARF6 (2).

Experimental Observations

G1451 was expressed throughout the plant, with the highest expression in flowers. Transcripts of G1451 were induced in leaves by a variety of stress conditions. A line homozygous for a T-DNA insertion in G1451 was used to determine the function of this gene. The T-DNA insertion of G1451 is approximately one-fifth of the way into the coding sequence of the gene and therefore is likely to result in a null mutation.

As measured by NIR, G1451 knockout mutants had increased total combined seed oil and seed protein content compared to wild-type plants.

Utilities

G1451 or its equivalogs may be used to alter seed oil and protein content, which may be very important for the nutritional value and production of various food products G1451 or its equivalogs could also be used to increase plant biomass. Large size is useful in crops where the vegetative portion of the plant is the marketable portion since vegetative growth often stops when plants make the transition to flowering.

G1468 (SEQ ID NO: 895)

Published Information

The genomic sequence of G1468 is located on the *Arabidopsis* BAC clone T7123 (GenBank accession number U89959). There is no published information available regarding the function of G1468.

Experimental Observations

A T-DNA insertion mutant for G1468 behaved similarly to the wild-type controls in all morphological and physiological assays performed. G1468 was predominantly expressed in flowers and embryos. Furthermore, its expression level was unaffected by any of the conditions tested.

The function of G1468 was studied using transgenic plants in which the gene was expressed under the control of the 35S promoter. Overexpression of G11468 produced plants that were rather dark in coloration compared to wild type controls at early stages. Severely affected individuals arrested growth early in vegetative development. Plants that survived formed narrow, gray leaves and showed a marked delay in onset of flowering. Many of the late flowering plants had more axillary rosette leaves compared to controls leading to an increase in vegetative biomass.

Utilities

The alterations in leaf shape, size, and coloration shown by 35S::G1468 transformants indicated that the gene or its equivalogs may be applied to modify plant architecture.

The delayed bolting suggests that gene might also be used to manipulate flowering time in commercial species. In particular, an extension of vegetative growth can significantly increase biomass and result in substantial yield increases.

G1471 (SEQ ID NO: 897)

Published Information

G1471 was identified in the sequence of P1 clone MDK4, GenBank accession number AB010695, released by the *Arabidopsis* Genome Initiative.

Experimental Observations

The function of this gene was analyzed using transgenic plants in which G1471 was expressed under the control of the 35S promoter. All 35S::G1471 primary transformants were markedly small, had narrow curled leaves and formed thin inflorescence stems. Flowers from many T1 plants were extremely poorly developed, and often had organs missing, reduced in size, or highly contorted. Due to such defects, the fertility was very low, and approximately one third of the lines were tiny and completely sterile. Plants from one T2 generation line displayed wild-type morphology, indicating that the transgene might have become silenced. Two lines, however, were small, had narrow curled leaves and flowered marginally earlier than controls. The phenotype of these transgenic plants was wild-type in all other assays performed. G1471 appeared to be expressed at medium levels in siliques and embryos.

G1471 overexpressing plants were found to have increased seed oil content compared to wild-type plants.

Utilities

G1471 or equivalog overexpression may be used to increase seed oil content in plants.

Because expression of G1471 is embryo and silique specific, its promoter could be useful for targeted gene expression in these tissues.

G1482 (SEQ ID NO: 905)

Published Information

G1482 was identified as a gene in the sequence of BAC AC006434, released by the *Arabidopsis* Genome Initiative.

Experimental Observations

The sequence of G1482 was experimentally determined. The data presented for this gene are from plants homozygous for a T-DNA insertion in G1482. The T-DNA insertion of G1482 is in coding sequence and therefore this knockout mutant is likely to contain a null allele. Homozygous plants harboring a T-DNA insertion in G1482 displayed significantly more root growth on MS control plates as well as on different stresses in three separate experiments. G1482 was constitutively expressed and significantly induced by auxin, ABA and osmotic stress.

The function of G1482 was studied using transgenic plants in which the gene was expressed under the control of the 35S promoter. Plants overexpressing G1482 contained high levels of anthocyanins.

Utilities

Based on the phenotypes produced when this gene is knocked out, G1482 or its equivalogs could be used to manipulate root growth, particularly in response to environmental stresses such as drought and low nutrients.

G1482 or its equivalogs could also be used to alter anthocyanin production. The potential utilities of this gene includes alterations in pigment production for horticultural purposes, and possibly increasing stress resistance in combination with another transcription factor. Flavonoids have antimicrobial activity and could be used to engineer pathogen resistance. Several flavonoid compounds have health promoting effects such as the inhibition of tumor growth and cancer, prevention of bone loss and the prevention of the oxidation of lipids. Increasing levels of condensed tannins, whose biosynthetic pathway is shared with anthocyanin biosynthesis, in forage legumes is an important agronomic trait because they prevent pasture bloat by collapsing protein foams within the rumen. For a review on the utilities of

G1499 (SEQ ID NO: 913)

Published Information

The sequence of G1499 was obtained from the *Arabidopsis* genome sequencing project, GenBank accession number AB020752, based on its sequence similarity within the conserved domain to other bHLH related proteins in *Arabidopsis*.

Closely Related Genes from Other Species

The similarity between G1499 and *Brassica rapa* subsp. *pekinensis* flower bud cDNA (acc#AT002234) is significant not only in the conserved bHLH domains but also outside of the domains.

Experimental Observations

The function of G1499 was analyzed using transgenic plants in which G1499 was expressed under the control of the 35S promoter. A range of phenotypes was observed in primary transformants of G1499. The most severely affected plants were smaller than controls, dark green, with strongly curled leaves, and produced bolts that terminated without an inflorescence. In some cases, flowers were replaced with filamentous structures or carpelloid structures. Less severely affected lines produced flowers where sepals were converted to carpelloid tissue. Petals and stamens were absent or reduced in size and number. Mildly affected T1 plants that were small in size but produced normal flowers were taken to the T2 generation. Three T2 lines produced plants that were smaller than controls, darker green, and had narrower leaves.

G1499 overexpressors were similar to their wild-type counterparts in all physiological and biochemical assays.

G1499 was predominantly expressed in the reproductive tissues such as flower, embryo and silique. Lower levels of expression were also detected in roots and germinating seeds. It's expression level was unaffected by any of the environmental conditions tested.

Phenotypes produced by overexpressing G1499 and G779 were similar in the aspects of flower structures. Cluster analysis using basic helix-loop-helix motif revealed that both proteins of G1499 and G779 are closely related.

Utilities

G1499 or its equivalogs could be used to modify plant architecture and development, including flower structure. If expressed under a flower-specific promoter, it might also be useful for engineering male sterility. Because expression of G1499 is flower and embryo specific, its promoter could be useful for targeted gene expression in these tissues.

Potential utilities of this gene or its equivalogs also include increasing chlorophyll content, allowing more growth and productivity in conditions of low light. With a potentially higher photosynthetic rate, fruits could have higher sugar content. Increased carotenoid content could be used as a nutraceutical to produce foods with greater antioxidant capability.

G1540 (SEQ ID NO: 919)

Published Information

G1540 is the *Arabidopsis* WUSCHEL (WUS) gene and encodes a novel subclass of homeodomain protein (Mayer et al. (1998) *Cell* 95:805-815).

WUS is a key developmental protein that has a core role in regulating the fate of stem cells within *Arabidopsis* apical meristems. The central zone of an apical meristem contains a pool of undifferentiated pluripotent stems cells. These stem cells are able to both maintain themselves and supply cells for incorporation into new organs on the periphery of the meristem (shoot meristems initiate leaves whereas flower meristems initiate whorls of floral organs).

Defects are visible in the shoots and flowers of wus mutants (Laux et al. (1996) *Development* 122: 87-96; Endrizzi et al. (1996) *Plant J.* 10:967-979). Wus mutants fail to properly organize a shoot meristem in the developing embryo. Post-embryonically, wus shoot meristems become flattened and terminate growth prematurely. Leaf primordia and secondary shoots often initiate ectopically across the surface of these terminated structures. The leaf primordia usually develop into a disorganized bunch and a secondary shoot meristem takes over growth. This secondary meristem then terminates and the developmental pattern is repeated, leading to a plant with no clear main axis of growth and clusters of leaves at the tips of shoots. Wus floral meristems exhibit a comparable phenotype to the shoot meristem; development often ceases prematurely such that flowers either lack the innermost whorls of organs, or possess a single stamen in place of the inner whorls.

The mutant phenotype indicates that wus is required to maintain the identity of the central zone within apical meristems and prevent those cells from becoming differentiated. In situ expression patterns of WUS RNA support such a conclusion; WUS is first observed in the embryonic shoot meristem at the 16-cell stage. Later, expression becomes confined to small groups of cells (in shoot and floral meristems) at the base of the central zone where it specifies the fate of overlying cells as stem cells. WUS is thought to be expressed, and act, independently of another homeobox gene, SHOOT MERISTEMLESS (STM), G431, which has a related function (Long et al. (1996) Development 125: 3027-3035). STM is initially required for the establishment of the shoot meristem during embryogenesis. Later STM is expressed throughout the whole meristem dome where, together with an antagonist, CLAVATA1, it regulates transition of cells from the central zone towards differentiation and organ formation at the meristem periphery (Clarke et al. (1996) *Development* 122: 1565-1575; Endrizzi et al. (1996) *Plant J.* 10:967-979). A current hypothesis is that WUS specifies the identity of central stem cells whereas STM allows the progeny of those cells to proliferate before being partitioned into organ primordia (Mayer et al. (1998) *Cell* 95:805-815).

The effects of WUS over-expression have not yet been published. However, based on the present model for WUS function, its ectopic expression might be expected to induce formation of ectopic meristematic stem cells.

Experimental Observations

Over-expressers for G1540 (WUSCHEL) formed callus-like structures on leaves, stems and floral organs. These observations correlate with the proposed role of WUS in specifying stem cell fate in meristems. In T1 over-expressers, cells took on characteristics of stem cells at inappropriate locations, indicating that WUS was sufficient to specify stem cell identity.

Utilities

The over-expression phenotype indicates that G1540 is sufficient to confer stem cell identity on plant cells, and thereby prevent them from differentiating. The gene or its equivalogs might be of utility in the maintenance of plant cell lines grown in vitro, where the differentiation of those lines creates difficulties. The gene or its equivalogs might also be applied to transformation systems for recalcitrant species, where generation of callus is currently problematic but is required as part of the transformation procedure.

G1560 (SEQ ID NO: 925)

Published Information

The heat shock transcription factor G1560 is a member of the class-A HSFs (Nover et al. (1996) *Cell Stress & Chaperones* 1:215-223) characterized by an extended HR-A/B oligomerization domain. G1560 is found in the sequence of the chromosome 3, P1 clone: MW123 (GenBank accession AB022223.1 GI:4159712), released by the *Arabidopsis* Genome Initiative. The translational start and stop codons were correctly predicted. No additional public information related to the functional characterization of G1560 is available.

Closely Related Genes from Other Species

Amino acid sequence comparison with entries available from GenBank shows strong similarity with plant HSFs of several species (*Oryza sativa, Lycopersicon peruvianum, Medicago truncatula, Solanum tuberosum, Lycopersicon esculentum, Glycine max, Pisum sativum, Hordeum vulgare* subsp. *Vulgare, Triticum aestivum* and *Lotus japonicus*; see accompanying BLAST reports).

Experimental Observations

The function of G1560 was analyzed through its ectopic overexpression in plants. Analysis of the endogenous level of G1560 transcripts by RT-PCR revealed that this gene was predominantly expressed in shoots, flowers, embryo and siliques. G1560 expression was induced strongly in response to heat shock treatment and moderately after auxin, ABA, drought and osmotic treatment. The inducibility of G1560 by heat shock treatment suggested that G1560 may play a central role in the regulation of the heat shock response in plants. Physiological analysis of G1560 overexpressors revealed no changes compared to wild type control upon either heat shock or osmotic stress treatment.

Overexpression of G1560 resulted in transgenic T1 and T2 plants with altered morphological characteristics. Throughout development, transgenic 35S::G1560 T1 and T2 plants were smaller than wild-type plants and showed abnormalities in flower development. In several independent lines floral organs, mainly petals and stamens, were poorly developed or absent, and flower buds were generally smaller and round-shaped. This phenotype resulted in poor fertility and low seed yield. Current models regarding the mode of action of chaperones (regulated by HSFs) are insufficient to explain this phenotype at the molecular level, or to suggest if the phenotype is a direct or indirect consequence of the overexpression of HSF G1560.

Utilities

The overexpression of G1560 resulted in plants of small size and altered flower morphology. Alteration of G1560 expression could potentially be used to modify plant development and fertility.

G1634 (SEQ ID NO: 927)

Published Information

G1634 was identified in the sequence of BAC MJJ3, GenBank accession number AB005237, released by the *Arabidopsis* Genome Initiative.

Experimental Observations

The complete sequence of G1634 was determined. cDNA microarray analyses of the endogenous levels of G1634 indicated that this gene was primarily expressed in root and silique tissues. In addition, G1634 expression was not altered significantly in response to any of the stress-related treatments tested. The function of this gene was analyzed using transgenic plants in which G1634 was expressed under the control of the 35S promoter. The phenotype of these transgenic plants was wild-type in all assays performed.

G1634 overexpressors were found to have altered seed protein content compared to wild-type plants.

Utilities

G1634 or its equivalogs could be used to alter seed protein amounts which is very important for the nutritional value and production of various food products.

G1645 (SEQ ID NO: 929)

Published Information

G1645 is a member of the (R1)R2R3 subfamily of MYB transcription factors. G1645 was identified in the sequence of BAC T24P13, GenBank accession number AC006535, released by the *Arabidopsis* Genome Initiative.

Closely Related Genes from Other Species

G1645 shows extensive sequence similarity to MYB proteins from other plant species including tomato (AW624217), and alfalfa (AQ917084).

Experimental Observations

The function of G1645 was analyzed using transgenic plants in which the gene was expressed under the control of the 35 S promoter. Overexpression of G1645 produced marked changes in *Arabidopsis* leaf, flower and shoot development. These effects were observed, to varying extents, in the majority of 35S::G1645 primary transformants.

At early stages, many 35S::G1645 T1 lines appeared slightly small and most had rather rounded leaves. However, later, as the leaves expanded, in many cases they became misshapen and highly contorted. Furthermore, some of the lines grew slowly and bolted markedly later than control plants. Following the switch to flowering, 35S::G1645 inflorescences often showed aberrant growth patterns, and had a reduction in apical dominance. Additionally, the flowers were frequently abnormal and had organs missing, reduced in size, or contorted. Pollen production also appeared poor in some instances. Due to these deficiencies, the fertility of many of the 35S::G1645 lines was low and only small numbers of seeds were produced.

Overexpression of G1645 resulted in a low germination efficiency when germinated on the 32C heat stress.

As determined by RT-PCR, G11645 was expressed in flowers, embryos, germinating seeds and siliques. No expression of G1645 was detected in the other tissues tested. G1645 expression appeared to be repressed in rosette leaves infected with the phytopathogen *Erysiphe orontii*.

Utilities

G1645 or its equivalogs could be used to alter inflorescence structure, which may have value in production of novel ornamental plants.

G1645 or equivalog activity could be used to alter a plant's response to heat stress.

G1760 (SEQ ID NO: 937)

Published Information

G1760 was identified in the sequence of BAC clone F20D10 (gene AT4g37940/F20D10.60, GenBank accession number CAB80459). G1760 also corresponds to AGL21. A phylogenetic analysis of the *Arabidopsis* MADS box gene family situated G1760/AGL21 in the same clade as ANR1 and AGL17, which are root-specific (Alvarez-Buylla et al.

(2000) *Proc. Natl. Acad. Sci. USA.* 97:5328-5333). No information is available about the function(s) of G1760/AGL21.

Closely Related Genes from Other Species

G1760 shows sequence similarity with a tomato gene represented in GenBank by an EST: AW219962 EST302445 tomato root during/after fruit set, *Lycopersicon esculentum* cDNA clone cLEX6M17. Since similarity between the two genes extends beyond the conserved MADS domain, and because of the fact the tomato gene represented by EST AW219962 is also expressed in roots, both genes might be related in function.

Experimental Observations

The function of G1760 was studied using transgenic plants in which this gene was expressed under the control of the 35S promoter. Overexpression of G1760 consistently reduced the time to flowering. G1760 overexpressing plants did not show any other morphological or physiological alterations in the assays that were performed. In fact, overexpression of G11760 was not observed to have deleterious effects: 35S::G1760 plants were healthy and attained a wild-type stature when mature. To date, a substantial number of genes have been found to promote flowering. Many, however, including those encoding the transcription factors, APETALA1, LEAFY, and CONSTANS, produce extreme dwarfing and/or shoot termination when over-expressed.

G1760 was specifically expressed in roots, in good agreement with its position within the *Arabidopsis* MADS-box gene family phylogenetic tree (Alvarez-Buylla et al. (2000) supra). The expression of G1760 appeared to be ectopically induced by drought stress.

Utilities

G1760 could be used to modify a plant's flowering time characteristics. In addition, its promoter could be used to confer root specific gene expression, as well as to engineer responsiveness to drought.

In general, a wide variety of applications exist for systems that either lengthen or shorten the time to flowering.

G1816 (SEQ ID NO: 939)

Published Information

G1816 is a member of the MYB-related class of transcription factors. The gene corresponds to TRIPTYCHON (TRY), and has recently been shown to be involved in the lateral inhibition during epidermal cell specification in the leaf and root (Schellmann et al. (2002) *EMBO J.* 21: 5036-5046). The model proposes that TRY (G1816) and CPC (G225) function as repressors of trichome and atrichoblast cell fate. TRY loss-of-function mutants form ectopic trichomes on the leaf surface. TRY gain-of-function mutants are glabrous and form ectopic root hairs.

Experimental Observations

The complete sequence of G1816 was determined. The function of the gene was studied using transgenic plants in which G1816 was expressed under the control of the 35S promoter. Consistent with the morphological phenotypes published for the 35S::TRY overexpressors, the transgenic plants were glabrous and formed ectopic root hairs. These transgenic lines were also more tolerant to growth under N limiting conditions, both in a germination assay as well as a root growth assay on older seedlings. The N germination assay looked for alterations in C:N sensing through the increase or decrease in anthocyanin production of the transgenics relative to the controls. 35S::G1816 transgenic lines produced less anthocyanin than wild-type controls. However, in addition to the N tolerance phenotypes observed in these transgenic lines, the 35S::G1816 plants were also insensitive to growth retardation effects of germination on conditions of high glucose, suggesting that this gene could play a role in sugar sensing responses in the plant or osmotic stress tolerance. Genes for many sugar sensing mutants are allelic to genes involved in ABA and ethylene signaling (Rolland et al. (2002) *Plant Cell* 14 Suppl: S1185-S205. Therefore, G1816 could also be involved in hormone signaling pathways.

Utilities

The phenotypic effects of G1816 overexpression, such as the increase in root hair formation and the increase in seedling vigor observed in a germination assay on high glucose media, indicated that the gene could be used to engineer plants with increased tolerance to abiotic stresses such as drought, salt, heat or cold.

In addition, the enhanced performance of G1816 overexpression lines under low nitrogen conditions indicated that the gene could be used to engineer crops that could thrive under conditions of reduced nitrogen availability.

The effect of G1816 overexpression on insensitivity to glucose in a germination assay, indicated that the gene could be involved in sugar sensing responses in the plant. The potential utilities of a gene involved in glucose-specific sugar sensing are to alter energy balance, photosynthetic rate, carbohydrate accumulation, biomass production, source-sink relationships, and senescence.

G1816 could also be used to alter anthocyanin production and trichome formation in leaves

G1820 (SEQ ID NO: 941)

Published Information

G1820 is a member of the Hap5 subfamily of CCAAT-box-binding transcription factors. G1820 was identified as part of the BAC clone MBA10, accession number AB025619 released by the *Arabidopsis* Genome sequencing project.

Closely Related Genes from Other Species

G1820 is closely related to a soybean gene represented by EST335784 isolated from leaves infected with *Colletotrichum trifolii*. Similarity between G1820 and the soybean gene extends beyond the signature motif of the family to a level that would suggest the genes are orthologous. Therefore the gene represented by EST335784 may have a function and/or utility similar to that of G1820.

Experimental Observations

The complete sequence of G1820 was determined. The function of this gene was analyzed using transgenic plants in which G1820 was expressed under the control of the 35S promoter. G1820 overexpressing lines showed more tolerance to salt stress in a germination assay. They also showed insensitivity to ABA, with the three lines analyzed showing the phenotype. The salt and ABA phenotypes could be related to the plants increased tolerance to osmotic stress because in a severe water deprivation assay, G1820 overexpressors are, again, more tolerant.

Interestingly, overexpression of G1820 also consistently reduced the time to flowering. Under continuous light conditions at 20-25 C, the 35S::G1820 transformants displayed visible flower buds several days earlier than control plants. The primary shoots of these plants typically started flower initiation 1-4 leaf plastochrons sooner than those of wild type. Such effects were observed in all three T2 populations and in a substantial number of primary transformants.

When biochemical assays were performed, some changes in leaf fames were detected. In one line, an increase in the percentage of 18:3 and a decrease in 16:1 were observed. Otherwise, G11820 overexpressors behaved similarly to wild-type controls in all biochemical assays performed. As determined by RT-PCR, G1820 was highly expressed in embryos and siliques. No expression of G1820 was detected in the other tissues tested. G1820 expression appeared to be induced in rosette leaves by cold and drought stress treatments, and overexpressing lines showed tolerance to water deficit and high salt conditions.

One possible explanation for the complexity of the G1820 overexpression phenotype is that the gene is somehow involved in the cross talk between ABA and GA signal transduction pathways. It is well known that seed dormancy and germination are regulated by the plant hormones abscisic acid (ABA) and gibberellin (GA). These two hormones act antagonistically with each other. ABA induces seed dormancy in maturing embryos and inhibits germination of seeds. GA breaks seed dormancy and promotes germination. It is conceivable that the flowering time and ABA insensitive phenotypes observed in the G1820 overexpressors are related to an enhanced sensitivity to GA, or an increase in the level of GA, and that the phenotype of the overexpressors is unrelated to ABA. In *Arabidopsis*, GA is thought to be required to promote flowering in non-inductive photoperiods. However, the drought and salt tolerant phenotypes would indicate that ABA signal transduction is also perturbed in these plants. It seems counterintuitive for a plant with salt and drought tolerance to be ABA insensitive since ABA seems to activate signal transduction pathways involved in tolerance to salt and dehydration stresses. One explanation is that ABA levels in the G1820 overexpressors are also high but that the plant is unable to perceive or transduce the signal.

G1820 overexpressors also had decreased seed oil content and increased seed protein content compared to wild-type plants Utilities G1820 affects ABA sensitivity, and thus when transformed into a plant this transcription factor or its equivalogs may diminish cold, drought, oxidative and other stress sensitivities, and also be used to alter plant architecture, and yield.

The osmotic stress results indicate that G1820 or its equivalogs could be used to alter a plant's response to water deficit conditions and can be used to engineer plants with enhanced tolerance to drought, salt stress, and freezing. Evaporation from the soil surface causes upward water movement and salt accumulation in the upper soil layer where the seeds are placed. Thus, germination normally takes place at a salt concentration much higher than the mean salt concentration of in the whole soil profile. Increased salt tolerance during the germination stage of a crop plant would impact survivability and yield.

G1820 or its equivalogs could also be used to accelerate flowering time.

G1820 or its equivalogs may be used to modify levels of saturation in oils.

G1820 or its equivalogs may be used to seed protein content.

The promoter of G1820 could be used to drive seed-specific gene expression.

Utilities

G1820 or equivalog overexpression may be used to alter seed protein content, which may be very important for the nutritional value and production of various food products

G1842 (SEQ ID NO: 943)

Published Information

G1842 corresponds to F1505.2 (BAA97510). The high level of sequence similarity between G1842 and FLOWERING LOCUS C (Michaels and Amasino, 1999; Sheldon et al., 1999) has been previously described (Ratcliffe et al. (2001) *Plant Physiol.* 126:122-132).

Experimental Observations

G1842 was recognized as a gene highly related to *Arabidopsis* FLOWERING LOCUS C (FLC; Michaels et al. (1999) *Plant Cell* 11, 949-956; Sheldon et al. (1999) *Plant Cell* 11, 445-458), and to MADS AFFECTING FLOWERING1 (Ratcliffe et al. (2001) *Plant Physiol.* 126:122-132). FLC acts as a repressor of flowering (Michaels et al. (1999) *Plant Cell* 11, 949-956; Sheldon et al. (1999) *Plant Cell* 11, 445-458). Similarly, G157/MAF1 can cause a delay in flowering time when overexpressed (Ratcliffe et al. (2001) *Plant Physiol.* 126:122-132.

The function of G1842 was studied using transgenic plants in which this gene was expressed under the control of the 35S promoter. Overexpression of G1842 reduced the time to flowering in the Columbia background. No consistent alterations were detected in 35S::G1842 plants in the physiological and biochemical analyses that were performed.

Early flowering was observed in 13/21 35S::G1842 primary transformants: under continuous light conditions, these plants produced flower buds approximately 1 week earlier than controls. A comparable phenotype was also noted in the T2 populations from each of the three lines examined. In a separate experiment, the 35S::G1842 transgene was transformed into Stockholm (a late flowering, vernalization-sensitive ecotype). A comparable result was observed to that seen for Columbia: approximately 50% of 35S::G1842 Stockholm plants flowered earlier than wild-type controls.

Although G1842 is highly related in sequence to G157, G859, and FLC, its overexpression reduced the time to flowering, whereas overexpression of G157, G859, and FLC often caused a delay in flowering. In other words, whereas the function of G157, G859, and FLC appeared to repress flowering, G1842 was an activator of that process.

Utilities

G1842 or its equivalogs could be used to alter flowering time.

G1843 (SEQ ID NO: 945)

Published Information

G1843 corresponds to F1505.3 (BAA9751 1). There is no literature published on G1843, except our own (Ratcliffe et al. (2001) *Plant Physiol.* 126:122-132). G1843 belongs to a group of five *Arabidopsis* MADS-box genes that are highly related to FLC (G1759), a repressor of the floral transition, and that we have called MADS AFFECTING FLOWERING 1-5 (Ratcliffe et al. (2001) *Plant Physiol.* 126:122-132). The published report describes functional data for only MAFI (G157), but the sequence similarity among all the members of the group is noted.

Experimental Observations

The function of G11843 was studied using transgenic plants in which the gene was expressed under the control of the 35S promoter. Overexpression of G11843 caused alterations in plant growth and development, in particular a severe reduction in overall plant size, premature senescence, and early flowering. That G1843 caused an effect in flowering time was expected because of its sequence similarity to G1759 (FLC), G157 (MAF1), and G859, G1842, and G1844. However, in contrast to all these other genes, which when overexpressed can alter flowering time (either delay or accelerate, depending on the gene) without severe side effects on the plant, overexpression of G1843 was severely detrimental.

Primary transformants for 35S::G1843 were consistently small, showed stunted growth, and formed poorly developed inflorescences that yielded relatively few seeds. The most severely affected of these plants were very small, and died at early stages of development. Approximately 50% of the 35S::G1843 transformants were also markedly early flowering and displayed visible flower buds 1-7 days earlier than any of the wild-type controls. Most notably, the leaves of 35S::G1843 transformants frequently senesced prematurely. A total of six T2 lines were morphologically examined; all exhibited (to varying extents) comparable phenotypes to those observed in the T1 generation, showing premature senescence and stunted growth. Due to these deleterious effects, however, an accurate determination of flowering time was difficult to make in the T2 generation.

The deleterious effects caused by G1843 overexpression were also noted in the physiological analyses that were performed: in general, the G1843 overexpressing lines showed reduced seedling vigor and were pale compared to wild-type controls. 35S::G1843 plants behaved otherwise like wild-type controls in the physiological assays.

No alterations were detected in 35S::G1843 plants in the biochemical analyses that were performed.

G1843 was ubiquitously expressed and did not appear to be significantly induced by any of the conditions tested.

G1947 (SEQ ID NO: 949)

Published Information

The heat shock transcription factor G1947 is a member of the class-A HSFs (Nover et al. (1996) Cell Stress Chaperones 1: 215-223) characterized by an extended HR-A/B oligomerization domain. G1947 is found in the sequence of the chromosome 5 P1 clone MQD 19 (GenBank accession AB02665 1.1 GI:4757407), released by the Arabidopsis Genome Initiative. The start codon was incorrectly predicted in the public annotation.

Experimental Observations

Analysis of the endogenous level of G1947 transcripts by RT-PCR revealed a constitutive expression, with the highest expression levels in rosette leaves and the lowest in shoots and roots. G1947 expression appeared to be induced by a variety of physiological or environmental conditions (auxin, ABA, heat, drought and osmotic stress).

A line homozygous for a T-DNA insertion in G1947 was used to analyze the function of this gene. The insertion point is 163 nucleotides downstream from the initiation codon of G11947, and therefore should result in a null mutation.

G11947 mutant plants formed inflorescences that grew for an extended period of time, and continued to generate flowers for substantially longer than wild-type controls. In G11947 mutant plants, silique development was generally poor: they were very short and contained only a few irregularly shaped seeds. Thus, the extended phase of flower production observed in G1947 knockout mutant plants might have been the result of poor fertility, because extended production of flowers and delayed floral organ abscission is often seen in sterile Arabidopsis mutants. The basis for the reduced fertility of G1947 knockout plants was not apparent from the morphology of their flowers. In addition, some inconsistent effects on seedling size were noted for G1947 knockout mutants. No size differences were noted between rosette stage G1947 knockout plants and controls, although at late stages the G1947 knockout plants appeared bushier than controls, probably due to continued growth of the inflorescence stems.

No altered phenotypes were observed for G11947 knockout plants in any of the physiological or biochemical assays performed.

Utilities

G1947 or its equivalogs could be used to engineer infertility in transgenic plants. G1947 may also have utility in engineering plants with longer-lasting flowers for the horticulture industry.

G2010 (SEQ ID NO: 951)

Published Information

G2010 is a member of the SBP family of transcription factors and corresponds to sp14 (Cardon et al., 1999). Expression of sp14 is up-regulated during development under both long day and short day conditions and is highly expressed in the inflorescence tissue. Expression of G2010 is localized to the rib meristem and inter-primordial regions of the inflorescence apex (Cardon et al (1999) Gene 237: 91-104).

Closely Related Genes from Other Species

A gene related to G2010 is squamosa-promoter binding protein 1 from Antirrhinum majus.

Experimental Observations

The complete sequence of G2010 was determined. The function of this gene was analyzed using transgenic plants in which G2010 was expressed under the control of the 35S promoter. Overexpression of G20 10 resulted in a clear reduction in time to flowering. Under continuous light conditions, at 20-25° C, three independent T2 lines of 35S::G2010 plants flowered approximately one week earlier than wild-type controls. The primary shoot of 35S::G2010 plants switched to reproductive growth after producing 5-6 rosette leaves, compared with 8-10 rosette leaves in controls. Flower buds were first visible 12-14 days after sowing in 35S::G2010 plants compared with approximately 20 days for wild type. 35S::G2010 transformants were also observed to begin senescence sooner than controls. Otherwise, plants overexpressing G2010 are wild-type in phenotype.

Expression of G2010 was not detected by RT-PCR in any of the tissues tested. G2010 was slightly induced in rosette leaves in response to heat and cold stress treatments as well as salicylic acid treatment. The expression profile for G2010 indicated that this gene is involved in a plant's transition to flowering normally and in response to stressful environmental conditions.

Utilities

The potential utility of a gene such as G2010 or its equivalogs is to accelerate flowering time.

G2347 (SEQ ID NO: 957)

Published Information

G2347 is a member of the SBP family of transcription factors and corresponds to sp15 (Cardon et al., 1999). Expression of sp15 is up-regulated in seedlings during development under both long day and short day conditions and is highly expressed in the inflorescence tissue. Expression of G2347 is specifically localized in the inflorescence apical meristem and young flowers (Cardon et al. (1999) *Gene* 237: 91-104).

Closely Related Genes from Other Species

The closest relative to G2347 is the *Antirrhinum protein*, SBP2 (CAA63061). The similarity between these two proteins is extensive enough to suggest they might have similar functions in a plant.

Experimental Observations

G2347 was analyzed using transgenic plants in which G2347 was expressed under the control of the 35S promoter. Overexpression of G2347 markedly reduced the time to flowering in *Arabidopsis*. This phenotype was apparent in the majority of primary transformants and in all plants from two out of the three T2 lines examined. Under continuous light conditions, 35S::G2347 plants formed flower buds up a week earlier than wild type. Many of the plants were rather small and spindly compared to controls. To demonstrate that overexpression of G2347 could induce flowering under less inductive photoperiods, two T2 lines were re-grown in 12 hour conditions; again, all plants from both lines bolted early, with some initiating flower buds up to two weeks sooner than wild type. As determined by RT-PCR, G2347 was highly expressed in rosette leaves and flowers, and to much lower levels in embryos and siliques. No expression of G2347 was detected in the other tissues tested. G2347 expression was repressed by cold, and by auxin treatments and by infection by *Erysiphe*. G2347 is also highly similar to the *Arabidopsis* protein G2010. The level of homology between these two proteins suggested they could have similar, overlapping, or redundant functions in *Arabidopsis*. In support of this hypothesis, overexpression of both G2010 and G2347 resulted in early flowering phenotypes in transgenic plants.

Utilities

G2347 or its equivalogs may be used to modify the time to flowering in plants.

G2718 (SEQ ID NO: 959)

Published Information

G2718 (AT1G01380) was identified in the BAC clone, F6F3 (GenBank accession AC023628). No published information on the function(s) of G2718 is available, however, two highly related genes, TRY and CPC have been implicated in epidermal cell specification. The model proposes that TRY (G1816) and CPC (G225) function as repressors of trichome and atrichoblast cell fate (Schellmann et al. (2002) *EMBO J.* 21: 5036-5046).

Experimental Observations

The function of G2718 was studied using plants in which the gene was expressed under the control of the 35S promoter. Overexpression of G2718 resulted in a glabrous phenotype. The effect was highly penetrant, being observed in 17/17 primary transformants and each of three independent T2 lines. All of the T1 lines showed a very strong phenotype and completely lacked trichomes on leaves and stems. A comparably severe effect was observed in one of the three T2 populations, whereas the other two T2 populations each exhibited a weaker phenotype, suggesting that the effect might have become partially silenced between the generations. Trichomes were present in these weaker lines, but at a much lower density than in wild type.

In addition to the effects on trichome density, 35S::G2718 transformants were also generally slightly smaller than wild type controls.

The above phenotypic effects of G2718 overexpression are consistent with the observed effects for all of the members of the G2718 clade (G225, G226, G11826, and G682). In addition to the morphological effects, the physiological effects are quite similar to the other members of the clade as well. However, due to the apparent silencing of the transgene in the T2 generation, only one of the lines displayed a strong response. This line was clearly glabrous, exhibited ectopic root hairs and was more tolerant to growth under conditions of limited nitrogen.

Utilities

The phenotypic effects of G2718 overexpression, such as the increase in root hair formation and the increase in seedling vigor observed in a root growth assay on N-limiting media, indicated that the gene could be used to engineer plants with increased tolerance to abiotic stresses such as nutrient limitation, drought, salt, heat or cold.

The enhanced performance of G2718 overexpression lines under low nitrogen conditions indicated that the gene could be used to engineer crops that could thrive under conditions of reduced nitrogen availability.

G2718 could also be used to alter anthocyanin production and trichome formation in leaves.

Example IX

Identification of Homologous Sequences

This example describes identification of genes that are orthologous to *Arabidopsis thaliana* transcription factors from a computer homology search.

Homologous sequences, including those of paralogs and orthologs from *Arabidopsis* and other plant species, were identified using database sequence search tools, such as the Basic Local Alignment Search Tool (BLAST) (Altschul et al. (1990) *J. Mol. Biol.* 215: 403-410; and Altschul et al. (1997) *Nucleic Acid Res.* 25: 3389-3402). The tblastx sequence analysis programs were employed using the BLOSUM-62 scoring matrix (Henikoff and Henikoff (1992) *Proc. Natl. Acad. Sci.* 89: 10915-10919). The entire NCBI GenBank database was filtered for sequences from all plants except *Arabidopsis thaliana* by selecting all entries in the NCBI GenBank database associated with NCBI taxonomic ID 33090 (Viridiplantae; all plants) and excluding entries associated with taxonomic ID 3701 (*Arabidopsis thaliana*).

These sequences are compared to sequences representing transcription factor genes presented in the Sequence Listing, using the Washington University TBLASTX algorithm (version 2.0a19 MP) at the default settings using gapped alignments with the filter "off". For each gene of SEQ ID NO: 2N-1, wherein N=1-480, individual comparisons were ordered by probability score (P-value), where the score reflects the probability that a particular alignment occurred by chance. For example, a score of 3.6e-40 is 3.6×10−40. In addition to P-values, comparisons were also scored by percentage identity. Percentage identity reflects the degree to which two segments of DNA or protein are identical over a particular length. Examples of sequences so identified are presented in Table 7 and Table 9. Paralogous or orthologous sequences were readily identified and available in GenBank by Accession number (Table 7; Test sequence ID). The percent sequence identity among these sequences can be as low as 47%, or even lower sequence identity.

Candidate paralogous sequences were identified among *Arabidopsis* transcription factors through alignment, identity, and phylogenic relationships. A list of paralogs is shown in Table 9. Candidate orthologous sequences were identified from proprietary unigene sets of plant gene sequences in *Zea mays, Glycine max* and *Oryza sativa* based on significant homology to *Arabidopsis* transcription factors. These candidates were reciprocally compared to the set of *Arabidopsis* transcription factors. If the candidate showed maximal similarity in the protein domain to the eliciting transcription factor or to a paralog of the eliciting transcription factor, then it was considered to be an ortholog. Identified non-*Arabidopsis* sequences that were shown in this manner to be orthologous to the *Arabidopsis* sequences are provided in Table 7.

Example X

Screen of Plant cDNA library for Sequence Encoding a Transcription Factor DNA Binding Domain That Binds To a Transcription Factor Binding Promoter Element and Demonstration of Protein Transcription Regulation Activity The "one-hybrid" strategy (Li and Herskowitz (1993) *Science* 262: 1870-1874) is used to screen for plant cDNA clones encoding a polypeptide comprising a transcription factor DNA binding domain, a conserved domain. In brief, yeast strains are constructed that contain a lacZ reporter gene with either wild-type or mutant transcription factor binding promoter element sequences in place of the normal UAS (upstream activator sequence) of the GALL promoter. Yeast reporter strains are constructed that carry transcription factor binding promoter element sequences as UAS elements are operably linked upstream (5') of a lacZ reporter gene with a minimal GAL1 promoter. The strains are transformed with a plant expression library that contains random cDNA inserts fused to the GAL4 activation domain (GAL4-ACT) and screened for blue colony formation on X-gal-treated filters (X-gal: 5-bromo-4-chloro-3-indolyl-β-D-galactoside; Invitrogen Corporation, Carlsbad Calif.). Alternatively, the strains are transformed with a cDNA polynucleotide encoding a known transcription factor DNA binding domain polypeptide sequence.

Yeast strains carrying these reporter constructs produce low levels of beta-galactosidase and form white colonies on filters containing X-gal. The reporter strains carrying wild-type transcription factor binding promoter element sequences are transformed with a polynucleotide that encodes a polypeptide comprising a plant transcription factor DNA binding domain operably linked to the acidic activator domain of the yeast GAL4 transcription factor, "GAL4-ACT". The clones that contain a polynucleotide encoding a transcription factor DNA binding domain operably linked to GLA4-ACT can bind upstream of the lacZ reporter genes carrying the wild-type transcription factor binding promoter element sequence, activate transcription of the lacZ gene and result in yeast forming blue colonies on X-gal-treated filters.

Upon screening about 2×10$^6$ yeast transformants, positive cDNA clones are isolated; i.e., clones that cause yeast strains carrying lacZ reporters operably linked to wild-type transcription factor binding promoter elements to form blue colonies on X-gal-treated filters. The cDNA clones do not cause a yeast strain carrying a mutant type transcription factor binding promoter elements fused to LacZ to turn blue.

Thus, a polynucleotide encoding transcription factor DNA binding domain, a conserved domain, is shown to activate transcription of a gene.

Example XI

Gel Shift Assays

The presence of a transcription factor comprising a DNA binding domain which binds to a DNA transcription factor binding element is evaluated using the following gel shift assay. The transcription factor is recombinantly expressed and isolated from *E. coli* or isolated from plant material. Total soluble protein, including transcription factor, (40 ng) is incubated at room temperature in 10 μl of 1× binding buffer (15 mM HEPES (pH 7.9), 1 mM EDTA, 30 mM KCl, 5% glycerol, 5% bovine serum albumin, 1 mM DTT) plus 50 ng poly(dI-dC):poly(dI-dC) (Pharmacia, Piscataway N.J.) with or without 100 ng competitor DNA. After 10 minutes incubation, probe DNA comprising a DNA transcription factor binding element (1 ng) that has been $^{32}$P-labeled by end-filling (Sambrook et al. (1989) supra) is added and the mixture incubated for an additional 10 minutes. Samples are loaded onto polyacrylamide gels (4% w/v) and fractionated by electrophoresis at 150V for 2h (Sambrook et al. supra). The degree of transcription factor-probe DNA binding is visualized using autoradiography. Probes and competitor DNAs are prepared from oligonucleotide inserts ligated into the BamHI site of pUC118 (Vieira et al. (1987) *Methods Enzymol.* 153: 3-11). Orientation and concatenation number of the inserts are determined by dideoxy DNA sequence analysis (Sambrook et al. supra). Inserts are recovered after restriction digestion with EcoRI and HindIII and fractionation on polyacrylamide gels (12% w/v) (Sambrook et al. supra).

Example XII

Introduction of Polynucleotides into Dicotyledonous Plants

Transcription factor sequences listed in the Sequence Listing recombined into pMEN20 or pMEN65 expression vectors are transformed into a plant for the purpose of modifying plant traits. The cloning vector may be introduced into a variety of cereal plants by means well known in the art such as, for example, direct DNA transfer or *Agrobacterium tumefaciens*-mediated transformation. It is now routine to produce transgenic plants using most dicot plants (see Weissbach and Weissbach, (1989) supra; Gelvin et al. (1990) supra; Herrera-Estrella et al. (1983) supra; Bevan (1984) supra; and Klee (1985) supra). Methods for analysis of traits are routine in the art and examples are disclosed above.

Example XIII

Transformation of Cereal Plants with an Expression Vector

Cereal plants such as, but not limited to, corn, wheat, rice, sorghum, or barley, may also be transformed with the present polynucleotide sequences in pMEN20 or pMEN65 expression vectors for the purpose of modifying plant traits. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art such as, for example, direct DNA transfer or *Agrobacterium tumefaciens*-mediated transformation. It is now routine to produce transgenic plants of most cereal crops (Vasil (1994) *Plant Mol. Biol.* 25: 925-937) such as corn, wheat, rice, sorghum (Cassas et al. (1993) *Proc. Natl. Acad. Sci.* 90: 11212-11216, and barley (Wan and Lemeaux (1994) *Plant Physiol.* 104: 37-48. DNA transfer methods such as the microprojectile can be used for corn (Fromm et al. (1990) *Bio/Technol.* 8: 833-839); Gordon-Kamm et al. (1990) *Plant Cell* 2: 603-618; Ishida (1990) *Nature Biotechnol.* 14:745-750), wheat (Vasil et al. (1992) *Bio/Technol.* 10:667-674; Vasil et al. (1993) *Bio/Technol.* 11:1553-1558; Weeks et al. (1993) *Plant Physiol.* 102:1077-1084), rice (Christou (1991) *Bio/Technol.* 9:957-962; Hiei et al. (1994) *Plant J.* 6:271-282; Aldemita and Hodges (1996) *Planta* 199:612-617; and Hiei et al. (1997) *Plant Mol. Biol.* 35:205-218). For most cereal plants, embryogenic cells derived from immature scutellum tissues are the preferred cellular targets for transformation (Hiei et al. (1997) *Plant Mol. Biol.* 35:205-218; Vasil (1994) *Plant Mol. Biol.* 25: 925-937).

Vectors according to the present invention may be transformed into corn embryogenic cells derived from immature scutellar tissue by using microprojectile bombardment, with the A188XB73 genotype as the preferred genotype (Fromm et al. (1990) *Bio/Technol.* 8: 833-839; Gordon-Kamm et al. (1990) *Plant Cell* 2: 603-618). After microprojectile bombardment the tissues are selected on phosphinothricin to identify the transgenic embryogenic cells (Gordon-Kamm et al. (1990) *Plant Cell* 2: 603-618). Transgenic plants are regenerated by standard corn regeneration techniques (Fromm et al. (1990) *Bio/Technol.* 8: 833-839; Gordon-Kamm et al. (1990) *Plant Cell* 2: 603-618).

The plasmids prepared as described above can also be used to produce transgenic wheat and rice plants (Christou (1991) *Bio/Technol.* 9:957-962; Hiei et al. (1994) *Plant J.* 6:271-282; Aldemita and Hodges (1996) *Planta* 199:612-617; and Hiei et al. (1997) *Plant Mol. Biol.* 35:205-218) that coordinately express genes of interest by following standard transformation protocols known to those skilled in the art for rice and wheat (Vasil et al. (1992) *Bio/Technol.* 10:667-674; Vasil et al. (1993) *Bio/Technol.* 11:1553-1558; and Weeks et al. (1993) *Plant Physiol.* 102:1077-1084), where the bar gene is used as the selectable marker.

Example XIV

Identification of Orthologous and Paralogous Sequences

Orthologs to *Arabidopsis* genes may identified by several methods, including hybridization, amplification, or bioinformatically. This example describes how one may identify equivalogs to the *Arabidopsis* AP2 family transcription factor CBF1 (polynucleotide SEQ ID NO: 43, encoded polypeptide SEQ ID NO: 44), which confers tolerance to abiotic stresses (Thomashow et al. (2002) U.S. Pat. No. 6,417,428), and an example to confirm the function of homologous sequences. In this example, orthologs to CBF1 were found in canola (*Brassica napus*) using polymerase chain reaction (PCR).

Degenerate primers were designed for regions of AP2 binding domain and outside of the AP2 (carboxyl terminal domain):

(SEQ ID NO: 1942)
Mol 368 (reverse) 5'-CAY CCN ATH TAY MGN GGN GT-3'

(SEQ ID NO: 1943)
Mol 378 (forward) 5'-GGN ARN ARC ATN CCY TCN GCC-3'
(Y: C/T, N: A/C/G/T, H: A/C/T, M: A/C, R: A/G)

Primer Mol 368 is in the AP2 binding domain of CBF1 (amino acid sequence: His-Pro-Ile-Tyr-Arg-Gly-Val) while primer Mol 378 is outside the AP2 domain (carboxyl terminal domain) (amino acid sequence: Met-Ala-Glu-Gly-Met-Leu-Leu-Pro).

The genomic DNA isolated from *B. napus* was PCR-amplified by using these primers following these conditions: an initial denaturation step of 2 min at 93° C.; 35 cycles of 93° C. for 1 min, 55° C. for 1 min, and 72° C. for 1 min; and a final incubation of 7 min at 72° C. at the end of cycling.

The PCR products were separated by electrophoresis on a 1.2% agarose gel and transferred to nylon membrane and hybridized with the AT CBF I probe prepared from *Arabidopsis* genomic DNA by PCR amplification. The hybridized products were visualized by colorimetric detection system (Boehringer Mannheim) and the corresponding bands from a similar agarose gel were isolated using the Qiagen Extraction Kit (Qiagen, Valencia Calif.). The DNA fragments were ligated into the TA clone vector from TOPO TA Cloning Kit (Invitrogen Corporation, Carlsbad Calif.) and transformed into *E. coli* strain TOP 10 (Invitrogen).

Seven colonies were picked and the inserts were sequenced on an ABI 377 machine from both strands of sense and antisense after plasmid DNA isolation. The DNA sequence was edited by sequencer and aligned with the AtCBF1 by GCG software and NCBI blast searching.

The nucleic acid sequence and amino acid sequence of one canola ortholog found in this manner (bnCBF1; polynucleotide SEQ ID NO: 1940 and polypeptide SEQ ID NO: 1941) identified by this process is shown in the Sequence Listing.

The aligned amino acid sequences show that the bnCBF1 gene has 88% identity with the *Arabidopsis* sequence in the AP2 domain region and 85% identity with the *Arabidopsis* sequence outside the AP2 domain when aligned for two insertion sequences that are outside the AP2 domain.

Similarly, paralogous sequences to *Arabidopsis* genes, such as CBF1, may also be identified.

Two paralogs of CBF 1 from *Arabidopsis thaliana*: CBF2 and CBF3. CBF2 and CBF3 have been cloned and sequenced as described below. The sequences of the DNA SEQ ID NO: 45 and 47 and encoded proteins SEQ ID NO: 46 and 48 are set forth in the Sequence Listing.

A lambda cDNA library prepared from RNA isolated from *Arabidopsis thaliana* ecotype Columbia (Lin and Thomashow (1992) *Plant Physiol.* 99: 519-525) was screened for recombinant clones that carried inserts related to the CBF1 gene (Stockinger et al. (1997) *Proc. Natl. Acad. Sci.* 94:1035-1040). CBF1 was $^{32}$P-radiolabeled by random priming (Sambrook et al. supra) and used to screen the library by the plaque-lift technique using standard stringent hybridization and wash conditions (Hajela et al. (1990) *Plant Physiol.* 93:1246-1252; Sambrook et al. supra) 6×SSPE buffer, 60° C. for hybridization and 0.1×SSPE buffer and 60° C. for washes). Twelve positively hybridizing clones were obtained and the DNA sequences of the cDNA inserts were determined. The results indicated that the clones fell into three classes. One class carried inserts corresponding to CBF1. The two other classes carried sequences corresponding to two different homologs of CBF1, designated CBF2 and CBF3. The nucleic acid sequences and predicted protein coding sequences for *Arabidopsis* CBF1, CBF2 and CBF3 are listed in the Sequence Listing (SEQ ID NOs: 43, 45, 47 and SEQ ID NOs: 44, 46, 48, respectively). The nucleic acid sequences and predicted protein coding sequence for *Brassica napus* CBF ortholog is listed in the Sequence Listing (SEQ ID NOs: 1940 and 1941, respectively).

A comparison of the nucleic acid sequences of *Arabidopsis* CBF1, CBF2 and CBF3 indicate that they are 83 to 85% identical as shown in Table 13.

TABLE 13

| | Percent identity[a] | |
|---|---|---|
| | DNA[b] | Polypeptide |
| cbf1/cbf2 | 85 | 86 |
| cbf1/cbf3 | 83 | 84 |
| cbf2/cbf3 | 84 | 85 |

[a]Percent identity was determined using the Clustal algorithm from the Megalign program (DNASTAR, Inc.).
[b]Comparisons of the nucleic acid sequences of the open reading frames are shown.

Similarly, the amino acid sequences of the three CBF polypeptides range from 84 to 86% identity. An alignment of the three amino acidic sequences reveals that most of the differences in amino acid sequence occur in the acidic C-terminal half of the polypeptide. This region of CBF1 serves as an activation domain in both yeast and *Arabidopsis* (not shown).

Residues 47 to 106 of CBF1 correspond to the AP2 domain of the protein, a DNA binding motif that to date, has only been found in plant proteins. A comparison of the AP2 domains of CBF1, CBF2 and CBF3 indicates that there are a few differences in amino acid sequence. These differences in amino acid sequence might have an effect on DNA binding specificity.

Example XV

Transformation of Canola with a Plasmid Containing CBF1, CBF2, or CBF3

After identifying homologous genes to CBF1, canola was transformed with a plasmid containing the *Arabidopsis* CBF1, CBF2, or CBF3 genes cloned into the vector pGA643 (An (1987) *Methods Enzymol.* 253: 292). In these constructs the CBF genes were expressed constitutively under the CaMV 35S promoter. In addition, the CBF1 gene was cloned under the control of the *Arabidopsis* COR15 promoter in the same vector pGA643. Each construct was transformed into Agrobacterium strain GV3101. Transformed Agrobacteria were grown for 2 days in minimal AB medium containing appropriate antibiotics.

Spring canola (*B. napus* cv. Westar) was transformed using the protocol of Moloney et al. (1989) *Plant Cell Reports* 8: 238, with some modifications as described. Briefly, seeds were sterilized and plated on half strength MS medium, containing 1% sucrose. Plates were incubated at 24° C. under 60-80 µE/m$^2$s light using a 16 hour light/8 hour dark photoperiod. Cotyledons from 4-5 day old seedlings were collected, the petioles cut and dipped into the Agrobacterium solution. The dipped cotyledons were placed on co-cultivation medium at a density of 20 cotyledons/plate and incubated as described above for 3 days. Explants were transferred to the same media, but containing 300 mg/l timentin (SmithKline Beecham, Pa.) and thinned to 10 cotyledons/plate. After 7 days explants were transferred to Selection/Regeneration medium. Transfers were continued every 2-3 weeks (2 or 3 times) until shoots had developed. Shoots were transferred to Shoot-Elongation medium every 2-3 weeks. Healthy looking shoots were transferred to rooting medium. Once good roots had developed, the plants were placed into moist potting soil.

The transformed plants were then analyzed for the presence of the NPTII gene/kanamycin resistance by ELISA, using the ELISA NPTII kit from 5Prime-3Prime Inc. (Boulder, Colo.). Approximately 70% of the screened plants were NPTII positive. Only those plants were further analyzed.

From Northern blot analysis of the plants that were transformed with the constitutively expressing constructs, showed expression of the CBF genes and all CBF genes were capable of inducing the *Brassica napus* cold-regulated gene BN115 (homolog of the *Arabidopsis* COR15 gene). Most of the transgenic plants appear to exhibit a normal growth phenotype. As expected, the transgenic plants are more freezing tolerant than the wild-type plants. Using the electrolyte leakage of leaves test, the control showed a 50% leakage at –2 to –3° C. Spring canola transformed with either CBF1 or CBF2 showed a 50% leakage at 6 to –7° C. Spring canola transformed with CBF3 shows a 50% leakage at about –10 to –15° C. Winter canola transformed with CBF3 may show a 50% leakage at about –16 to –20° C. Furthermore, if the spring or winter canola are cold acclimated the transformed plants may exhibit a further increase in freezing tolerance of at least –2° C.

To test salinity tolerance of the transformed plants, plants were watered with 150 mM NaCl. Plants overexpressing CBF1, CBF2, or CBF3 grew better compared with plants that had not been transformed with CBF1, CBF2, or CBF3.

These results demonstrate that equivalogs of *Arabidopsis* transcription factors can be identified and shown to confer similar functions in non-*Arabidopsis* plant species.

Example XVI

Cloning of Transcription Factor Promoters

Promoters are isolated from transcription factor genes that have gene expression patterns useful for a range of applications, as determined by methods well known in the art (including transcript profile analysis with cDNA or oligonucleotide microarrays, Northern blot analysis, semi-quantitative or quantitative RT-PCR). Interesting gene expression profiles are revealed by determining transcript abundance for a selected transcription factor gene after exposure of plants to a range of different experimental conditions, and in a range of different tissue or organ types, or developmental stages. Experimental conditions to which plants are exposed for this purpose includes cold, heat, drought, osmotic challenge, varied hormone concentrations (ABA, GA, auxin, cytokinin, salicylic acid, brassinosteroid), pathogen and pest challenge. The tissue types and developmental stages include stem; root, flower, rosette leaves, cauline leaves, siliques, germinating seed, and meristematic tissue. The set of expression levels provides a pattern that is determined by the regulatory elements of the gene promoter.

Transcription factor promoters for the genes disclosed herein are obtained by cloning 1.5 kb to 2.0 kb of genomic sequence immediately upstream of the translation start codon for the coding sequence of the encoded transcription factor protein. This region includes the 5'-UTR of the transcription factor gene, which can comprise regulatory elements. The 1.5 kb to 2.0 kb region is cloned through PCR methods, using primers that include one in the 3' direction located at the translation start codon (including appropriate adaptor sequence), and one in the 5' direction located from 1.5 kb to 2.0 kb upstream of the translation start codon (including appropriate adaptor sequence). The desired fragments are PCR-amplified from *Arabidopsis* Col-0 genomic DNA using high-fidelity Taq DNA polymerase to minimize the incorporation of point mutation(s). The cloning primers incorporate two rare restriction sites, such as NotI and SfiI, found at low frequency throughout the *Arabidopsis* genome. Additional restriction sites are used in the instances where a NotI or SfiI restriction site is present within the promoter.

The 1.5-2.0 kb fragment upstream from the translation start codon, including the 5'-untranslated region of the transcription factor, is cloned in a binary transformation vector immediately upstream of a suitable reporter gene, or a transactivator gene that is capable of programming expression of a reporter gene in a second gene construct. Reporter genes used include green fluorescent protein (and related fluorescent protein color variants), beta-glucuronidase, and luciferase. Suitable transactivator genes include LexA-GAL4, along with a transactivatable reporter in a second binary plasmid (as disclosed in U.S. patent application Ser. No. 09/958,131, incorporated herein by reference). The binary plasmid(s) is transferred into Agrobacterium and the structure of the plasmid confirmed by PCR. These strains are introduced into *Arabidopsis* plants as described in other examples, and gene expression patterns determined according to standard methods know to one skilled in the art for monitoring GFP fluorescence, beta-glucuronidase activity, or luminescence.

Example XVII

Cloning and Transformation of MAF2 (SEQ ID NO: 567), MAF3 (SEQ ID NO: 943), MAF4 (SEQ ID NO: 945), and MAF5 (SEQ ID NO: 947) into *Arabidopsis* Plants Experiments were performed using *Arabidopsis* of ecotype Columbia (Col-0, Lot # 199-014; Lehle Seeds, Round Rock Tex.) except where otherwise indicated. Stockholm accession (CS6863) and Pitztal accession (CS6832) lines were supplied by the *Arabidopsis* Biological Resource Center (ABRC; Ohio State University, Columbus Ohio). The fca-9 allele was in a Columbia background (Page et al. (1999) *Plant J.* 17: 231-239). Transgenic 35S:FLC lines were generated as described by Ratcliffe et al. (2001) supra.

*Arabidopsis* plants were transformed by the floral dip method (Bechtold and Pelletier, 1998; Clough and Bent (1998) supra) using *Agrobacterium* carrying a standard transformation vector, pMEN20 or pMEN65 (Mendel Biotechnology, Inc., Hayward Calif.), which contained a kanamycin resistance selectable marker system driven by a nos promoter and MAF1-5 (SEQ ID NOs: 1734, 567, 943, 945, and 947, respectively) or FLC (SEQ ID NO: 1874) cDNA oriented 3' to a CaMV 35S promoter.

In all experiments, seeds were sterilized by a 2 minute EtOH treatment followed by 20 minutes in 30% bleach/ 0.01% Tween and five washes in distilled water. Seeds were sown to MS agar in 0.1% agarose and stratified for 3-5 days at 4° C., before transfer to growth rooms with a temperature of 20-25° C. MS media was supplemented with 50 mg/l kanamycin for selection of transformed plants. Plants were transplanted to soil after 8 days of growth on plates, when grown under continuous light, and after 10 days when grown under 8 or 12 hour photoperiods. For vernalization treatments, seeds were sown to MS agar plates, sealed with micropore tape, and placed in a 4° C. cold room with low light levels. The plates were then transferred to the growth rooms alongside plates containing freshly sown non-vernalized controls, which had received a short cold stratification of 3 days (to synchronize germination). Time to flowering was measured as days to flower a flower bud becoming visible and/or in terms of the total number of leaf nodes formed by the primary shoot meristem. Rosette leaves were counted when a visible inflorescence of approximately three centimeters was apparent.

cDNAs for each of the FLC/MAF1-like (MAF) sequences were identified either among clones in a library derived from leaf RNA, or by a combination of RACE and RT-PCR performed on RNA derived from mixed tissue samples of the Columbia accession. Alternative transcripts were detected for each of the four genes. All these MAF sequences are listed in Table 5B. At least four variants of At5g65050 (MAF2; SEQ ID NO: 567) were identified; variant V (SEQ ID NO: 1950) encodes a 171 amino acid protein (SEQ ID NO: 1951). Variants II and III (SEQ ID NOs: 1944 and 1946) differ in their 3' region but both generate a protein of 145 amino acids (SEQ ID NOs: 1945 and 1946), the last 20 residues of which are different from the 196 amino acid full-length version. Variant IV (SEQ ID NO: 1948) comprises a truncated form of variant I, and would give rise to a small polypeptide of 80 amino acids (SEQ ID NO: 1949).

At5g65060 (MAF3; SEQ ID NO: 943) and At5g65070 (MAF4; SEQ ID NO: 945) both displayed at least 5 variants. The longest MAF3 product, encoded by variant I (SEQ ID NO: 943), is 196 amino acids in length (SEQ ID NO: 944). MAF3 variants II and III (SEQ ID NOs: 1952 and 1954) encode 185 (SEQ ID NO: 1953) and 118 (SEQ ID NO: 1955) amino acid proteins respectively, whilst variants IV and V (SEQ ID NO: 1956 and 1958) both generate products of 77 amino acids in length (SEQ ID NOs: 1957 and 1959, but differ at in their 3' regions. The longest MAF4 clone identified, variant I (SEQ ID NO: 945) encodes a protein of 200 amino acids (SEQ ID NO: 946). MAF4 variant II (SEQ ID NO: 1960) encodes a 136 amino acid product (SEQ ID NO: 1961) whereas MAF4 variants III, IV, and V (SEQ ID NOs: 1962, 1964, and 1966) encode very short polypeptides of 63 (SEQ ID NO: 1963), 66 (SEQ ID NO: 1965), and 69 (SEQ ID NO: 1967) amino acids respectively.

Two alternative variants of At5g65080 (MAF5) (SEQ ID NO: 947) were identified (SEQ ID NOs: 947 and 1968) which encode polypeptides of 198 (SEQ ID NO: 948) and 184 (SEQ ID NO: 1969) amino acids, respectively. The significance of these alternative transcripts is unclear; alternative splicing for MAF1 has been described previously (Ratcliffe et al. (2001) supra; Scortecci et al. (2001) supra), whereas for FLC (SEQ ID NO: 1874), it has not been reported.

MAF2 variants II and III (SEQ ID NOs: 1944 and 1946) were randomly isolated from an in-house library derived from *Arabidopsis* leaf mRNA. All other MAF clones were isolated by RT-PCR on RNA extracted from whole vegetative Columbia seedlings. RNA was extracted from plant tissue using a CTAB based protocol (Jones et al. (1995) supra), poly(A)+ RNA was purified using oligo(dT)-cellulose (Life Technologies, Inc., Rockville Md.), and first stand cDNA synthesis was performed using a SUPERSCRIPT kit (Life Technologies).

To confirm the genes boundaries, 3' RACE was first performed using a SMART RACE cDNA Amplification kit (Clontech, Palo Alto Calif.) and two rounds of PCR (30 cycles and 25 cycles) were performed using the following gene specific primers:

MAF2:

first round,
AAGAAGCAAAAAACATTGTGGGTCTCCG,            (SEQ ID NO: 1974)

second round,
CGTCTCCGGCTCCGGAAAACTCTACAAG;            (SEQ ID NO: 1975)

MAF3:

first round,
CTGTTGTCGCCGTCTCCGGTTCCGGAAA,            (SEQ ID NO: 1976)

second round,
ACTCTACGACTCTGCCTCCGGTGACAA:             (SEQ ID NO: 1977)

MAF4:

first round,
ATCAAACGAATTGAGAACAAAAGCTCTC,            (SEQ ID NO: 1978)

second round,
CTTATCATCATCTCTGCCACCGGAAGAC;            (SEQ ID NO: 1979)

MAF5:

first round,
GGGGATTAGATGTGTCGGAAGAGTGAAG,            (SEQ ID NO: 1980)

second round,
AACTCTACAACTCCTCCTCCGGCGACAG;            (SEQ ID NO: 1981)

RACE products were then cloned to the pGEM-T Easy vector (Promega, Madison Wis.) and sequenced. Following RACE analysis, MAF cDNA clones were PCR-isolated from cDNA using the primers listed below, and then ligated into the transformation vector, following digestion with the restriction enzymes indicated below.

MAF2: (KpnI/NotI)                        (SEQ ID NO: 1982)

GAGGGGTACCACATTGTGGGTCTCCGGTGATTAGGATC and
                                         (SEQ ID NO: 1983)
GGGAAAGCGGCCGCAATCAGGCTGTAAGTTTAAGGTGAAAGC;

MAF3: (KpnI/NotI)                        (SEQ ID NO: 1984)

GAGGGGTACCAGAAAAAAAGCAAACACATTTTGGGTCC and
                                         (SEQ ID NO: 1985)
GGGAAAGCGGCCGCACAAGAACTCTGATATTTGTCTACTAAG;

MAF4: (SalI/NotI)                        (SEQ ID NO: 1986)

GCACGCGTCGACCAAATTAGGTCAGAAGAATTAGTCGGAG and
                                         (SEQ ID NO: 1987)
GGGAAAGCGGCCGCTCTCCTTGGATGACTTTTCCGTAGCAGG;

MAF5: (SalI/NotI)                        (SEQ ID NO: 1988)

GCACGCGTCGACGGGGATTAGATGTGTCGGAAGAGTGAAG and
                                         (SEQ ID NO: 1989)
GGGAAAGCGGCCGCGATCCTGTCTTCCAAGGTAACACAAAGG.

For semi-quantitative RT-PCR expression studies, the following primers were used:

FLC:

TTAGTATCTCCGGCGACTTGAACCCAAACC           (SEQ ID NO: 1990)

and

AGATTCTCAACAAGCTTCAACATGAGTTCG;          (SEQ ID NO: 1991)

MAF2:

ACATTGTGGGTCTCCGGTGATTAGGATC             (SEQ ID NO: 1992)

and

AATCAGGCTGTAAGTTTAAGGTGAAAGC;            (SEQ ID NO: 1993)

MAF3:

GAAGAAAAAAAGCAAACACATTTTGGGTCC           (SEQ ID NO: 1994)

and

AAGAACTCTGATATTTGTCTACTAAGGTAC;          (SEQ ID NO: 1995)

MAF4:

ATTAGGTCAGAAGAATTAGTCGGAGAAAAC           (SEQ ID NO: 1996)

and

CTTGGATGACTTTTCCGTAGCAGGGGAAG;           (SEQ ID NO: 1997)

MAF5:

GGGGATTAGATGTGTCGGAAGAGTGAAG             (SEQ ID NO: 1998)

and

GATCCTGTCTTCCAAGGTAACACAAAGG:            (SEQ ID NO: 1999)

Actin:

AGAGATTCAGATGCCCAGAAGTCTTGTTCC           (SEQ ID NO: 2000)

and

AACGATTCCTGGACCTGCCTCATCATACTC;          (SEQ ID NO: 2001)

SOC1:

GGCATACTAAGGATCGAGTCAGCACCAAAC           (SEQ ID NO: 2002)

and

ACCCAATGAACAATTGCGTCTCTACTTCAG.          (SEQ ID NO: 2003)

The T-DNA insertion event within MAF2 was initially detected in a pooled collection of approximately 3,000 lines, and then de-replicated to a single plant, by multiple rounds of PCR using the following pairs of T-DNA left border (LB) and gene specific (GS) primers:

First round (40 cycles):

LB,
CTCATCTAAGCCCCCATTTGGACGTGAATG           (SEQ ID NO: 2004)

and

GS,
CAGGCTGTAAGTTTAAGGTGAAAGCTCA.            (SEQ ID NO: 2005)

-continued
Second round (40 cycles):

LB nested,
TTGCTTTCGCCTATAAATACGACGGATCG (SEQ ID NO: 2006)

and

CS nested,
TGATGATGGTGATTACTTGAGCAGCGGA. (SEQ ID NO: 2007)

The insertion position was confirmed by sequencing of the PCR products. Homozygous plants for the MAF2 T-DNA insertion were then identified by the absence of a band following 40 cycles of PCR with the following pair of gene specific primers:

AAGACAGAACTAATGATGGGGAAGTGAAGTCC (SEQ ID NO: 2008)

and

TACGAAGGTACAATAAAGATCTACTATAGC (SEQ ID NO: 2009)

which resided on either side of the insertion locus.

Example XVIII

Examples of Genes that Confer Significant Improvements to Plants

Examples of genes and homologs that confer significant improvements to knockout or overexpressing plants are noted below. Experimental observations made by us with regard to specific genes whose expression has been modified in overexpressing or knock-out plants, and potential applications based on these observations, are also presented.

SEQ ID NOs: 567, 943, 945, 947, 1734, 1874, 1970, and 1972 (G859, G1842, G1843, G1844, G157, G1759, Soy 1, and Soy3, respectively) and the encoded polypeptides can be used to alter flowering time.

SEQ ID NO: 1944, SEQ ID NO: 1946, SEQ ID NO: 1948, SEQ ID NO: 1950, SEQ ID NO: 1952, SEQ ID NO: 1954, SEQ ID NO: 1956, SEQ ID NO: 1958, SEQ ID NO: 1960, SEQ ID NO: 1962, SEQ ID NO: 1964, SEQ ID NO: 1966, and SEQ ID NO: 1968, and the encoded polypeptides can be used to alter flowering time.

Differences in flowering time displayed by 35S::G859, 35S::G1842, 35S::G1843, 35S::G1844, 35S::G157, and 35S::G1759 transformants indicates that the gene or its homologs can be used to manipulate the flowering time of commercial species (see "Detailed description of genes, traits and utilities that affect plant characteristics; Flowering time: late flowering", above).

Example XIX

Identification of a T-DNA Insertion Mutant for MAF2 (SEQ ID NO: 567)

A single plant hemizygous for a T-DNA insertion within At5g65050 was identified by PCR screening of an in-house collection of random insertion lines. Sequencing from a primer matching the left T-DNA border revealed that the T-DNA resided within the predicted final intron of the gene (a position corresponding to nucleotide 3443 of At5g65050 (SEQ ID NO: 567), within the final intron of the putative full-length splice-variant). Self crossed seed were collected from the individual containing the insertion, and these progeny were examined in the next generation. The progeny plants were genotyped using PRC, and four out of twenty individual plants were identified as being homozygous for the T-DNA insertion. These four individual plants all showed visible flower buds at 13 days under continuous light conditions, at least two days earlier than any of the wild-type Columbia ecotype control plants, or any of their hemizygous or wild-type siblings growing in the same flat. Thus, it appeared that At5g65050 functioned as a repressor of the floral transition. At5g65050 was therefore designated as MAF2 (MADS AFFECTING FLOWERING 2; SEQ ID NO: 567). Homozygous seed was collected from the four individual early flowering plants. To examine the effects of the mutation on endogenous MAF2 expression, RNA was extracted from pooled 10-day-old seedlings in the next generation. Semi-quantitative RT-PCR was performed, using primers specific to MAF2; endogenous MAF2 transcripts in the maf2 seedlings were undetectable, but strong endogenous MAF2 expression was detected in the wild-type controls, demonstrating that MAF2 activity had been substantially reduced or eliminated in the maf2 mutant (see FIG. 10).

FIG. 10 shows the effect of vernalization on the maf2 mutant: (A) the maf2 mutant is marginally earlier flowering than wild type Columbia, in the absence of vernalization; plants are shown after 50 days growth under a 12-hour photoperiod; imbibed seeds were stratified for 3 days at 4° C. before transfer to the growth room; (B) the maf2 mutant is considerably earlier flowering than wild type Columbia following a short vernalization treatment; plants are shown after 45 days under a 12-hour photoperiod; imbibed seeds were cold treated for 15 days at 4° C. before transfer to the growth room; (C) the maf2 mutant responds prematurely to vernalization; chart in Table 15 depicts data from experiment 4; bars represent days to visible flower bud under a 12-hour photoperiod, following 4° C. cold-treatments of 3, 6, 10, 15, 21, and 85 days on imbibed seeds; error bars indicate standard errors to which 95% confidence limits have been attached; note that a 10-day cold treatment significantly reduced time to flowering in the maf2 mutant, but not in wild type Columbia ecotype; (D) expression of FLC, MAF2 and SOC1 in maf2 and wild type Columbia seedlings following cold treatments of 3, 6, 10, 15, 21, and 85 days on imbibed seeds; RNA was extracted from pools of ten whole seedlings after 10 days growth under 12-hour light, and expression monitored by reverse transcriptase PCR (FLC, 30 cycles; MAF2, 35 cycles; SOC1, 30 cycles; actin, 25 cycles). The 'forward slash' symbol (/) in FIG. 10 identifies a water control; the premature vernalization response of maf2 seen in (C) does not appear to be correlated with a premature decline in FLC levels, or a premature increase of SOC1; note that MAF2 transcript is absent from the maf2 seedlings, but is present at a constant level between the 3, 6, 10, 15, and 21-day time points in wild type, then declines by the 85 day sample; note that the MAF2 product is a doublet corresponding to splice-variants II and I.

Example XX

MAF2 Functions as a Floral Repressor that Prevents Vernalization in Response to Short Cold Periods Populations of homozygous maf2 and wild-type plants were grown under continuous light, a 12-hour photoperiod, and an 8-hour photoperiod. In each case, the maf2 plants on average flowered slightly earlier than the controls in terms of both days to visible flower buds and total leaf number (see experiment 1, Table 15). Thus, MAF2 acts as a floral repressor, but appears to play a relatively minor role in determining flowering time under the conditions of these experiments.

Null mutants for flc show a very much weaker response to vernalization than wild type (Michaels and Amasino (2001) supra). However, the fact that flc mutants can exhibit a vernalization response demonstrates that other factors must contribute to maintenance of a vernalization requirement. To test whether MAF2 could be one of those factors, batches of germinating wild type and maf2 seedlings were subjected to an extensive cold treatment of 52 days. The seedlings were then grown alongside non-vernalized controls under a 12-hour photoperiod (see experiment 2, Table 15). In this experiment, non-vernalized maf2 plants produced flower buds around 6 days sooner than non-vernalized wild type, confirming our earlier observations. However, maf2 seedlings showed a similar response to wild type. Vernalization of maf2 seedlings reduced the time to bud emergence by 31% and the total leaf number by 47% (with respect to non-vernalized maf2 plants). By comparison, in the wild-type seedlings, vernalization produced a 34% (time to bud emergence) and a 53% (total leaf number) reduction, respectively. The vernalization response of the maf2 mutant contrasts with the weaker response described for flc mutants (Michaels and Amasino (2001) supra). Thus, although MAF2 acts as a floral repressor, either it does not directly maintain a vernalization requirement in the same manner as FLC, or has a more minor role in the maintenance of a vernalization requirement.

An additional experiment was performed in which batches of maf2 and wild-type seedlings were subjected to a cold treatment for a period of only 10 days. Following this treatment, the maf2 population flowered proportionally much earlier than in any of our previous experiments (see experiment 3, Table 15), with a mean total leaf number of 111.1+/−0.7 versus 19.0+/−0.8 in wild-type. To confirm this result, batches of maf2 and wild type plants were given a range of different cold-treatments: 3, 6, 10, 15, 21, and 85 days (see FIG. 10 and Experiment 4, Table 15). maf2 plants given intermediate cold-periods of 10, 15, 21 days (which time is not sufficiently long to elicit a full vernalization in the wild-type) showed a strong response and flowered disproportionately early. Thus, a specific role of MAF2 appeared to be the repression of premature vernalization in response to brief cold spells.

To test whether the observed acceleration of flowering in the maf2 mutant was accompanied by a decline in FLC levels RNA was extracted from whole seedlings at 10 days following the cold treatments. RT-PCR experiments showed that FLC levels declined progressively in relation to the duration of the cold treatment (see FIG. 10) and which confirmed the results of Sheldon et al. ((2000) supra). However, for each of the time-points there were no clear discernible differences in FLC levels between maf2 and the wild-type controls (see FIG. 10). Thus, the premature vernalization response in the maf2 seedlings was apparently induced independently of changes in FLC transcription.

In both the maf2 and the wild-type samples, it was observed that by 10 day cold time-point, FLC levels had already fallen very substantially when compared to the 3 and 6 day time points (see FIG. 10D). However, despite this decline in FLC levels, there was very little difference in the flowering time of wild-type plants that had received 10, 15, or 21 days of cold compared to those that had been given 6 days of cold. A very marked reduction in flowering time was seen only in the wild type plants that had been given the extensive 85 day cold treatment. By contrast, in the maf2 mutant, a 10-day cold treatment substantially accelerated flowering, and a 21-day cold treatment produced an equivalent effect to that caused by an 85 days of cold treatment. RT-PCR with MAF2 specific primers was then performed. MAF2 transcript was absent from the maf2 mutant. However, in contrast to FLC, MAF2 levels in the wild type were identical between the 3, 6, 10, 15, and 21-day time points. However, MAF2 expression had declined in the 85 day cold treatment sample, for which a pronounced reduction in flowering time was observed. These data suggested that MAF2 expression compensated for the apparent decline in FLC levels caused by the 10, 15, or 21 day cold treatments, and thereby have maintained flowering at the same time as for the 6 day cold treatment in wild type.

Example XXI

Overexpression of MAF2, MAF3, MAF4, or MAF5, Modifies Flowering Time

To further investigate the role of MAF2 as a floral repressor, and determine whether At5g65060, At5g65070, and At5g65080 could also affect flowering time, transgenic Arabidopsis lines containing the full-length cDNA of each of the genes expressed from the 35SCaMV promoter were analyzed.

Overexpression lines for each of the FLCIMAF1 paralogs (At5g65060, At5g65070, and At5g65080) displayed various alterations in the timing of flowering compared to wild-type control plants (see Tables 16 and 17). Flowering time was monitored in primary transformants and/or in a number of independent lines in the second generation, and the results are described in detail below. Accordingly, the At5g65060, At5g65070, and At5g65080 loci were designated as MADS AFFECTING FLOWERING 3, 4, and 5 (MAF3, (SEQ ID NO: 943); MAF4, (SEQ ID NO: 945); and MAF5, (SEQ ID NO: 947)), respectively.

Example XXII

Overexpression of MAF2 (SEQ ID NO: 567) Produces Similar Phenotypes to Overexpression of FLC or MAF1 in the Columbia and Stockholm backgrounds Two separate batches of primary 35S:MAF2 primary transformants in the Columbia ecotype were examined under conditions of continuous light. In the two experiments, approximately half of lines flowered early, displaying visible flower buds around a week earlier, and producing significantly fewer leaves than control plants lacking the transgene (see Table 16). In batch 1 (see experiment 5) 3 of 20 T1 plants flowered within the wild-type range; in batch 2 (see experiment 6) 10 of 19 Ti plants flowered within the wild-type range. However, in both sets of plants, a small proportion of the lines flowered distinctly later than wild type.

The progeny of two late flowering 35S:MAF2 lines and two early flowering 35S:MAF2 Columbia lines were examined in the T2 generation (see experiment 8, Table 17). All individuals from the two late lines (line T2-16 and line T2-24) also flowered markedly later than wild-type controls in the T2 generation, under conditions of either 24 or 12 hours light. In contrast, the phenotype of the early flowering lines was less consistent between generations. Under continuous light conditions, no significant difference in flowering time was observed in terms of either days to visible flower bud, or total leaf number. Under the less inductive conditions of 12 hours light, however, a very marginal acceleration of flowering was noted. Thus, the most consistent effect of MAF2 overexpression, between generations, was a delay in flowering, even though the majority of lines were early flowering as primary transformants. Semi-quantitative RT-PCR studies performed on rosette leaves from the T1 plants revealed that the late flowering lines had higher levels of MAF2 overexpression than the early flowering lines.

The effects of MAF2 (SEQ ID NO: 567) overexpression were also tested using the late flowering Stockholm accession (which has significantly higher levels of FLC than Columbia accession, Sheldon et al. (1999) supra; Michaels and Amasino (1999) supra; Ratcliffe et al. (2001) supra). Similar data were obtained to those from the Columbia accession were obtained with the Stockholm lines: 6 of 13 lines flowered early, 6 of 13 lines flowered within the wild-type range, and a single line flowered 2-3 weeks late (see experiment 7, Table 16). Therefore, the effects of MAF2 overexpression were the same irrespective of FLC levels, with a substantial number of lines flowering early and a minority of lines flowering late.

The MAF2 overexpression data paralleled those that had been described for FLC or MAF1. Although FLC and MAF1 had been established to be repressors of flowering (Sheldon et al. (1999) supra; Michaels and Amasino (1999) supra; Ratcliffe et al. (2001) supra; Scortecci et al. (2001) supra), FLC and MAF1 induce flowering in a high proportion of lines, when overexpressed in accessions other than Landsberg. In the Landsberg accession, FLC or MAF1 overexpression produced late flowering, but no early flowering lines were noted (Michaels and Amasino (1999) supra; Ratcliffe et al. (2001) supra; Scortecci et al. (2001) supra). Comparable data were acquired when the 35S:MAF2 construct was transformed into the Landsberg accession; only late flowering lines were obtained (see experiment 11, Table 12). The MAF2 overexpression data, combined with the acceleration of flowering observed in the maf2 mutant, indicated that MAF2 is a repressor of flowering.

Example XXIII

MAF2 (SEQ ID NO: 567) Prevents Vernalization Independently of FLC Transcription, but Represses SOC1 Expression To examine whether MAF2 (SEQ ID NO: 567) could delay or prevent vernalization, 35S:MAF2 seedlings were tested to evaluate the response to extensive cold treatments (see FIG. 16 and Table 17, experiments 9 and 10). Two separate studies were performed; in the first instance, batches of 35S:MAF2 (T2 from the late flowering line 16; T1-16) and wild-type germinating seedlings were placed in a cold room at 4° C. for a period of 76 days, and then transferred to a growth room (12-hour photoperiod, 20-25° C.) alongside a freshly sown non-treated batch. In the repeat experiment, seedlings were cold-treated for 56 days and then transferred to a second growth room (24 hours light, 20-25° C.). In both experiments, 35S:MAF2 plants were completely unresponsive to the cold treatment and flowered as late as the non-vernalized specimens grown alongside. The wild-type control plants (and wild-type segregants from the 35S:MAF2 population) verified the effectiveness of the vernalization treatment; in both the experiments cold-treated wild-type plants flowered significantly earlier than non-treated individuals.

To determine if this absence of a vernalization response was due to MAF2 preventing a fall in FLC transcript levels following cold-treatments, RT-PCR experiments were performed on cold treated and non-treated 35S:MAF2 seedlings that had been harvested at 8 days following transfer into the growth room. Although the cold-treated 35S:MAF2 seedlings were as late flowering as their non-treated siblings, FLC transcript abundance was greatly reduced to levels similar to those found in vernalized wild-type plants (see FIG. 11).

FIG. 11 shows the effects of MAF2 (SEQ ID NO: 567) overexpression in the Columbia accession.

FIG. 11A shows that 35S:MAF2 plants were late flowering and did not respond to vernalization. Plants are shown after approximately 50 days under a 12-hour photoperiod, following a 10 week 4° C. cold-treatment on the imbibed seeds. FIG. 11B shows expression of FLC, MAF2, and SOC1 in wild type Columbia, 35S:MAF2, and 35S:FLC seedlings. RNA was extracted from pools of ten whole seedlings after 10 days growth under 12-hour light, following either a 3-day cold stratification (-, non-vernalized) or a 76-day vernalization treatment (+, vernalized). Expression was monitored by RT-PCR (25 cycles). Note that no significant changes in FLC levels are apparent in the 35S:MAF2 samples relative to the wild-type control, and the SOC1 levels are repressed in the 35S:MAF2 plants in a comparable manner to the 35S:FLC samples.

Levels of FLC transcript in the non-vernalized 35S:MAF2 plants were also much lower than in 35S:FLC controls. Thus, although MAF2 is capable of preventing a premature vernalization response, it cannot inhibit the eventual depletion of FLC transcript by long cold-treatments. Furthermore, the fact that cold-treated 35S:MAF2 plants were late flowering, despite containing undetectable levels of FLC, indicated that MAF2 could repress flowering via pathways independent or downstream of FLC.

A major target of repression by FLC is the MADS-box gene SOC1 (Michaels and Amasino (2001) supra). To test whether the mechanism by which MAF2 (SEQ ID NOs: 567 and 568) can also influence downstream targets of the FLC repression pathway, SOC1 expression levels were examined in the 35S:MAF2 seedlings (see FIG. 11). SOC1 expression levels were extremely low, compared to wild type Columbia plants, in both vernalized and non-vernalized 35S:MAF2 plants. Thus, MAF2 overexpression was sufficient to maintain repression of SOC1, even when repression by FLC had been reduced via extensive cold treatments.

Example XXIV

Effects of MAF3 (SEQ ID NO: 943), MAF4 (SEQ ID NO: 945), and MAF5 (SEQ ID NO: 947) Overexpression Given that MAF2 (like FLC and MAF1) acts as a repressor of flowering, the remaining three MAF transcription factors, MAF3 (SEQ ID NO: 943), MAF4 (SEQ ID NO: 945), and MAF5 (SEQ ID NO: 947) were tested to identify if there were similar repression effects on flowering time when overexpressed in a transgenic plant.

1. Overexpression of the MAF3 (SEQ ID NO: 943) Accelerates Flowering in the Columbia and Stockholm, but Delays Flowering in the Landsberg Ecotype In the case of MAF3, Columbia lines overexpressing MAF3 (SEQ ID NO: 943) displayed accelerated flowering. In two separate experiments, fourteen out of a total of eighteen 35S:MAF3 primary transformants (Columbia accession) displayed flower buds several earlier than wild-type plants under continuous light conditions (see experiments 5 and 6, Table 16). In contrast, no late flowering MAF3 overexpression lines were obtained in the Columbia accession, and the remaining transformants flowered at a wild-type time. The progeny of three early flowering MAF3 overexpression lines were also examined and these also flowered sooner than wild-type controls in the T2 generation (see experiment 8, Table 17). Comparable results were obtained upon overexpression of MAF3 in the Stockholm accession (see experiment 7, Table 16). Ten out of 20 lines (all primary transformants) flowered earlier than controls. Of the remaining lines, seven flowered at a wild-type time and three lines were scored as flowering marginally late. However, this delay was not significantly different from wild type in terms of total leaf number. Given that no substantially late flowering overexpression lines were obtained in Columbia or Stockholm, MAF3 was observed to have contrasting effects to FLC, MAF1, and MAF2. Nevertheless, a number of 35S:MAF3 Landsberg accession lines were clearly late flowering, particularly under non-inductive photoperiodic conditions of 12-hour light (see experiment 11, Table 17). Thus, either overexpression levels of MAF3 in the Columbia and Stockholm accession lines were not sufficiently high enough to cause severe repression, or MAF3 or MAF3 protein requires a partner to act as a repressor in those accessions, but alone is sufficient to act as a repressor in Landsberg accession.

2. Overexpression of MAF4 (SEQ ID NO: 945) Modifies Flowering Time but Produces Deleterious Effects on Growth and Development For unknown reasons, transcriptional overexpression of the third gene in the *Arabidopsis* chromosomal cluster, MAF4 (SEQ ID NO: 945), produced many pleiotropic effects on growth and development. 35S:MAF4 lines were often very small, stunted, displayed a slow growth rate, and formed poorly developed inflorescences that set relatively few seeds. Additionally, some lines exhibited premature senescence of rosette leaves, whilst others arrested growth during the seedling stage and senesced without flowering. Despite these deleterious effects however, alterations in flowering time could still be observed. As described above, approximately half of the MAF3 Columbia overexpression lines flowered earlier than controls (see experiments 5 and 6, Table 16). In contrast, a single 35S:MAF4 Columbia T1 plant was late flowering. A number of late flowering lines were also obtained in the Stockholm and Landsberg accessions, showing that the gene can repress flowering (see experiment 7, Table 16, and experiment 11, Table 17, respectively).

3. Effects of MAF5 (SEQ ID NO: 947) Overexpression

Overexpression of the fourth gene in the *Arabidopsis* chromosomal cluster, MAF5 (SEQ ID NO: 947), produced somewhat inconsistent effects on flowering time (see Tables 16 and 17). In a first study (see experiment 5, Table 16), five of ten 35S:MAF5 Columbia transformants flowered significantly earlier than wild-type controls, whereas the remainder flowered at a wild-type time. In a second study (see experiment 6, Table 16), in which a larger number of lines were examined, only three of nineteen lines flowered early. Fifteen of the remaining lines showed a wild-type flowering time whilst a single plant flowered slightly late, making a slightly larger number of leaves than controls, but displaying flower buds at the same date. The progeny of three early flowering 35S:MAF5 lines were examined in the T2 generation in both continuous light and a 12 hour photoperiod, but neither showed a consistent difference in flowering time from wild-type (see experiment 8, Table 17). Thus, although MAF5 appeared to promote flowering in Columbia accession, such effects varied between experiments, generations and genetic backgrounds suggesting that this result was conditional on unresolved variables.

The 35S:MAF5 transgene was also introduced into Stockholm accession (see experiment 7, Table 16). In this experiment, all except two of the lines flowered within the wild-type range. The remaining two lines were observed to flower marginally later than wild type (either a leaf or a day later). As with MAF2-4, delayed flowering occurred when MAF5 was overexpressed in Landsberg accession, however such effects were much less marked than for MAF2-4. Thus, although the Landsberg results indicated that MAF5 could delay flowering, the floral repression activity of MAF5 appeared less extreme than for MAF2, MAF3 and MAF4.

Example XXV

Endogenous Expression of MAF3 (SEQ ID NO: 943) and MAF4 (SEQ ID NO: 945) Repressed by Vernalization; Endogenous Expression of MAF5 (SEQ ID NO: 947) Up-regulated by Vernalization The mutant analysis of maf2 along with the overexpression studies on MAF2-5 (SEQ ID NOs: 567, 943, 945, and 947, respectively) demonstrated that each of the genes could influence flowering time, and that MAF2 (SEQ ID NO: 567) prevents premature vernalization. Using RT-PCR analysis, it was observed that all of these genes were expressed across a wide range of tissue types (data not shown) similarly to that which had been described for FLC and MAF1 (Sheldon et al. (1999) supra; Michaels and Amasino (1999) supra; Alvarez-Buylla (2000b) Plant J. 24: 457-466; Ratcliffe et al. (2001) supra; Scortecci et al. (2001) supra). A key feature of the mechanism by which FLC acts is that FLC transcript and protein levels decrease in response to long cold treatments of 4-6 weeks, thereby allowing the floral transition to occur (Sheldon et al. (1999) supra; Michaels and Amasino (1999) supra; Sheldon et al. (2000) supra; Rouse et al. (2002) supra). The expression levels of MAF1 are also affected by vernalization in certain genetic backgrounds (Ratcliffe et al. (2001) supra).

To examine whether expression levels of endogenous MAF2-5 (SEQ ID NOs: 567, 943, 945, and 947, respectively) were also influenced by vernalization, expression of each of the genes were compared between vernalized and non-vernalized seedlings by RT-PCR using gene specific primers (see FIG. 8). FIG. 8 shows the effects of vernalization on expression of MAF2-5 (SEQ ID NOs: 567, 943, 945, and 947, respectively) in different genetic (accession) backgrounds.

RNA was extracted from pools of 10-20, 8-day old seedlings grown under continuous light conditions. Expression was monitored by RT-PCR (MAF1-5 (SEQ ID NOs: 9, 567, 943, 945, and 947, respectively), and FLC (SEQ ID NO: 1874), 30 cycles; actin, 25 cycles). Vernalized (+)

samples were cold-treated for 6 weeks at 4° C., whereas non-vernalized (−) samples were stratified for only 3 days at 4° C. as imbibed seeds. Col=Columbia, Pi-0=Pitztal, St-0=Stockholm, fca=fca-9 mutant. Note that FLC levels are lower in vernalized than non-vernalized samples, confirming the efficacy of the treatment. MAF2 (SEQ ID NO: 567) levels are similar between vernalized and non-vernalized seedlings from all backgrounds. MAF3 (SEQ ID NO: 943) and MAF4 (SEQ ID NO: 945) transcript levels are lower in vernalized compared to non-vernalized samples for each of the different backgrounds. MAF5 (SEQ ID NO: 947) transcript levels, in contrast to MAF1-5 and FLC, were elevated in vernalized compared to non-vernalized samples for each of the different backgrounds.

Germinating seeds from a number of genetic backgrounds were vernalized in a cold room for a period of 6 weeks and then transferred to a growth chamber along with freshly sown non-vernalized controls. After 8 days in continuous light conditions, whole seedlings were harvested and RNA was extracted. FLC transcript levels were substantially higher in non-vernalized versus vernalized seedlings, in all of the backgrounds, confirming the efficacy of the treatment. In this experiment, MAF2 (SEQ ID NO: 567) transcripts displayed no clear consistent differences in expression level between non-vernalized plants and those given a 6 week cold treatment. However, in other experiments, MAF2 transcript levels were eventually reduced following excessively long cold treatments, of up to 10-12 weeks (see FIGS. 10 and 11). Both MAF3 (SEQ ID NO: 943) and MAF4 (SEQ ID NO: 945) appeared responsive to a 6-week vernalization, and their expression paralleled that of FLC; transcript levels of MAF3 and MAF4 appeared somewhat elevated in fca and Stockholm compared to Columbia seedlings; in all backgrounds, transcript levels were markedly lower in vernalized compared to non-vernalized samples.

MAF5 (SEQ ID NO: 947) showed an opposite endogenous expression pattern compared with FLC. In all of the genetic backgrounds, endogenous MAF5 transcript levels were low in non-vernalized samples and became elevated in seedlings that had been vernalized. Thus, although the MAF2-5 genes are arranged in a very tight cluster on the *Arabidopsis* chromosome, their expression appears to be under distinct modes of transcriptional regulation, yet remain involved in the plant's response to cold treatment.

FIG. 9 is a schematic diagram summarizing the observed responses of FLC and MAF1-5 (SEQ ID NOs: 1874, 1734, 567, 943, 945, and 947, respectively) to vernalization and their potential effects on the floral transition. Arrows indicate positive interactions, blunt-ended lines denote inhibition.

Example XXVI

Identification of Homologous Sequences

This example describes identification of genes that are orthologous to *Arabidopsis thaliana* MAF transcription factors from a computer homology search.

Homologous sequences, including those of paralogs and orthologs from *Arabidopsis* and other plant species, were identified using database sequence search tools, such as the Basic Local Alignment Search Tool (BLAST) (Altschul et al. (1990) *J. Mol. Biol.* 215:403-410; Altschul et al. (1997) *Nucleic Acid Res.* 25: 3389-3402). The tblastx sequence analysis programs were employed using the BLOSUM-62 scoring matrix (Henikoff and Henikoff (1992) *Proc. Natl. Acad. Sci.* 89: 10915-10919). The entire NCBI GenBank database was filtered for sequences from all plants except *Arabidopsis thaliana* by selecting all entries in the NCBI GenBank database associated with NCBI taxonomic ID 33090 (Viridiplantae; all plants) and excluding entries associated with taxonomic ID 3701 (*Arabidopsis thaliana*).

These sequences were compared to sequences representing genes of SEQ IDs NOs: 568, 944, 946, 948, 1735, 1875, 1971, and 1973, using the Washington University TBLASTX algorithm (version 2.0a19 MP) at the default settings using gapped alignments with the filter "off". For each gene of SEQ IDs NOs: 568, 944, 946, 948, 1735, and 1875, individual comparisons were ordered by probability score (Pvalue), where the score reflects the probability that a particular alignment occurred by chance. For example, a score of 3.6e-40 is $3.6\times10\text{-}40$. In addition to P-values, comparisons were also scored by percentage identity. Percentage identity reflects the degree to which two segments of DNA or protein are identical over a particular length. Examples of sequences so identified are presented in Table 7 and Table 9. Paralogous or orthologous sequences were readily identified and available in GenBank by Accession number (Table 7; Test sequence ID). The percent sequence identity among these sequences can be as low as 47%, or even lower sequence identity.

In addition, the sequences representing genes of SEQ IDs NOs: 568, 944, 946, 948, 1735, and 1875, were compared using the Washington University TBLASTX algorithm, as described above, to sequences in a proprietary database comprising polynucleotide sequences isolated from soy. In this manner, SEQ ID NOs: 1014, 1971, and 1973 from soy were identified as putative orthologs and the soy sequences were then compared as queries with a proprietary *Arabidopsis* transcription factor database using the Washington University TBLASTX algorithm, as described above (reciprocal BLAST). In each case, the subject sequence with the highest probability score was one of SEQ IDs NOs: 568, 944, 946, 948, 1735, and 1875, thereby confirming that SEQ ID NOs: 1014, 1971, and 1973 are, more likely than not, soy MAF transcription factor orthologs of the *Arabidopsis* MAF transcription factors.

Candidate paralogous sequences were identified among *Arabidopsis* MAF transcription factors through alignment, identity, and phylogenic relationships. A list of paralogs is shown in Table 9. Candidate orthologous sequences were identified from proprietary unigene sets of plant gene sequences in *Zea mays*, *Glycine max*, and *Oryza sativa* based on significant homology to *Arabidopsis* MAF transcription factors. These candidates were reciprocally compared to the set of *Arabidopsis* MAF transcription factors. If the candidate showed maximal similarity in the protein domain to the eliciting MAF transcription factor or to a paralog of the eliciting MAF transcription factor, then it was considered to be an ortholog. Identified non-*Arabidopsis* sequences that were shown in this manner to be orthologous to the *Arabidopsis* sequences are provided in Table 7.

Example XXVII

Introduction of MAF Polynucleotides into Dicotyledonous Plants

SEQ ID NO: 567, SEQ ID NO: 943, SEQ ID NO: 945, SEQ ID NO: 947, SEQ ID NO: 1734, SEQ ID NO: 1874, SEQ ID NO: 1014, SEQ ID NO: 1970, SEQ ID NO: 1972, SEQ ID NO: 1944, SEQ ID NO: 1946, SEQ ID NO: 1948, SEQ ID NO: 1950, SEQ ID NO: 1952, SEQ ID NO: 1954, SEQ ID NO: 1956, SEQ ID NO: 1958, SEQ ID NO: 1960, SEQ ID NO: 1962, SEQ ID NO: 1964, SEQ ID NO: 1966,

SEQ ID NO: 1968, SEQ ID NO: 1970, SEQ ID NO: 172, paralogous, orthologous, and homologous sequences recombined into pMEN20 or pMEN65 expression vectors are transformed into a plant for the purpose of modifying plant traits. The cloning vector may be introduced into a variety of cereal plants by means well-known in the art such as, for example, direct DNA transfer or *Agrobacterium tumefaciens*-mediated transformation. It is now routine to produce transgenic plants using most dicot plants (see Weissbach and Weissbach (1989) supra; Gelvin et al. (1990) supra; Herrera-Estrella et al. (1983) supra; Bevan (1984) supra; and Klee (1985) supra). Methods for analysis of traits are routine in the art and examples are disclosed above.

All references, publications, patent documents, web pages, and other documents cited or mentioned herein are hereby incorporated by reference in their entirety for all purposes. Although the invention has been described with reference to specific embodiments and examples, it should be understood that one of ordinary skill can make various modifications without departing from the spirit of the invention. The scope of the invention is not limited to the specific embodiments and examples provided.

SEQUENCE LISTING (2011 sequences)

SEQ ID NO: 1 - DNA, 759 bp, Arabidopsis thaliana
  G3
gtttgtcttttatcaatggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatagtcaatttatatacatgtagtttgttttgtttgattagaagattacatttacatacaagatacacatagatactggaaaatataggtatgtatacattcataaattatcttatgtatcaaagaattttatagattctgattagctttttgtttttgtttttgataagaactctgattagttgtccggagacaaaaccggctaagagcaatccatgagaagctagcgagtgttttttagttcaagttgtaatataaatgcatattaattctttagtaattttgt

SEQ ID NO: 2 - protein, 153 aa, Arabidopsis thaliana
  G3
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 3 - DNA, 1577 bp, Arabidopsis thaliana
  G4
aaagaatcgaatatttattatttcgccccgaagattctatttctgatcatttacacccctaaaaagagtagagctttcgtgaagccaccatgtgtggaggagctataatctccgatttcatacctccgccgaggtccctccgcgtcactaacgagtttatctggccggatctgaaaaacaaagtgaaagcttcaaagaagagatcgaataagcgatccgatttcttcgatcttgacgatgatttcgaagctgatttccaagggtttaaggatgactcggcttttgactgcgaagacgatgatgatgtcttcgtcaatgttaagcctttcgtcttcaccgcaactactaagcccgtagcttccgctttcgtctccactgtaggttcagcatatgccaagaaaactgtagagtccgctgagcaagctgagaaatcttctaagaggaagaggaagaatcaataccgagggattaggcagcgtccttggggaaaatgggctgcggagatccgtgatccgagaaaaggctcccgagaatggcttggaacattcgacactgctgaggaagcagcaagagcttatgatgctgcagcacgcagaatccgtggcacgaaagctaaggtgaattttcccgaggagaagaaccctagcgtcgtatcccagaaacgtcctagtgctaagactaataatcttcagaaatcagtggctaaaccaaacaaaagcgtaactttggttcagcagccaacacatctgagtcagcagtactgcaacaactcctttgacaactcttttggtgatatgagtttcatggaagagaagcctcagatgtacaacaatcagtttgggttaacaaactcgttcgatgctggaggtaacaatggataccagtatttcagttccgatcagggcagtaactccttcgactgttctgagttcgggtggagtgatcacggccctaaaacacccgagatctcttcaatgcttgtcaataacaacgaagcatcatttgttgaagaaaccaatgcagccaagaagctcaaaccaaactctgatgagtcagacgatctgatggcataccttgacaacgccttgtgggacaccccactagaagtggaagccatgcttggcgcagatgctggtgctgtgactcaggaagaggaaaacccagtggagctatggagcttagatgagatcaatttcatgctggaaggagacttttgaagtgatcgatggttccttagtttgtaaataaagctgtgttggattttgctgttgggggatggtacaagtcacacctcaagctctatgcattggtatctcatgagccttctcttccatagagagtttctcttttaattttgtcgaaataaaaaaggtgtgatgaagtaaatagaggtataataatatctatctattaagtcttgttttgttctttcatttttgtatttcttttctatttaaaagacagtttattagtcttctgagctctctttttgatctttgttatagcgtatcatcaccctcgaaagtgtaatgttttgtacccccaaacttgtttagcattataataaagtctctttg

SEQ ID NO: 4 - protein, 375 aa, Arabidopsis thaliana
  G4
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVEAMLGADAGAVTQEEENPVELWSLDEINFMLEGDF

SEQ ID NO: 5 - DNA, 1699 bp, Arabidopsis thaliana
  G5
ttttttttttgcaatctccccctaatctgttgtttctcgcttcttcttctgttaatcatctgtctttcaaaaagaaagaaaaaagaaaaattcgatttctgggtttgtttttgtcatacagaaaaaaatcaagcttatgaatttgtgtttaattttttgttttaatttgaaaggcaggttttttcagaacgagatcgttttttcaaatttcttctgattttacctctttttttcttcttagattttagtgaatcgagggtgaaatttttgattccctcttttcggatctacacagaggttgcttatttcaaaccttttagatccatttttttttaattttctcggaaaaatccctgtttctttacttttttataagtctcaggttcaattttttcggattcaaatttttattttaaatggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatttcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttaggggcaaaataggaaattcagccgcttgcaatggagtttttgtgaaattgcatgactggcccaagagtaattaattaaatatggattagtgttaaatttcgtatgttaatatttgtattatggtttgtattagtctctctgtgtcggtccagcttgcggttttttgtcaggctcgaccatgccacagttttcattttatgtaatctttttttcttttgtcttatgtaatttgtagcttcagtttcttcatctataatgcaattttattatgattatgtg

SEQ ID NO: 6 - protein, 334 aa, Arabidopsis thaliana
  G5
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGFHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 7 - DNA, 1023 bp, Arabidopsis thaliana
  G6
tatctatccgagaatggccaagatgggcttgaaacccgacccggctactactaaccagacccacaataatgccaaggagattcgttacagaggcgttaggaagcgtccttggggccgttatgccgccgagatccgagatccgggcaagaaaacccgcgtctggcttggcactttcgatacggctgaagaggcggcgcgtgcttacgatacggcggcgcgtgattttcgtggtgctaaggctaagaccaatttcccaacttttctcgagctgagtgaccagaaggtccctaccggtttcgcgcgtagccctagccagagcagcacgctcgactgtgcttctcctccgacgttagttgtgccttcagcgacggctgggaatgttcccccgcagctcgagcttagtctcggcggaggaggcggcggctcgtgttatcagatcccgatgtcgcgtcctgtctactttttggacctgatggggatcggtaacgtaggtcgtggtcagcctcctcctgtgacatcggcgtttagatcgccggtggtgcatgttgcgacgaagatggcttgtggtgcccaaagcgactctgattcgtcatcggtcgttgatttcgaaggtgggatggagaagagatctcagctgttagatctagatcttaatttgcctcctccatcggaacaggcctgagcttttaacggtgtcgtttcaattcgaagcgcatgcgtttcttcttctttttgagctgtgaaaattcgttttctcatagtttttcctctctctctctctcagtctaaatttattaccagtttttagaaagaaaaaacagattaaatctgagagagaaaaatataattttagctgacatggatcgttatgtacatattattacataaccggagatctgaacttttgttgtgtgcttttaattttttgcgacttggtttcaccccatgttgtttctctattttttttactactttttttttttttgttcttccaaattttcaatcaataatttggtaatcttc

SEQ ID NO: 8 - protein, 222 aa, Arabidopsis thaliana
  G6
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQLLDLDLNLPPPSEQA

SEQ ID NO: 9 - DNA, 859 bp, Arabidopsis thaliana
  G7
gtgactctaacgaagaaaccggcaatggccagtatcactacaatgccgaagaaataacaagaatcataaacgagccagaatattatcccccgggttacaacttgtctaccaccgcaatttcaaacatggtgtctatgctgactaatgttgtctctggtgagaccgaaccctcggcatctgcgacatggacgatgggtcataagagagaaagagaagagttttctttgcctcctcaaccattgattaccggttcagctgtgactaaagaatgtgaaagctcaatgtccttggagaggccaaaaaaatatagaggagtaaggcaacgaccatggggaaaatgggcggcggagattcgagacccacacaaggcgacacgtgtatggcttgggacattcgagacagccgaggccgccgcaagagcctatgatgcggcagcacttcgctttagaggaagcaaagcaaagcttaatttccccgaaaatgttggaactcagacgattcaacgaaattctcatttcttgcaaaactcaatgcaaccttctctaacatacatcgatcaatgtccaactctattatcttactctcgatgtatggagcaacaacaaccattagtaggcatgttgcagccaacagaagaggaaaatcactttttcgaaaaaccatggaccgaatatgatcaatacaattactcctcttttggttaactaacatatcgtcaacgctttgtatttctacttattcgatctaccaattttttctctcccaatacaacttcagtctgattattgccttcttagatatgtcttcgaatgttatgactatacatgggtgtatataaaatttgtgatcaaagtcttgt

SEQ ID NO: 10 - protein, 192 aa, Arabidopsis thaliana
  G7
MVSMLTNVVSGETEPSASATWTMGHKREREEFSLPPQPLITGSAVTKECESSMSLERPKKYRGVRQRPWGKWAAEIRDPHKATRVWLGTFETAEAAARAYDAAALRFRGSKAKLNFPENVGTQTIQRNSHFLQNSMQPSLTYIDQCPTLLSYSRCMEQQQPLVGMLQPTEEENHFFEKPWTEYDQYNYSSFG

SEQ ID NO: 11 - DNA, 1713 bp, Arabidopsis thaliana
  G8
aaaaaaaaatatccgtctcactctctcgccgccggtaacatttcccggcgacaaaacttctctactctcaccattcctccatcgtaatctctaaattcttctccattctcttcttcctcccgatcatctcgagctcttcgtgagagattatgtgattatgtaatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtttttttaccatctctctctctctcaacactctagtcccctttcaaaaatgtcatttgggttttagatttttcacatacaatgatcaatttttcc

SEQ ID NO: 12 - protein, 449 aa, Arabidopsis thaliana
  G8
MLDLNLNADSPESTQYGGDSYLDRQTSDNSAGNRVEESGTSTSSVINADGDEDSCSTRAFTLSFDILKVGSSSGGDESPAASASVTKEFFPVSGDCGHLRDVEGSSSSRNWIDLSFDRIGDGETKLVTPVPTPAPVPAQVKKSRRGPRSRSSQYRGVTFYRRTGRWESHIWDCGKQVYLGGFDTAHAAARAYDRAAIKFRGVDADINFTLGDYEEDMKQVQNLSKEEFVHILRRQSTGFSRGSSKYRGVTLHKCGRWEARMGQFLGKKAYDKAAINTNGREAVTNFEMSSYQNEINSESNNSEIDLNLGISLSTGNAPKQNGRLFHFPSNTYETQRGVSLRIDNEYMGKPVNTPLPYGSSDHRLYWNGACPSYNNPAEGRATEKRSEAEGMMSNWGWQRPGQTSAVRPQPPGPQPPPLFSVAAASSGFSHFRPQPPNDNATRGYFYPHP

SEQ ID NO: 13 - DNA, 1246 bp, Arabidopsis thaliana
  G9
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgtgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 14 - protein, 352 aa, Arabidopsis thaliana
  G9
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTCEVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 15 - DNA, 583 bp, Arabidopsis thaliana
  G10
ggtgattcaatacaaacgaaaacaagagtttcctatggtgaaagaaggaatggtcatgaccgagaagccaaagaggaatctcataagctctaatgagaagcgatacaaaggaataaggatgaggaagtggggcaagtgggtggctgagataagagagcctaataaacgatcacggatctggcttggttcatacaaaaccgccgttgccgcggcacgggcctacgataccgctgtgttttacttacgtggtccttcggcgagactcaatttccctgaagaggtctttaaggatggaaacggcggtgaaggcttaggaggagatatgtctccgacgttgatacggaagaaggcggctgaggtgggagctagagtcgacgcagagttgcggttagagaataggatggttgagaacttagacatgaataagttgccggaggcatatggattgtaatttatagtttggtagtttataggttggagattgcccggagacagagtcaaacagaggttctctgactcatatgaggcataatatagttaatatagtaatttttgttttgagcatagtaattatgtcataacc

SEQ ID NO: 16 - protein, 138 aa, Arabidopsis thaliana
  G10
MVKEGMVMTEKPKRNLISSNEKRYKGIRMRKWGKWVAEIREPNKRSRIWLGSYKTAVAAARAYDTAVFYLRGPSARLNFPEEVFKDGNGGEGLGGDMSPTLIRKKAAEVGARVDAELRLENRMVENLDMNKLPEAYGL

SEQ ID NO: 17 - DNA, 1056 bp, Arabidopsis thaliana
  G13
tttttttttttagaaagacgagacaaccactaagatttgacccaaacatacgagcacaaaatggaaaaatttatgtatccctatatatatgcctataactatgtctatgtacagattcatacaaaaaaaatatggaacatcaaacaactccaaagcagaaaactaaggagaagagcaaaggcaacaagactaagtttgtgggagttaggcaaaggccttcaggaaaatgggtggcagagatcaaagacactacacaaaagatacggatgtggctcggaacctttgaaaccgcagaagaagccgctcgagcctacgatgaagctgcatgtctcttacgtggctccaatactcgcaccaatttcgcaaaccattttcctaacaactcacaactatctttgaagatcagaaatcttcttcaccagaagcagagcatgaagcagcagcaacaacaacaacacaaaccagtttcttctttaacggattgcaacatcaactacatctcgactgctactagtctcaccacaaccaccaccaccaccactaccacggccataccgctcaataatgtgtaccgaccagattcatcggtcattgggcaaccagaaaccgagggtctccagcttccttattcgtggccccttgtctctggattcaaccatcagattccattggctcaggcagggggagaaacacatggacatctcaacgatcactactcaaccgatcaacatttgggtcttgcagaaattgaaagacagatatctgcgtccctatatgcaatgaatggagctaacagttactatgacaacatgaatgcagaatatgcaattttcgatcctaccgatcccatttgggatctcccttcactctcccaactcttctgccctacgtgatttccaatttacttttcctgatcaattcatgtaatgtttggatcaatgatccatgattgtaaagtagaacacatctctacaatgttccaatagacaagattgtacctaaagaaaatggacaatgtaagaagataatgaaggtttcgtacaacaaaagcttgat

SEQ ID NO: 18 - protein, 253 aa, Arabidopsis thaliana
  G13
MEHQTTPKQKTKEKSKGNKTKFVGVRQRPSGKWVAEIKDTTQKIRMWLGTFETAEEAARAYDEAACLLRGSNTRTNFANHFPNNSQLSLKIRNLLHQKQSMKQQQQQQHKPVSSLTDCNINYISTATSLTTTTTTTTTTAIPLNNVYRPDSSVIGQPETEGLQLPYSWPLVSGFNHQIPLAQAGGETHGHLNDHYSTDQHLGLAEIERQISASLYAMNGANSYYDNMNAEYAIFDPTDPIWDLPSLSQLFCPT

SEQ ID NO: 19 - DNA, 1498 bp, Arabidopsis thaliana
  G14
gaagaagcaaagatataacccccaaaagtatcaattagtttccattttcgccgctaagattctgttttcgaacatttacaccctcaagaatcgccgccatgtgtggaggagctataatatccgatttcattccaccgccgaggtctcgccgtgttactagcgagtttatttggccggatctgaagaagaatttgaaaggatcgaagaaaagctcgaagaatcgttcgaatttcttcgattttgacgctgagttcgaagctgatttccaaggtttcaaagatgattcgtctatcgattgcgatgatgatttcgacgtcggtgatgttttcgccgatgtgaaaccattcgttttcacttcgactccaaaacccgccgtctccgccgctgcggaaggttcagtttttggtaagaaagttactggcttggatggggacgctgagaaatctgcaaataggaagaggaagaatcagtaccgagggattaggcaacgtccttggggaaaatgggctgctgagatacgtgatccaagggaaggtgctagaatctggcttggaacgttcaagacagctgaggaagctgctagagcttacgatgctgcagcgcggagaatccgtggatctaaagctaaggtgaatttccctgaagaaaacatgaaggctaattctcagaaacgctctgtgaaggctaatcttcagaaaccagtggctaaacctaaccctaacccaagtccagctttggttcagaactcgaacatctcctttgaaaatatgtgtttcatggaggagaaacaccaagtgagcaacaacaacaacaaccagtttgggatgacaaactccgttgatgctggatgtaatgggtatcagtatttcagctctgaccagggtagtaattctttcgattgttcggagtttggttggagcgatcaagctccgataactcccgacatctcttctgcggttatcaacaacaacaactcagctctgttctttgaggaagccaatccagctaagaagctcaagtctatggatttcgagacaccttacaacaacactgaatgggacgcttcactggatttcctcaacgaagatgctgtaacgactcaggacaatggtgcaaaccctatggacctatggagtattgatgaaattcattccatgattggaggagtcttctgaagagatccagtttcatgtaaataaggctgcatgtttgtgagtttcccgcatcgttcgtttatcaacctccaaaactttctaatgtctgttacttgcatcttcttctgctgtctctgtctgtctctctcaggagttcctgtttgcattgcgagaagccatgagcctctatcttgagggtagttgtgatgaagttaagtagaggcttatttttaggggttgtggtagtttttgttttagtgaatcttttgaattcgtttgtgttttgtttttgttactttatgccccaaaactcctttaacatttgtcataatgtgtttgaacct

SEQ ID NO: 20 - protein, 358 aa, Arabidopsis thaliana
  G14
MCGGAIISDFIPPPRSRRVTSEFIWPDLKKNLKGSKKSSKNRSNFFDFDAEFEADFQGFKDDSSIDCDDDFDVGDVFADVKPFVFTSTPKPAVSAAAEGSVFGKKVTGLDGDAEKSANRKRKNQYRGIRQRPWGKWAAEIRDPREGARIWLGTFKTAEEAARAYDAAARRIRGSKAKVNFPEENMKANSQKRSVKANLQKPVAKPNPNPSPALVQNSNISFENMCFMEEKHQVSNNNNNQFGMTNSVDAGCNGYQYFSSDQGSNSFDCSEFGWSDQAPITPDISSAVINNNNSALFFEEANPAKKLKSMDFETPYNNTEWDASLDFLNEDAVTTQDNGANPMDLWSIDEIHSMIGGVF

SEQ ID NO: 21 - DNA, 1055 bp, Arabidopsis thaliana
  G19
ataaaggcatttcagctccaccgtaggaaactttctcttgaaagaaacccacagcaacaaacagagaaaatgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaaaagaaaaaaaataagtttaaaaaaagttaaataaagtctgtaatatatatgtaaccgccgttacttttaaaaggtttttaccgtcgcattggactgctgatgatgtctgttgtgtaatgtgtagaatgtgaccaaatggacgttatattacggtttgtggtattattagtttcttagatggaaaaacttacatgtgtaaataagatttgtaatgtaagacgaagtacttataacttctt

SEQ ID NO: 22 - protein, 248 aa, Arabidopsis thaliana
  G19
MCGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 23 - DNA, 1650 bp, Arabidopsis thaliana
  G20
ctctcactctctttttctctctctttacttctactgtatcaagaagctccgttttgcttagccatagtgcgtctagggtttggttggtgggaagaaggttccgatcatggcgtcggtgtcgtcgtcggatcaaggacctaagacagaagcaggatgtagcggcggaggaggaggagagagctcggagacagtggcggcgagtgatcagatgttgttgtatagaggttttaagaaggcgaagaaggagagaggttgtacagctaaggagcgtattagtaaaatgcctccgtgcactgctgggaaaaggagttccatataccggggagtcaccagacatagatggacaggtcgttatgaagctcacctttgggataagagtacctggaaccaaaaccagaacaagaagggaaaacaagtttatctaggagcatatgatgatgaagaggctgctgctagagcttacgaccttgctgccttaaaatattggggtcctgggacacttataaattttccggtgactgattataccagggatttagaagaaatgcaaaatctctcaagggaagaataccttgcatctttacgtagatatccctttggcagaaaaagcagcggtttctctaggggaatagcgaaatatcgtggacttcaaagccgatgggacgcatcagccagtcgtatgcctggacctgaatacttcagtaacattcattacggggcaggtgatgatcgtggaacagaaggtgactttctaggtagcttttgtctggaaagaaagattgatctaacaggatacataaagtggtggggagccaacaagaaccgtcaaccagaatcttcatcaaaagcatcagaggatgcaaacgtcgaagatgctggtactgagcttaaaacactggaacacacatcccatgcaacagaaccatacaaggcgccaaaccttggcgtcctttgtggaactcagagaaaagaaaaagaaatatcatcaccatcaagctcttctgctttaagcatcttgtctcagtcgcctgccttcaagagcctagaggagaaagtgttgaagatccaagaaagctgcaataatgaaaacgatgagaatgcaaaccgtaacatcatcaatatggagaagaataacggcaaggcaatagagaaaccagttgtgagtcatggagttgctttaggcggtgctgctgctttgtctcttcagaaaagcatgtacccacttacctctctcttaacggctccattgctcaccaactacaatacattggatcctcttgcagaccctattctctggacaccatttcttccttcaggatcctctcttacttcagaggtgacaaagacagagaccagctgttccacgtacagctacctcccacaagagaaatgagccgttccctttagactttatgtatgtcagattctccttttttgagatgaattcgtcgacttgacatctctttgtctcttttatggagaaaaagttgggaaaagtgtgacaatggtctgaagcaggaatgtacaggttttgttagtggttgtgtttttttttttccagtgtggaatatagaatcatgatattttgtgtaaaacagaaaaaagttatcattatagtatagaagtttgctcttaaaaaaaaaaaaaaaa

SEQ ID NO: 24 - protein, 428 aa, Arabidopsis thaliana
  G20
MASVSSSDQGPKTEAGCSGGGGGESSETVAASDQMLLYRGFKKAKKERGCTAKERISKMPPCTAGKRSSIYRGVTRHRWTGRYEAHLWDKSTWNQNQNKKGKQVYLGAYDDEEAAARAYDLAALKYWGPGTLINFPVTDYTRDLEEMQNLSREEYLASLRRYPFGRKSSGFSRGIAKYRGLQSRWDASASRMPGPEYFSNIHYGAGDDRGTEGDFLGSFCLERKIDLTGYIKWWGANKNRQPESSSKASEDANVEDAGTELKTLEHTSHATEPYKAPNLGVLCGTQRKEKEISSPSSSSALSILSQSPAFKSLEEKVLKIQESCNNENDENANRNIINMEKNNGKAIEKPVVSHGVALGGAAALSLQKSMYPLTSLLTAPLLTNYNTLDPLADPILWTPFLPSGSSLTSEVTKTETSCSTYSYLPQEK

SEQ ID NO: 25 - DNA, 1003 bp, Arabidopsis thaliana
  G21
tgtggaggaatattaatacagcccacttcacatctatttttgtgcaaccatctctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggctgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgagccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctctcactaacact

SEQ ID NO: 26 - protein, 295 aa, Arabidopsis thaliana
  G21
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRAVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 27 - DNA, 913 bp, Arabidopsis thaliana
  G22
agaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatggaaattaaatattgacgtttgtttttttgttgtaaaaaaaaaaaaaaaaaa

SEQ ID NO: 28 - protein, 226 aa, Arabidopsis thaliana
  G22
MSSSDSVNNGVNSRMYFRNPSFSNVILNDNWSDLPLSVDDSQDMAIYNTLRDAVSSGWTPSVPPVTSPAEENKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGESSLVVPELDFTVDQFYFDGSLLMDQSECSYSDNRI

SEQ ID NO: 29 - DNA, 957 bp, Arabidopsis thaliana
  G24
cggacgcgtgggcaaatattaaaataaaaagtgtcggtgaattctcaatctttgtcttctttcgtcgtctctttaaaactcctccgtccctccttattatgtaaccgtctcgccgtcaaattttcaaaatctctccctccgttcataaacccagatcgaaatttatggttttgtaatttttttaccggcggttatggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatagaaaaaataaaaagtagttgtagaaggagagacgagaatgtttgtctttaagatgcgctgttgccgctaacatgcgctttcgattttagtgttaaacatgcgcctccattgtttttgggttttgttttcgtcgtcgataatcaaagattttaaaacacaattctcaaatttttcacttgttacaaactagatttgcatgatctttgtattaacgaataacgattaagtcctaaa

SEQ ID NO: 30 - protein, 176 aa, Arabidopsis thaliana
  G24
METEAAVTATVTAATMGIGTRKRDLKPYKGIRMRKWGKWVAEIREPNKRSRIWLGSYATPEAAARAYDTAVFYLRGPSARLNFPELLAGLTVSNGGGRGGDLSAAYIRRKAAEVGAQVDALGATVVVNTGGENRGDYEKIENCRKSGNGSLERVDLNKLPDPENSDGDDDECVKRR

SEQ ID NO: 31 - DNA, 751 bp, Arabidopsis thaliana
  G25
aggactcggttcaaaaacgaaaacgcaaatacgtcttgttctagtttggagttggaagcgtaaaaaacaaaaaacaaaaatgtgtgggggagctatcatttctgatttcatctggtcgaaatctgagtcagaaccgagtcaactcggctctgttagcagcaggaagaagcgtaaacccgtctcagtgagtgaagaaagagatgggaaacgagagaggaagaatctgtacagagggataaggcagaggccatggggcaaatgggcagcggagattcgtgacccgagcaaaggtgtacgtgtctggcttggcacattcaaaaccgccgacgaagctgctcgagcctacgacgttgctgccatcaaaatccgtggccggaaagccaaactgaatttcccaaacactcaagtagaagaagaagccgatactaaaccaggggggaatcaaaatgagctgatttcggaaaaccaagtagagagcttatcggaggacctgatggcattggaggattacatgagattctatcagattccggttgccgacgaccaatcggcgaccgatattggaaatttatggagctatcaagactccaattaaatctcttatttcccggccggtttgctcactcattaatatgctgctaatttacttgttttttacttaacaatcaagtctaatttgtttccatcaatatttcagataagagtaaagcttcaattgtctttaaaaaaaaaaaaaaaaaaaaaaaaaaaa

SEQ ID NO: 32 - protein, 171 aa, Arabidopsis thaliana
  G25
MCGGAIISDFIWSKSESEPSQLGSVSSRKKRKPVSVSEERDGKRERKNLYRGIRQRPWGKWAAEIRDPSKGVRVWLGTFKTADEAARAYDVAAIKIRGRKAKLNFPNTQVEEEADTKPGGNQNELISENQVESLSEDLMALEDYMRFYQIPVADDQSATDIGNLWSYQDSN

SEQ ID NO: 33 - DNA, 1084 bp, Arabidopsis thaliana
  G26
ttggcttgtacccaaacccatctttgacttcaaaaataaaataaaaataatcataattgacatcatcggataatgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataacatgttaatggcataaatatctcttcgtccaagttatcaaacgcattgacctccggctttgatcattttaggcgcttaatctctttacgacttcattttggtagtctttaaagagtctatggagtggatttagctaggaatcaggccttatggatgaaaaatatataaattttgaacatgactatgcaagaatgggatgaagactacttagcttggaaaacgtcctgataggtcatgacgactatatccacagaagatgaccgacggagacaacaacatgcctcacctgatcgaccgatcaaatgagataatgtgttgaccggaccggtcggatcaggttgggtcgagtatatca

SEQ ID NO: 34 - protein, 218 aa, Arabidopsis thaliana
  G26
MHSGKRPLSPESMAGNREEKKELCCCSTLSESDVSDFVSELTGQPIPSSIDDQSSSLTLQEKSNSRQRNYRGVRQRPWGKWAAEIRDPNKAARVWLGTFDTAEEAALAYDKAAFEFRGHKAKLNFPEHIRVNPTQLYPSPATSHDRIIVTPPSPPPPIAPDILLDQYGHFQSRSSDSSANLSMNMLSSSSSSLNHQGLRPNLEDGENVKNISIHKRRK

SEQ ID NO: 35 - DNA, 881 bp, Arabidopsis thaliana
  G27
caaaataccaaaaacaaaacattttttttaatcttcccaccaatttttttctctttctctcgttacattaaattatctttagatgcaagactcttcctctcacgaatcgcaacgtaacctccggtcaccggtgccggagaaaaccggaaagagttctaagactaaaaatgagcaaaaaggtgtttctaaacaaccaaattttcgtggggtcagaatgagacaatggggaaaatgggtgtctgaaattagagaaccaagaaagaaatcaagaatatggctcggtactttctctacgccggagatggcggcgcgtgcacacgacgtggcggctttagccatcaaaggtggctctgcccaccttaatttcccggagctagcttaccatttgccgagaccggctagcgcggaccctaaagacattcaagaagccgccgccgcagcagctgccgttgactggaaagcaccggagtctccgtctagcaccgtgacgtcatctccagtcgccgacgacgctttctccgatcttcctgatcttttgcttgacgtgaatgatcacaacaaaaacgatggattctgggactcgtttccgtacgaagatcctttcttcttggaaaattactagaaggcaaattcttgccggcgaacggattttccggtggtttcccggtaaataagaagacgatgtcgttttgtaccttttttgtctacgatgggaaatttcttttttttttacgtgtgagtaaaagtttccgaatgtgtgatgtgtaagtaagtacaggttatttaatttcttttttttgtacaaatacgtacgtcattaccaaaaagttttcatttattgtgcttttatcttccaaattcattaaaaaaaaaaaaaaaaa

SEQ ID NO: 36 - protein, 179 aa, Arabidopsis thaliana
  G27
MQDSSSHESQRNLRSPVPEKTGKSSKTKNEQKGVSKQPNFRGVRMRQWGKWVSEIREPRKKSRIWLGTFSTPEMAARAHDVAALAIKGGSAHLNFPELAYHLPRPASADPKDIQEAAAAAAAVDWKAPESPSSTVTSSPVADDAFSDLPDLLLDVNDHNKNDGFWDSFPYEDPFFLENY

SEQ ID NO: 37 - DNA, 964 bp, Arabidopsis thaliana
  G28
gaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattaaaaaaaaaaaaaaaaaa

SEQ ID NO: 38 - protein, 268 aa, Arabidopsis thaliana
  G28
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 39 - DNA, 911 bp, Arabidopsis thaliana
  G32
aacacacattccctctcttccttcaactagaaaaaagatagatatatcggacatttattgatctgtgtatgcataaaggtatagtatcattattagaaagatgaacacaacatcatcaaagagcaagaagaagcaagacgatcaggttggtacaaggtttcttggggtgagaagaaggccttggggaagatacgcagctgagattagagacccaactacgaaggagcgtcactggcttggcactttcgatacggcggaagaagctgccttggcctacgatagagctgctcggtccatgcgtggcacacgtgccagaaccaactttgtttactcagacatgcctccttcctcatccgtcacctccattgtttctcctgacgatcctcctcctcctccacctcctcctgctcctcctagcaatgatcctgtcgattacatgatgatgtttaaccaatactcatccactgactcgccaatgcttcagcctcattgtgatcaagtggacagttacatgtttggtggctctcaatcttcgaattcttattgctattctaatgacagtagtaatgagctgcctcctctcccgagcgacttgtcgaattcgtgttatagccaaccacagtggacctggaccggtgacgactactcgtctgagtacgtacatagtccaatgttcagcagaatgcctccggtttctgactctttccctcaaggtttcaactactttggctcctaattctttctcatcgtccatatttaataccttcctcatttgtaccttttccttcttcttcttttttgggtttatctatgtttcgccgtccttgatctctgcctatgtgatcaaagtgactgtttgtcattagtttttcaataacaagttatcatttgtatcttgaaaaaaaaaaaaa

SEQ ID NO: 40 - protein, 211 aa, Arabidopsis thaliana
  G32
MNTTSSKSKKKQDDQVGTRFLGVRRRPWGRYAAEIRDPTTKERHWLGTFDTAEEAALAYDRAARSMRGTRARTNFVYSDMPPSSSVTSIVSPDDPPPPPPPPAPPSNDPVDYMMMFNQYSSTDSPMLQPHCDQVDSYMFGGSQSSNSYCYSNDSSNELPPLPSDLSNSCYSQPQWTWTGDDYSSEYVHSPMFSRMPPVSDSFPQGFNYFGS

SEQ ID NO: 41 - DNA, 1440 bp, Arabidopsis thaliana
  G38
gaggaaaactcgaaaaagctacacacaagaagaagaagaaaagatacgagcaagaagactaaacacgaaagcgatttatcaactcgaaggaagagactttgattttcaaatttcgtcccctatagattgtgttgtttctgggaaggagatggcagtttatgatcagagtggagatagaaacagaacacaaattgatacatcgaggaaaaggaaatctagaagtagaggtgacggtactactgtggctgagagattaaagagatggaaagagtataacgagaccgtagaagaagtttctaccaagaagaggaaagtacctgcgaaagggtcgaagaagggttgtatgaaaggtaaaggaggaccagagaatagccgatgtagtttcagaggagttaggcaaaggatttggggtaaatgggttgctgagatcagagagcctaatcgaggtagcaggctttggcttggtactttccctactgctcaagaagctgcttctgcttatgatgaggctgctaaagctatgtatggtcctttggctcgtcttaatttccctcggtctgatgcgtctgaggttacgagtacctcaagtcagtctgaggtgtgtactgttgagactcctggttgtgttcatgtgaaaacagaggatccagattgtgaatctaaacccttctccggtggagtggagccgatgtattgtctggagaatggtgcggaagagatgaagagaggtgttaaagcggataagcattggctgagcgagtttgaacataactattggagtgatattctgaaagagaaagagaaacagaaggagcaagggattgtagaaacctgtcagcaacaacagcaggattcgctatctgttgcagactatggttggcccaatgatgtggatcagagtcacttggattcttcagacatgtttgatgtcgatgagcttctacgtgacctaaatggcgacgatgtgtttgcaggcttaaatcaggaccggtacccggggaacagtgttgccaacggttcatacaggcccgagagtcaacaaagtggttttgatccgctacaaagcctcaactacggaatacctccgtttcagctcgagggaaaggatggtaatggattcttcgacgacttgagttacttggatctggagaactaaacaaaacaatatgaagctttttggatttgatatttgccttaatcccacaacgactgttgattctctatccgagttttagtgatatagagaactacagaacacgttttttcttgttataaaggtgaactgtatatatcgaaacagtgatatgacaatagagaagacaactatagtttgttagtctgcttctcttaagttgttctttagatatgttttatgttttgtaacaacaggaatgaataatacacacttgtgaagcttttaaaaaaaaaaaaaaaaaaaaa

SEQ ID NO: 42 - protein, 335 aa, Arabidopsis thaliana
  G38
MAVYDQSGDRNRTQIDTSRKRKSRSRGDGTTVAERLKRWKEYNETVEEVSTKKRKVPAKGSKKGCMKGKGGPENSRCSFRGVRQRIWGKWVAEIREPNRGSRLWLGTFPTAQEAASAYDEAAKAMYGPLARLNFPRSDASEVTSTSSQSEVCTVETPGCVHVKTEDPDCESKPFSGGVEPMYCLENGAEEMKRGVKADKHWLSEFEHNYWSDILKEKEKQKEQGIVETCQQQQQDSLSVADYGWPNDVDQSHLDSSDMFDVDELLRDLNGDDVFAGLNQDRYPGNSVANGSYRPESQQSGFDPLQSLNYGIPPFQLEGKDGNGFFDDLSYLDLEN

SEQ ID NO: 43 - DNA, 929 bp, Arabidopsis thaliana
  CBF1  G40
cttgaaaaagaatctacctgaaaagaaaaaaaagagagagagatataaatagctttaccaagacagatatactatcttttattaatccaaaaagactgagaactctagtaactacgtactacttaaaccttatccagtttcttgaaacagagtactctgatcaatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccaggatttggctcgggactttccaaaccgctgagatggcagctcgtgctcacgacgtcgctgcattagccctccgtggccgatcagcatgtctcaacttcgctgactcggcttggcggctacgaatcccggagtcaacatgcgccaaggatatccaaaaagcggctgctgaagcggcgttggcttttcaagatgagacgtgtgatacgacgaccacgaatcatggcctggacatggaggagacgatggtggaagctatttatacaccggaacagagcgaaggtgcgttttatatggatgaggagacaatgtttgggatgccgactttgttggataatatggctgaaggcatgcttttaccgccgccgtctgttcaatggaatcataattatgacggcgaaggagatggtgacgtgtcgctttggagttactaatattcgatagtcgtttccatttttgtactatagtttgaaaatattctagttcctttttttagaatggttccttcattttattttattttattgttgtagaaacgagtggaaaataattcaatac

SEQ ID NO: 44 - protein, 213 aa, Arabidopsis thaliana
  CBF1  G40
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 45 - DNA, 803 bp, Arabidopsis thaliana
  CBF2  G41
ctgatcaatgaactcattttctgccttttctgaaatgtttggctccgattacgagtctccggtttcctcaggcggtgattacagtccgaagcttgccacgagctgccccaagaaaccagcgggaaggaagaagtttcgtgagactcgtcacccaatttacagaggagttcgtcaaagaaactccggtaagtgggtgtgtgagttgagagagccaaacaagaaaacgaggatttggctcgggactttccaaaccgctgagatggcagctcgtgctcacgacgtcgccgccatagctctccgtggcagatctgcctgtctcaatttcgctgactcggcttggcggctacgaatcccggaatcaacctgtgccaaggaaatccaaaaggcggcggctgaagccgcgttgaattttcaagatgagatgtgtcatatgacgacggatgctcatggtcttgacatggaggagaccttggtggaggctatttatacgccggaacagagccaagatgcgttttatatggatgaagaggcgatgttggggatgtctagtttgttggataacatggccgaagggatgcttttaccgtcgccgtcggttcaatggaactataattttgatgtcgagggagatgatgacgtgtccttatggagctattaaaattcgatttttatttccatttttggtattatagctttttatacatttgatccttttttagaatggatcttcttctttttttggttgtgagaaacgaatgtaaatggtaaaagttgttgtcaaatgcaaatgtttttgagtgcag

SEQ ID NO: 46 - protein, 207 aa, Arabidopsis thaliana
  CBF2  G41
MFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 47 - DNA, 908 bp, Arabidopsis thaliana
  misc_feature (851)..(851): n is a, c, g, or t
  47  CBF3
cctgaactagaacagaaagagagagaaactattatttcagcaaaccataccaacaaaaaagacagagatcttttagttaccttatccagtttcttgaaacagagtactcttctgatcaatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaaaactcagattattatttccatttttagtacgatactttttattttattattatttttagatccttttttagaatggaatctncattatgtttgtaaaactgagaaacgagtgtaaattaaattgattcagtttcagtat

SEQ ID NO: 48 - protein, 216 aa, Arabidopsis thaliana
  47  CBF3
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 49 - DNA, 909 bp, Arabidopsis thaliana
  G43
ctcctgtcttgtctaaagaaaaaagagagaggaagaaatggagacttttgaggaaagctctgatttggatgttatacagaaacatctatttgaagacttgatgatccctgatggtttcattgaagattttgtctttgatgatactgcttttgtctccggactctggtctctagaaccctttaacccagttccgaaactggaacctagttcacctgttcttgatccagattcctatgtccaagagattctgcaaatggaagcagaatcatcatcatcatcatcaacaacaacgtcacctgaggttgagactgtctcaaaccggaaaaaaacaaagaggtttgaagaaacgagacattacagaggcgtgagaaggaggccatgggggaaatttgcagcagagattcgagatccggcaaagaaaggatccaggatttggttaggcacttttgagagtgatattgatgctgcaagggcttacgactatgcagcttttaagctcaggggaagaaaagctgttctcaactttcctttggatgccggaaagtatgatgctccggtcaattcatgccgaaaaaggaggagaaccgatgtaccacagcctcaaggaacaacaacaagtacttcatcatcgtcatcaaactaatgggggaatagtgatgtttaattagtatatataggttaatatcttaagtatgtgaagcatcatgtatagagccaagaacctgttagactagtgtactgaaaagaactcttgcaaaatatgtactaaagagttcctgtaacaatggaacttctgcgttttctcttgtcttaaagagcttaaggttctagaaacaaagttcttgtcctttcggtttaaaaaaaaaaaaaaaaaaaaaaaaaaaaaaaaaaaaaaaaaaaaaaaaaaaa

SEQ ID NO: 50 - protein, 201 aa, Arabidopsis thaliana
  G43
METFEESSDLDVIQKHLFEDLMIPDGFIEDFVFDDTAFVSGLWSLEPFNPVPKLEPSSPVLDPDSYVQEILQMEAESSSSSSTTTSPEVETVSNRKKTKRFEETRHYRGVRRRPWGKFAAEIRDPAKKGSRIWLGTFESDIDAARAYDYAAFKLRGRKAVLNFPLDAGKYDAPVNSCRKRRRTDVPQPQGTTTSTSSSSSN

SEQ ID NO: 51 - DNA, 997 bp, Arabidopsis thaliana
  G44
cacatacacatatacaacagagcaagagagtcaatcaagtagagtgaagatggcaactaaacaagaagctttagccatcgatttcataagccaacaccttctcacagactttgtttccatggaaactgatcacccatctctttttaccaaccaacttcacaactttcactcagaaacaggccctagaaccatcaccaaccaatcccctaaaccgaattcgactcttaaccagcgtaaaccgcccttaccgaatctatccgtctcgagaacggtttcaacaaagacagagaaagaggaagaagagaggcactacaggggagtgagacgaagaccgtggggaaaatacgcggcggagattagggatccgaacaaaaagggttgtaggatctggcttgggacttacgacactgccgtggaagctggaagagcttatgaccaagcggcgtttcaattacgtggaagaaaagcaatcttgaatttccctctcgatgttagggttacgtcagaaacttgttctggggaaggagttatcggattagggaaacgaaagcgagataagggttctccgccggaagaggagaaggcggctagggttaaagtggaggaagaagagagtaatacgtcggagacgacggaggctgaggttgagccggtggtaccattgacgccgtcaagttggatggggttttgggatgtgggagcaggagatggtattttcagtattcctccgttatctccgacgtctcccaacttttccgttatctccgtcacttaaaacttcggaaaagtcaacgtacgatgacgttttcacttgcgtcactctcatgatttcatttattcttgtataatataaaggtagcggtagtgtgcaaatatcaaataagtagtttaattagtaccaatcattttattcattattttttttagtagaatatttggatgttgaaaatataaatttaattttgtatttgttgatgttataaaaaaaaaaaaaaaa

SEQ ID NO: 52 - protein, 241 aa, Arabidopsis thaliana
  G44
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKGSPPEEEKAARVKVEEEESNTSETTEAEVEPVVPLTPSSWMGFWDVGAGDGIFSIPPLSPTSPNFSVISVT

SEQ ID NO: 53 - DNA, 818 bp, Arabidopsis thaliana
  G46
ttctctctttcgtaaaaatggcgagttttgaggaaagctctgatttggaagctatacagagccatctcttagaagacttgttggtttgtgatggtttcatgggagattttgacttcgatgcttcttttgtctcaggactttggtgtatagaaccacacgttcctaaacaagaacctgattctccagttcttgatccggattctttcgtcaacgagttcttgcaagtggaaggggaatcatcatcatcatcatcaccagagctgaattcatcgtcatcaacatatgagactgatcagagtgtgaaaaaggcagagaggttcgaagaagaagtagatgctagacattaccgaggagtgaggcgaaggccgtgggggaaatttgcagcagagattcgagatccagcaaagaaaggatcaagaatctggctaggaacatttgagagtgatgttgatgctgcaagagcctatgactgtgcagctttcaagctccggggaagaaaagccgtgctcaacttccctcttgacgccgggaaatatgaagctccagcgaattcaggaaggaaaaggaagagaagtgatgtgcatgaagagcttcaaagaactcagagcaattcatcttcatcttcctgtgatgcattttagcatattaagagtgtgagcagtttccttaagttgtataaagtaattgtacagaggaaacgaattgtgtaggtttagtgtgcttgcaagttgcaacaaatgtgtatggatgttctgtttcttcatgtccctaagatttagaaacatcttcttatttccaagaaaaaaaaaaaaaaaaaa

SEQ ID NO: 54 - protein, 207 aa, Arabidopsis thaliana
  G46
MASFEESSDLEAIQSHLLEDLLVCDGFMGDFDFDASFVSGLWCIEPHVPKQEPDSPVLDPDSFVNEFLQVEGESSSSSSPELNSSSSTYETDQSVKKAERFEEEVDARHYRGVRRRPWGKFAAEIRDPAKKGSRIWLGTFESDVDAARAYDCAAFKLRGRKAVLNFPLDAGKYEAPANSGRKRKRSDVHEELQRTQSNSSSSSCDAF

SEQ ID NO: 55 - DNA, 914 bp, Arabidopsis thaliana
  G134
ggcacgaggagagagaaagagatagagagagaaagatgggtagaggaaagatcgagataaagaggatagagaacgcaaacaacagagtggtgacgttctcaaagaggaggaatggattggtgaagaaggctaaagagatcacagttctttgtgatgcaaaagttgccctcataatctttgcaagtaatggtaagatgattgattactgttgtccttccatggatcttggtgctatgttggaccaataccagaagttatctggcaagaaactatgggatgctaagcatgagaaccttagcaatgagattgataggatcaagaaagagaatgatagcttacaactggagctcaggcatttgaagggagaagatatacagtctctcaacttgaaaaatctgatggctgtcgagcacgccattgaacatggcctcgacaaagtccgagaccaccagatggagatccttatatcaaagaggagaaatgagaagatgatggcggaggagcaacggcaactcactttccagctgcaacaacaggagatggctatagcaagcaacgcaagaggaatgatgatgagagatcatgatgggcagtttggatatagagtgcaaccgattcagccaaatcttcaggaaaagattatgtctttggtcatcgattgatcatcgagattttataatctcatcctgatcaactcctatctatactatcgtggtctttagtttgtctttatcaatctgtgtgtcttaatctcgagcaacatatatactcgctatcagactttttacttaagctatatgtgtgttgtttgcttatgacctctatgtattggttgtgttgtgtgcttaaacgtttcgaactaattgatctgtgtgaaacttattattctgtgataagctatttgtgataaaaaa

SEQ ID NO: 56 - protein, 208 aa, Arabidopsis thaliana
  G134
MGRGKIEIKRIENANNRVVTFSKRRNGLVKKAKEITVLCDAKVALIIFASNGKMIDYCCPSMDLGAMLDQYQKLSGKKLWDAKHENLSNEIDRIKKENDSLQLELRHLKGEDIQSLNLKNLMAVEHAIEHGLDKVRDHQMEILISKRRNEKMMAEEQRQLTFQLQQQEMAIASNARGMMMRDHDGQFGYRVQPIQPNLQEKIMSLVID

SEQ ID NO: 57 - DNA, 1093 bp, Arabidopsis thaliana
  G142
atttatcgtgtacgatactttattccttttatctattcttgaaaaaaagttaccaattcttgagaagaagaagaaatcagaatcaagagaaggagagagaaagatgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttggaattgaaagcacaatcgaacggtataatcgttgttacaactgctctctaagcaataataagcctgaagagactacacagagttggtgtcaggaggtgacaaagcttaaatccaaatacgaatctcttgttcgtactaacaggaatttgcttggagaagatcttggagaaatgggtgtgaaggaactgcaagcgctcgagaggcagctcgaagccgctcttaccgcgactcgacagcgcaagacacaagttatgatggaagaaatggaagaccttaggaaaaaggagaggcaactaggagacataaacaaacaactcaagattaagtttgaaacggaaggccatgctttcaaaacctttcaagacttatgggcaaactcggcggcatcggtggccggggatccaaacaattctgaatttccggtagagccttctcatcctaatgtattggattgcaacaccgaaccctttttacaaatagggtttcaacaacattactacgtgcaaggtgaagggtcttcggtatcaaagagtaacgtggcaggtgagactaatttcgtccaaggttgggttctttgactctctgttgattagcccacgatgccacggtcaggccaatttcagctctctacagttgttcttttttcaaattagatttctggttttttttttcctataagaaaaacttttgcactagatgtttgtcatttaatttccagctcgtgtgaatctatattcgcatgtatgtgctttgaagaatttctcctcttactcctacttgatctaaaacattatttttcttttgggttt

SEQ ID NO: 58 - protein, 252 aa, Arabidopsis thaliana
  G142
MGRGRVEMKRIENKINRQVTFSKRRNGLLKKAYELSVLCDAEVALIIFSSRGKLYEFGSVGIESTIERYNRCYNCSLSNNKPEETTQSWCQEVTKLKSKYESLVRTNRNLLGEDLGEMGVKELQALERQLEAALTATRQRKTQVMMEEMEDLRKKERQLGDINKQLKIKFETEGHAFKTFQDLWANSAASVAGDPNNSEFPVEPSHPNVLDCNTEPFLQIGFQQHYYVQGEGSSVSKSNVAGETNFVQGWVL

SEQ ID NO: 59 - DNA, 906 bp, Arabidopsis thaliana
  G145
aagaaaatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagttgaacttagtagccagcaggagtatctcaagcttaaggagcgttatgacgccttacaaagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcagcaagatggaatgggagcaggaccaagtgtgaataattacatgttgggttggttaccttatgacaccaactctatttgaatctttctcacttaattaatctctcttttttttgacatttttaagatgatgtttctattttattacctctctcacgttttctgtcttgtgtgcatgtgtctgtgtaatgtttattgcccttctattattcaatgatttctcgac

SEQ ID NO: 60 - protein, 251 aa, Arabidopsis thaliana
  G145
MGRGRVELKRIENKINRQVTFAKRRNGLLKKAYELSVLCDAEVALIIFSNRGKLYEFCSSSSMLRTLERYQKCNYGAPEPNVPSREALAVELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 61 - DNA, 905 bp, Arabidopsis thaliana
  G146
acgagagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttctagttgaaatcgaaaacgcgcagaaaagggagattgagcttgacaatgagaacatctatctaagaactaaggtagcagaagtggagaggtatcaacaacaccatcatcaaatggttagtggttcagagattaacgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgt

SEQ ID NO: 62 - protein, 230 aa, Arabidopsis thaliana
  G146
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 63 - DNA, 959 bp, Arabidopsis thaliana
  G152
cctagaacgcaccaagatctaaaggaagatcaaaatagggtttaaattaatggggagagggaagattgtgatccagaagatcgatgattccacgagtagacaagtcactttctccaaaagaagaaagggtctcatcaagaaagctaaagaacttgctattctctgcgacgccgaggtctgtctcatcattttctccaacactgacaagctctatgactttgccagctccagtgtgaaatctactattgaacgattcaatacggctaagatggaggagcaagaactaatgaaccctgcatcagaagttaagttttggcagagagaggctgaaactctaaggcaagaattgcactcattgcaagaaaattatcggcaactaacgggagtggaattaaatggtttgagcgttaaggagttacaaaacatagagagtcaacttgaaatgagtttacgtggaattcgtatgaaaagggaacaaattttgaccaatgaaattaaagagctaaccagaaagaggaatcttgttcatcatgaaaacctcgaattgtcgagaaaagtacaaaggattcatcaagaaaatgtcgaactatacaagaaggcttatggaacgtcgaacacaaatggattgggacatcatgagctagtagatgcagtttatgaatcccatgcacaggttaggctgcagctaagccagcctgagcagtcccattataagacatcttcaaacagctaagatcatataagagatatataacaaattgttcgttcttgattatctcaaaaccctttcaaatatatatacgtgcatattatatatgaagactcgtttgactatgtcaatatatatgttttcatgcaggagtaagtgtgagtgtaatcatgtcggagagcaaaccaaaggtttgatttgtacgatatatacttatatatggtctcaagtgaaagcaatggaacagctt

SEQ ID NO: 64 - protein, 227 aa, Arabidopsis thaliana
  G152
MGRGKIVIQKIDDSTSRQVTFSKRRKGLIKKAKELAILCDAEVCLIIFSNTDKLYDFASSSVKSTIERFNTAKMEEQELMNPASEVKFWQREAETLRQELHSLQENYRQLTGVELNGLSVKELQNIESQLEMSLRGIRMKREQILTNEIKELTRKRNLVHHENLELSRKVQRIHQENVELYKKAYGTSNTNGLGHHELVDAVYESHAQVRLQLSQPEQSHYKTSSNS

SEQ ID NO: 65 - DNA, 1098 bp, Arabidopsis thaliana
  G153
aaaaaaaagaagcttctcctcttcctctgccttcttctttccatttattgcaaaccctgatcaattggttttggtgttagtcttttggggagagagatggggagagggaagatagttatacgaaggatcgataactctacaagtagacaagtgactttctccaagagaaggagtggtttgcttaagaaagctaaagagttatcgatcctttgtgatgcagaagttggtgttatcatattctctagcaccggaaagctctacgactacgcaagcaattcaagtatgaaaacaatcattgagcggtacaacagagtaaaagaggagcagcatcaacttctgaatcatgcctcagagataaagttttggcaaagagaggttgcaagtttgcagcagcagctccaatatctacaagaatgccacaggaaactagtgggagaggaactttctggaatgaatgctaacgacctacaaaaccttgaagaccagctagtaacaagtctaaaaggtgttcgtctcaaaaaggatcaacttatgacaaatgaaatcagagaacttaatcgtaagggacaaatcatccaaaaagagaatcacgagctacaaaatattgtagatataatgcgtaaggaaaatattaaattgcaaaagaaggttcatggaagaacaaatgcgattgaaggcaattcaagtgtagatccaataagcaatggaaccacaacatatgcaccaccgcaacttcaactcatacaactacaaccagctcctagagaaaaatcaatcagactagggctacaactttcctagcaaaacatgtgggacatcgaacaatatacgaaaagagtttgtatgtcatcttcagtaacaaccaagctggatcatttcattcttggttatgtaattctgtttactactttggagtttaatatgttatatgacaagtttctctttgtcaagttacttgtgtatgtacatcataaaataatgatgtgatgtgagtgccgaacatactagacatcattttaccgtgtgtttttttcgggtacattaaatgtacaaaatccagtctaattggcatttttatacaaaaaaaaaaaaaaaaaa

SEQ ID NO: 66 - protein, 234 aa, Arabidopsis thaliana
  G153
MGRGKIVIRRIDNSTSRQVTFSKRRSGLLKKAKELSILCDAEVGVIIFSSTGKLYDYASNSSMKTIIERYNRVKEEQHQLLNHASEIKFWQREVASLQQQLQYLQECHRKLVGEELSGMNANDLQNLEDQLVTSLKGVRLKKDQLMTNEIRELNRKGQIIQKENHELQNIVDIMRKENIKLQKKVHGRTNAIEGNSSVDPISNGTTTYAPPQLQLIQLQPAPREKSIRLGLQLS

SEQ ID NO: 67 - DNA, 947 bp, Arabidopsis thaliana
  misc_feature (924)..(925): n is a, c, g, or t
  misc_feature (929)..(929): n is a, c, g, or t
  misc_feature (932)..(933): n is a, c, g, or t
  G156
aggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggatgcctcaactcattgaccgatacttgcataccaacggattgcgacttcctgatcatcatgacgaccaggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaagaggaggatgctagaagaagataacaacaacatgtaccgttggcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactctttctttatggagacagattcatgaacttttattacctatattttgataagccagtgtcttcttttgtgtggctatggaaaccttgtttaaagcacaatgcacttgagttcttggttatataattaatcatcattattacatannaaanaannaaaaaaaaaaaaaa

SEQ ID NO: 68 - protein, 238 aa, Arabidopsis thaliana
  G156
MGRGKIEIKKIENQTARQVTFSKRRTGLIKKTRELSILCDAHIGLIVFSATGKLSEFCSEQNRMPQLIDRYLHTNGLRLPDHHDDQEQLHHEMELLRRETCNLELRLRPFHGHDLASIPPNELDGLERQLEHSVLKVRERKRRMLEEDNNNMYRWLHEHRAAMEFQQAGIDTKPGEYQQFIEQLQCYKPGEYQQFLEQQQQQPNSVLQLATLPSEIDPTYNLQLAQPNLQNDPTAQND

SEQ ID NO: 69 - DNA, 883 bp, Arabidopsis thaliana
  G157
gggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttcaaaaaaaaaaa

SEQ ID NO: 70 - protein, 196 aa, Arabidopsis thaliana
  G157
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 71 - DNA, 826 bp, Arabidopsis thaliana
  G162
agacatacaacaccaaaatcttcttcttcaccaacatattcactttcacagcaaaaaaaaacgagaggttctctcttattcgtaccgttttagcaaacaaatgggtcggagaaagatcaagatggagatggttcaggacatgaacacacgacaggttaccttttcaaaacggaggactggtttgttcaagaaggcgagcgagttagccacgctctgcaacgctgagttgggcatcgttgtcttttcaccaggaggcaagcctttctcctacgggaaaccgaatcttgattctgttgcagagcgattcatgagagaatatgatgattcagacagtggcgatgaagaaaaaagtggtaattacaggcctaaactgaagaggctgagtgaacgtctcgatttgctcaaccaagaggttgaagctgagaaggaacgaggcgagaagagtcaggagaagcttgaatctgctggggatgagagattcaaggagtccattgagacgcttaccctcgatgaactcaatgaatacaaagataggcttcagacagtccatggtaggattgaaggtcaagtcaatcacttgcaggcttcgtcttgcctcatgcttctctccagaaaatagctagaccgacttgttagagttacattctattttttgtatcagcctacagaacttaccaacacatgaaagttattgctggtgtagaattttctgtcatctatggggtgtgactttctatttgacatcaaatgaaaatgtacctggaaatttgtctgtattaatctcaagtgtacttgctaaacttgatcagctttttcgcaaaaaaaa

SEQ ID NO: 72 - protein, 172 aa, Arabidopsis thaliana
  G162
MGRRKIKMEMVQDMNTRQVTFSKRRTGLFKKASELATLCNAELGIVVFSPGGKPFSYGKPNLDSVAERFMREYDDSDSGDEEKSGNYRPKLKRLSERLDLLNQEVEAEKERGEKSQEKLESAGDERFKESIETLTLDELNEYKDRLQTVHGRIEGQVNHLQASSCLMLLSRK

SEQ ID NO: 73 - DNA, 1011 bp, Arabidopsis thaliana
  G166
aacaaagcaaaacacatataacaaaaacaatagatatgaagagaaagatgaagttatcgttaatagaaaacagtgtatcgaggaaaacaacattcaccaaaaggaagaaagggatgacgaagaaactaaccgagctagtcactctatgtggtgttgaagcatgtgcggtcgtctatagtccgttcaactcgatcccggaggcttggccgtcaagggaaggcgttgaagacgtggtgtcgaaatttatggagttgtcggtgttggaccggaccaagaagatggtggatcaagagacttttataagtcaaaggatcgccaaagaaaaagagcagctgcagaagctacgtgatgagaaccataattctcagattcgggagttaatgtttggttgtctcaaaggggagacgaatgtgtataatcttgatggaagggatcttcaagatttgagtttatatattgataagtatcttaatggtcttactcgcaggattgagatccttattgagaacggtgagtcttcttcatctttacctcttcctattgttgcgaatgcagctgcaccagtcggatttgatggtcctatgtttcaatatcataatcaaaatcagcaaaagccggttcaattccaatatcaggctctttatgatttttatgatcagattccaaagaaaattcatggttttaatatgaatatgaataaggattcgaatcaaagtatggttttggatttgaatcaaaatcttaatgatggagaggacgagggcattccttgcatggacaacaacaactaccaccccgaaatcgattgtctcgctaccgtcaccactgcccccactgatgtttgtgctcctaacatcaccaatgatctctagtctaagggatgtatttcgagtgaagtgtttgatcgtttgcatttgtgttttctccattttataagacaaaacttatatgtgatgtcttttttattattattaattgttggacaattcttgcgtccacacttatcttatt

SEQ ID NO: 74 - protein, 278 aa, Arabidopsis thaliana
  G166
MKRKMKLSLIENSVSRKTTFTKRKKGMTKKLTELVTLCGVEACAVVYSPFNSIPEAWPSREGVEDVVSKFMELSVLDRTKKMVDQETFISQRIAKEKEQLQKLRDENHNSQIRELMFGCLKGETNVYNLDGRDLQDLSLYIDKYLNGLTRRIEILIENGESSSSLPLPIVANAAAPVGFDGPMFQYHNQNQQKPVQFQYQALYDFYDQIPKKIHGFNMNMNKDSNQSMVLDLNQNLNDGEDEGIPCMDNNNYHPEIDCLATVTTAPTDVCAPNITNDL

SEQ ID NO: 75 - DNA, 1107 bp, Arabidopsis thaliana
  G170
atggggatgaagaaggtgaagctatctttgatagctaatgaaagatcaaggaaaacatccttcataaagaggaaagacgggatttttaagaaactccacgagttgtcaactctgtgtggtgtccaagcttgtgctctcatctacagtccattcataccggttccagagtcatggccgtcaagggaaggtgctaaaaaggtggcttcaaggtttctggagatgccgccgacagcccgaaccaagaagatgatggatcaagagacttaccttatggagaggattaccaaagcaaaagagcaactaaagaacctggctgctgagaaccgagagttacaggttagacgatttatgtttgattgtgttgaaggcaaaatgtcccagtatcattatgatgcaaaagaccttcaagatttgcaatcttgtataaatctatatctcgatcagcttaacggaaggatcgagtccattaaagaaaatggtgagtcgttgttgtcttccgtctctccttttcctactagaattggtgttgacgaaattggtgatgagtcattttccgactctcctattcatgctacaactggggttgtagatactcttaatgctaccaatcctcatgttcttacgggcgatatgactccttttcttgatgcggacgcaactgcggtaactgcttccagtagattttttgatcatattccatatgaaaatatgaatatgagtcaaaatctgcatgaaccgtttcaacaccttgttcctactaacgtttgtgatttttttcaaaatcagaatatgaatcaggttcaataccaggctcctaataatctgtttaatcagattcaacgagaattctacaacataaatttgaatctgaatttgaatctgaattcgaatcagtatctgaatcaacaacaatcattcatgaatccgatggtggaacaacatatgaatcatgttggagggcgtgaaagcattcctttcgtggacggaaactgctacaactaccatcaactaccatccaatcaactaccagccgttgatcatgcttccaccagttacatgccttccaccaccggtgtctatgatccttacatcaacaataatctctaa

SEQ ID NO: 76 - protein, 368 aa, Arabidopsis thaliana
  G170
MGMKKVKLSLIANERSRKTSFIKRKDGIFKKLHELSTLCGVQACALIYSPFIPVPESWPSREGAKKVASRFLEMPPTARTKKMMDQETYLMERITKAKEQLKNLAAENRELQVRRFMFDCVEGKMSQYHYDAKDLQDLQSCINLYLDQLNGRIESIKENGESLLSSVSPFPTRIGVDEIGDESFSDSPIHATTGVVDTLNATNPHVLTGDMTPFLDADATAVTASSRFFDHIPYENMNMSQNLHEPFQHLVPTNVCDFFQNQNMNQVQYQAPNNLFNQIQREFYNINLNLNLNLNSNQYLNQQQSFMNPMVEQHMNHVGGRESIPFVDGNCYNYHQLPSNQLPAVDHASTSYMPSTTGVYDPYINNNL

SEQ ID NO: 77 - DNA, 861 bp, Arabidopsis thaliana
  G171
atgggtcgaaagatggtaaagatgacgaggataacgaacgagaaaacgaggataacgacttacaagaagaggaaagcatgtttgtataagaaagccagtgagttctcaacactctgcggtgtggacacttgtgtcattgtgtacggcccgagcagagcaggggacgaaatggtcatggagcccgagttatggccaaaggatgggagcaaagtccgtgaaatcttaaccaagtacagagacactgcgtcaagcagctgcaccaagacatacaccgtgcaagaatgcttggagaaaaacaacactaaggtggagaaaccgacgattgcgacaaagtatcctacatgggacaaaaagctcgaccagtgttctttaaatgacctctatgcggttttcatggcagtagaaaacaagatccaagaggctacgaataggaatcagacatttcctgacactagttgttggtctaatgaccaacttggtttatgcggttacaatcggcaatgttttgagcagtatcagttgtttcctctgcctactatggattacaacgggctctctttcttcccttttaataaccagatgacctcaaatactgcggaagtgtcttccttctcgaatgtgacagagccgatgatagcgaacgggcaaagcttgttttacgggagttgttcggatggtccatatggtccgatggtacagaggacagcttatatggagccaatacattggggtttaggaaacagtatgttcaacaatgtgaagcagttccaagattatcccttcaggtttgcacaagttaatgatttggaggattcaagtaaactttctatgtgagaaatgtcatttgtttcttccgtttga

SEQ ID NO: 78 - protein, 277 aa, Arabidopsis thaliana
  G171
MGRKMVKMTRITNEKTRITTYKKRKACLYKKASEFSTLCGVDTCVIVYGPSRAGDEMVMEPELWPKDGSKVREILTKYRDTASSSCTKTYTVQECLEKNNTKVEKPTIATKYPTWDKKLDQCSLNDLYAVFMAVENKIQEATNRNQTFPDTSCWSNDQLGLCGYNRQCFEQYQLFPLPTMDYNGLSFFPFNNQMTSNTAEVSSFSNVTEPMIANGQSLFYGSCSDGPYGPMVQRTAYMEPIHWGLGNSMFNNVKQFQDYPFRFAQVNDLEDSSKLSM

SEQ ID NO: 79 - DNA, 443 bp, Arabidopsis thaliana
  G173
agaagaaaccaaacttgtctatgagagaagatacaatgtttaagaaagccctcgagctttcaactctgtgcgatatcgaagtctgtgtcatactttatagtcgtgacggagaactcatcaagacatggccggaggatcaatccaaggttcgagacatggcagagaggtttagcaaactacacgagagagagcgacgcaagaaaagaaccaacctttctctgtttctacgtaagaagatcctcgacaacagtaagctctcggagaaagtcttagagatgaaggattcattagaaagtggtctacgggtactacaagataagcttctgttactacaacccgagaaaaaccagaccgagttaggtcagatccccgtcatcaacaatggacagaaccattggtgaatatcggtgtgtcaaacacagagcaagacctatcgacgtcac

SEQ ID NO: 80 - protein, 126 aa, Arabidopsis thaliana
  G173
MREDTMFKKALELSTLCDIEVCVILYSRDGELIKTWPEDQSKVRDMAERFSKLHERERRKKRTNLSLFLRKKILDNSKLSEKVLEMKDSLESGLRVLQDKLLLLQPEKNQTELGQIPVINNGQNHW

SEQ ID NO: 81 - DNA, 1674 bp, Arabidopsis thaliana
  G176
agaagaagaagaagaagagtacctcatacgtaaaccattgatgggctcttttgatcgccaaagagctgttccgaaattcaaaacagcaacaccgtcaccgctccctctttctccttcgccttacttcactatgcctcctggccttactcccgccgactttctcgactctcctcttctcttcacttcctccaacattttgccgtctcctacgacaggcacatttccagcgcaatctctgaactataacaataacggtttgctcattgacaaaaatgaaatcaaatatgaagacacaactcctcccttgttcctaccatctatggtaactcagcctttacctcaactggatttattcaaatccgaaatcatgtcgagtaacaaaacctctgatgacggctacaattggcgcaaatacgggcagaagcaagtcaaaggaagcgaaaacccgaggagttacttcaaatgcacgtatccaaattgtctcacaaagaagaaagtagagacgtctcttgtgaagggtcagatgattgagattgtctataaaggaagccacaatcatcccaagccccaatccacgaagcgatcatcttccaccgctatagcagcacatcagaacagcagtaatggagacggtaaagacattggtgaagatgaaacagaggccaagagatggaaaagagaagagaatgtgaaggagccaagagtggtggttcagacaacaagtgatatagacattcttgacgatggctacagatggagaaagtatggtcagaaagtcgtcaagggtaatccaaatccaaggagctattacaagtgcacatttacaggatgttttgtaaggaaacacgttgaaagagcatttcaagatcccaagtcagtgatcacaacttacgaaggaaaacacaaacaccaaatcccgaccccaagaagaggtccagttttaagatctgctgcaatggcttctcctcttctcccaacttcgactactcctgatcaacttcccggcggcgatccacagttgctgagctctctacgcgtcctcttgtcccgcgttctagccaccgtccgtcacgcttctgcagatgccagaccctgggcagagctcgttgaccggtcagcgttttcccggccaccatcgctctcggaggcaacgtcacgagtaaggaagaacttttcctatttccgagccaattacataaccttagtggcaatcttactcgccgcgtctctgctcacgcaccctttcgctctcttcctcctcgcatcgctggccgcttcttggcttttcctctactttttccgtccggcggatcagccgttggtcattggaggacgcacgttctccgatcttgagacgctagggatactctgcctgtccactgtggtggtgatgttcatgaccagcgttggatcgctcttgatgtccactctagcagttgggatcatgggcgtggccatccacggagcgtttcgtgctcccgaagacctgtttcttgaagaacaagaagccattggatctggacttttcgcattcttcaacaacaatgcctctaatgcagctgccgctgccatagccacctcagcaatgtcacgcgttcgagtctgagattgttgaagagactacattcctacaccgcatttccaaagtgtgatatttattcatattgaattgtt

SEQ ID NO: 82 - protein, 521 aa, Arabidopsis thaliana
  G176
MGSFDRQRAVPKFKTATPSPLPLSPSPYFTMPPGLTPADFLDSPLLFTSSNILPSPTTGTFPAQSLNYNNNGLLIDKNEIKYEDTTPPLFLPSMVTQPLPQLDLFKSEIMSSNKTSDDGYNWRKYGQKQVKGSENPRSYFKCTYPNCLTKKKVETSLVKGQMIEIVYKGSHNHPKPQSTKRSSSTAIAAHQNSSNGDGKDIGEDETEAKRWKREENVKEPRVVVQTTSDIDILDDGYRWRKYGQKVVKGNPNPRSYYKCTFTGCFVRKHVERAFQDPKSVITTYEGKHKHQIPTPRRGPVLRSAAMASPLLPTSTTPDQLPGGDPQLLSSLRVLLSRVLATVRHASADARPWAELVDRSAFSRPPSLSEATSRVRKNFSYFRANYITLVAILLAASLLTHPFALFLLASLAASWLFLYFFRPADQPLVIGGRTFSDLETLGILCLSTVVVMFMTSVGSLLMSTLAVGIMGVAIHGAFRAPEDLFLEEQEAIGSGLFAFFNNNASNAAAAAIATSAMSRVRV

SEQ ID NO: 83 - DNA, 1398 bp, Arabidopsis thaliana
  G177
aaaagtttccttttttagcgaatcctctgttttagaaatcttaaagttgtctcctttattaaagaccatcatgtcttccacttctttcaccgaccttcttggttcttccggcgttgactgttacgaagatgatgaagacttgagagtttctgggtcgagttttggtgggtactatccagagagaaccgggtctggtttacctaagttcaagacggctcaaccaccacctcttccgatttcacaatcttctcataacttcactttctccgattaccttgattctcctctgcttctcagctcctcacacagtttgatatctccaacaacaggaacgtttccattgcaaggctttaatggaacaacaaacaatcactcagattttccctggcagctacaatctcaaccatcaaacgcttcttctgctttgcaagaaacatatggtgttcaagatcacgagaagaagcaggagatgattcctaatgagattgcaacacaaaacaacaatcaaagttttggaacagaacgtcagataaagataccagcatacatggtgagtaggaactctaatgatggttatggttggagaaaatacggtcagaaacaagtgaagaagagcgaaaaccctaggagttacttcaagtgtacgtatcctgattgtgtttccaagaagattgttgagacggcttctgatggacagatcactgagatcatttataaaggtggtcataatcatcctaagcctgagttcaccaagagaccatctcaatcttcattaccatcatcggttaatgggaggcgcttgtttaatcctgcttctgttgttagtgaacctcatgatcaatcagagaactcttcgatttcgtttgactatagtgatcttgagcagaaaagttttaaatcagagtatggtgagatagatgaagaggaggaacaacctgagatgaagaggatgaaaagagaaggtgaagatgaagggatgtctatagaagtaagcaaaggagttaaagagccaagagttgtggttcagacaataagtgatattgatgttcttatagatggctttagatggaggaaatatggtcaaaaagttgtcaaaggaaatactaatccaaggagctactacaagtgcacattccaaggttgtggagtgaagaagcaagtggaaagatccgcagcagacgagagagcagttctcactacctatgaaggaagacacaatcacgatatcccaaccgcgctacgtcgctcgtgaaattattgggacttagtcactagtaatatgatttaggctttctaaaaacaaaaaatcttactatggcttatcttttgtgctcattcacagtttgtttatttgtttgttacacagtcaatactttgttttgtaaaaaaaaaaaaaaa

SEQ ID NO: 84 - protein, 393 aa, Arabidopsis thaliana
  G177
MSSTSFTDLLGSSGVDCYEDDEDLRVSGSSFGGYYPERTGSGLPKFKTAQPPPLPISQSSHNFTFSDYLDSPLLLSSSHSLISPTTGTFPLQGFNGTTNNHSDFPWQLQSQPSNASSALQETYGVQDHEKKQEMIPNEIATQNNNQSFGTERQIKIPAYMVSRNSNDGYGWRKYGQKQVKKSENPRSYFKCTYPDCVSKKIVETASDGQITEIIYKGGHNHPKPEFTKRPSQSSLPSSVNGRRLFNPASVVSEPHDQSENSSISFDYSDLEQKSFKSEYGEIDEEEEQPEMKRMKREGEDEGMSIEVSKGVKEPRVVVQTISDIDVLIDGFRWRKYGQKVVKGNTNPRSYYKCTFQGCGVKKQVERSAADERAVLTTYEGRHNHDIPTALRRS

SEQ ID NO: 85 - DNA, 724 bp, Arabidopsis thaliana
  G179
gtctttctctccctcccctccttggcttttttcaagttcccaccataaacgcagagggagttaagaaatggaggataggaggtgtgatgtgttgtttccatgttcatcatcggttgatcctcgcttgacagagtttcatggggtcgacaactctgctcagccgacaacatcatccgaagagaagccaaggagtaagaagaagaagaaagagagagaagcgaggtacgcgttccagacaagaagccaggttgatatactggatgatggatacaggtggaggaagtacggccaaaaagcagtcaagaacaatccattccccaggagctattataagtgcacagaagaaggatgcagagtgaagaagcaagtgcagaggcaatggggagacgaaggagtggtggtgacgacataccaaggtgttcatacacatgccgttgataaaccctctgataatttccaccacatcttgacacaaatgcacatcttccctcccttttgcttgaaggaatgattagaggaattggattgtaatatttactttcccaaaaacgttgggctcacaccatcagacctttacttttaaactagcagcaactcacatatctcaaaaatactaatccttatctttgtctttatgggacctttgaatccatctgctttggtgtcttagtctcggctgccctgtaatcgaaagtatattcatcatcaaattaccaaacataaa

SEQ ID NO: 86 - protein, 147 aa, Arabidopsis thaliana
  G179
MEDRRCDVLFPCSSSVDPRLTEFHGVDNSAQPTTSSEEKPRSKKKKKEREARYAFQTRSQVDILDDGYRWRKYGQKAVKNNPFPRSYYKCTEEGCRVKKQVQRQWGDEGVVVTTYQGVHTHAVDKPSDNFHHILTQMHIFPPFCLKE

SEQ ID NO: 87 - DNA, 837 bp, Arabidopsis thaliana
  G180
gtaattacgatctacaacaagtgacatcgtcgtcgacgacgattcaagagaatatgaacttcctcgttccttttgaagaaaccaatgtcttaacctttttctcttcttcttcttcctcttctctttcttctccttctttccccattcacaactcttcctccactactactactcatgcacctctagggttttctaataatcttcagggtggaggacccttgggatcaaaggtggttaatgatgatcaggagaattttggaggtggaactaacaatgatgctcattctaattcttggtggagatcaaatagtggaagtggagatatgaagaacaaagtgaagataaggaggaaactaagagagccaagattctgtttccaaaccaaaagcgatgttgatgttcttgacgatggctacaaatggcgtaaatatggtcagaaagtcgtcaagaacagccttcaccccaggagttattacagatgcacacacaacaactgtagggtgaaaaagagagtggagcgactatcggaagattgtagaatggtgattactacttacgaaggtcgtcacaaccacattccctctgatgactccacttctcctgaccatgattgtctctcttccttttaacatctctttctatatatctatatatagacagttatatgtgcacatatagatgtgtgatatattgcatatttgatattgcatgtgtttttcaagagtatgtcatcagatgttatgcatatattcttgacttgttgcttatagtatacatatgtaataatatatattgacattggtagttcatttctgttcaaacaaaaaaaaaaaaaaa

SEQ ID NO: 88 - protein, 191 aa, Arabidopsis thaliana
  G180
MNFLVPFEETNVLTFFSSSSSSSLSSPSFPIHNSSSTTTTHAPLGFSNNLQGGGPLGSKVVNDDQENFGGGTNNDAHSNSWWRSNSGSGDMKNKVKIRRKLREPRFCFQTKSDVDVLDDGYKWRKYGQKVVKNSLHPRSYYRCTHNNCRVKKRVERLSEDCRMVITTYEGRHNHIPSDDSTSPDHDCLSSF

SEQ ID NO: 89 - DNA, 1974 bp, Arabidopsis thaliana
  G184
tgaattctagcctttttgtaggcgaatcatctggaccggtaagagactctctcatcgataataaccacataatttaatcaaactctttctctctctttctaagatcttttgctttgctcttttcctttttgatcttcctatatatggagaagcaccaaaacggtacttactatacgatactgtacggatccatcaaactggattaattatcaaaacgtacatttttatcttacctggcaagttacattcctagggttttggagaatccaatcaacaacaaagaaaataatcatcgttacaataatcagtatcacgcacagacttagatgttccggtttccagtgagtctaggcggttcacgtgacgaagaccgtcacgatcagatcacaccgttggatgaccatcgtgtggtggttgatgaggttgacttcttctcagagaagagagatagggtttcacgtgagaacatcaacgacgacgacgacgaaggcaataaggttctcatcaaaatggagggttcacgagttgaagaaaacgatcgttccagagatgtcaatatcggtctgaatcttctgaccgcgaatacgggaagcgatgagtcaacggtggatgatggactatcaatggatatggaagataaacgtgcaaagattgagaacgcacaactacaagaagagctcaagaagatgaaaatagagaatcaaaggctaagagatatgttgagccaagcgacgaccaacttcaatgccttacaaatgcaacttgttgccgtcatgaggcaacaagaacaacgtaactcttcacaagatcatctcctggagagcaaagcagaaggaaggaaacggcaggaactgcaaatcatggtgccaaggcagttcatggaccttgggccgtcgtctggagcagcagagcatggagccgaagtgtcatctgaagagaggacaacggttcgttcaggttctcctccttcgcttctagaaagttccaatccccgagagaacggaaagaggttgcttggaagagaagaaagctcagaggaatcagagtctaacgcctggggaaaccctaacaaagtccccaaacataatccatcctctagcaatagcaatggaaacagaaacggaaatgttattgatcagtcggccgcagaagccaccatgcggaaagcccgtgtctcagttcgtgcccgatctgaagctgccatgataagcgatggatgtcaatggagaaagtacggacaaaaaatggctaaaggaaacccgtgtccgcgggcttattatcgttgcacaatggccggtggatgtccagttcgcaagcaagtgcagcgttgcgcagaagacagatctattctcataaccacctacgaaggaaaccacaaccatccactcccaccagccgctacggccatggcctcaacaaccaccgcagctgcaagcatgctcctctcgggctcaatgtcgagtcaagacggtttaatgaacccaacaaacctcctagctcgagctatcttgccttgctcctcaagcatggctacaatctcagcctccgcaccattcccaaccatcacattggacctcaccaattcacccaacggtaacaaccctaatatgaccactaataacccgttgatgcagttcgctcaacggcccggtttcaacccggcagttttgcctcaagtggttggtcaagctatgtacaataaccaacaacagtccaagttttctggtttacagttaccggctcagccactgcagatcgcggccacttcctcggtggccgagagcgttagtgctgccagtgcagcaattgcgtccgatccaaactttgcggcggctctagcggcagcgatcacgtccattatgaacggttccagtcatcaaaataataacaccaataataataatgtggctacgagcaacaatgacagtaggcaataagagttttcattttgatggtcgatttttttttttgggg

SEQ ID NO: 90 - protein, 536 aa, Arabidopsis thaliana
  G184
MFRFPVSLGGSRDEDRHDQITPLDDHRVVVDEVDFFSEKRDRVSRENINDDDDEGNKVLIKMEGSRVEENDRSRDVNIGLNLLTANTGSDESTVDDGLSMDMEDKRAKIENAQLQEELKKMKIENQRLRDMLSQATTNFNALQMQLVAVMRQQEQRNSSQDHLLESKAEGRKRQELQIMVPRQFMDLGPSSGAAEHGAEVSSEERTTVRSGSPPSLLESSNPRENGKRLLGREESSEESESNAWGNPNKVPKHNPSSSNSNGNRNGNVIDQSAAEATMRKARVSVRARSEAAMISDGCQWRKYGQKMAKGNPCPRAYYRCTMAGGCPVRKQVQRCAEDRSILITTYEGNHNHPLPPAATAMASTTTAAASMLLSGSMSSQDGLMNPTNLLARAILPCSSSMATISASAPFPTITLDLTNSPNGNNPNMTTNNPLMQFAQRPGFNPAVLPQVVGQAMYNNQQQSKFSGLQLPAQPLQIAATSSVAESVSAASAAIASDPNFAAALAAAITSIMNGSSHQNNNTNNNNVATSNNDSRQ

SEQ ID NO: 91 - DNA, 1205 bp, Arabidopsis thaliana
  G185
atgcaaaaataaacatagtaacaatactttaaactatttacaccactttaatcttattctccactctttgaacgtaatggagaagaaccatagtagtggagagtgggagaagatgaagaacgagatcaacgagctaatgatagaaggaagagactatgcacaccagtttggatcagcttcatctcaagaaacacgtgaacatttagccaaaaagattcttcaatcttaccacaagtctctcaccatcatgaactactccggcgaacttgaccaagtttctcagggtggaggaagccccaagagcgatgattccgatcaagaaccacttgtcatcaagagttcgaagaagtcaatgccaaggtggagttcaaaagtcagaattgcccctggagctggtgttgatagaacgctggacgatggattcagttggagaaagtacggccagaaggatattctcggagccaaatttccaagaggatactatagatgcacgtatagaaagtctcaaggatgtgaagccactaaacaagtccaaagatctgatgaaaatcagatgctccttgagatcagttaccgaggaatacattcttgctctcaagctgcaaatgtcggtacaacaatgccgatacaaaacctcgaaccgaaccagacccaagaacacggaaatcttgacatggtaaaggaaagtgtagacaactacaatcaccaagcacatttgcatcacaaccttcactatccattgtcatctaccccaaatctagagaataacaatgcctatatgcttcaaatgcgagatcaaaacatcgaatattttggatctacgagcttctctagtgatctaggaactagtatcaactacaattttccagcatctggctcggcttctcactcagcatcaaactctccgtccaccgtccctttggaatccccgtttgaaagctatgatccaaatcatccatatggaggatttggtgggttctattcttagttatctacttaagggagggacggaactttttacatgacctcttgattaaagagagagttttcataatagctaatcaatttcctattcaaatatccgagttttttttctaatcatgtttatcaattgtcttattacagaaggcttattttcaggtctatgttgaaataaatggatttgtactcgtaggtatgatccttgttatctaaaaaaaaaaaaa

SEQ ID NO: 92 - protein, 303 aa, Arabidopsis thaliana
  G185
MEKNHSSGEWEKMKNEINELMIEGRDYAHQFGSASSQETREHLAKKILQSYHKSLTIMNYSGELDQVSQGGGSPKSDDSDQEPLVIKSSKKSMPRWSSKVRIAPGAGVDRTLDDGFSWRKYGQKDILGAKFPRGYYRCTYRKSQGCEATKQVQRSDENQMLLEISYRGIHSCSQAANVGTTMPIQNLEPNQTQEHGNLDMVKESVDNYNHQAHLHHNLHYPLSSTPNLENNNAYMLQMRDQNIEYFGSTSFSSDLGTSINYNFPASGSASHSASNSPSTVPLESPFESYDPNHPYGGFGGFYS

SEQ ID NO: 93 - DNA, 1931 bp, Arabidopsis thaliana
  G186
ctttcaaccaaacccctaaacaaaaaaaaaatacattttctgatctctctaaaaatctttctccttcgttaatctcgtgatctctttctttttctatatatggacagaggatggtctggtctcactcttgattcatcttctcttgatcttttaaaccctaatcgtatttctcataagaatcaccgacgtttctcaaatcctttggcgatgtctagaattgacgaagaagatgatcagaagacgagaatatcaaccaacggtagtgaatttaggtttccggtgagtctctcaggtattcgtgatcgtgaagatgaagatttttcatctggcgttgctggagataatgaccgtgaagttcccggcgaagtggatttcttctccgacaagaaatctagggtttgtcgtgaagacgacgaaggatttcgtgtgaagaaggaagaacaagatgatcgaacggacgtaaataccggtttgaatcttcgaacaactggtaatacaaagagtgatgagtcaatgatcgatgatggagaatcttccgaaatggaagataagcgtgcgaaaaatgagttggtgaaattacaagatgagttgaagaaaatgacaatggataatcaaaagcttagagaattgcttacacaagttagcaacagttacacttcacttcagatgcatcttgtttcactaatgcagcaacagcaacaacagaacaataaggtaatagaagctgctgagaagcctgaggagacgatagtaccaaggcaatttattgatttaggccctacgagagcagtaggtgaggccgaggatgtgtcaaattcttcatccgaagatagaactcgttcggggggttcttctgcagccgagaggcgtagtaacgggaagagacttgggcgtgaagaaagccccgaaactgagtccaacaaaattcagaaggtgaattctactaccccgacgacatttgatcaaaccgctgaagctacgatgaggaaagcccgtgtctccgttcgtgcccgatcggaagctccgatgataagcgatggatgtcaatggagaaaatatggccagaagatggccaaagggaatccttgtccgcgggcatattaccgctgcacgatggccacgggctgtcccgttcgcaaacaagttcaacgttgcgcggaagacagatcaattctgattacaacctacgagggaaaccataaccatccgttgccgccagccgcggtagccatggcttctaccaccacggcggcggctaacatgttgctatccgggtcaatgtctagtcacgacgggatgatgaaccctacaaatttactagctagggctgttcttccttgctccacaagcatggcaacaatctcagcctccgcgccgtttccaaccgtcacattagacctcacccactcacctccgcctcctaatggttccaatccttcctcttccgcggctaccaacaacaaccacaactcactgatgcagcggccgcaacaacaacaacagcaaatgacgaacttacctccgggaatgctacctcatgtaataggccaggcattgtataaccaatccaagttctcggggctgcagttctctggtggctctccctcgacggcagcgttttctcagtcacacgcggtggctgatacaataacggcactcacagctgacccgaatttcacggcggctcttgcagccgttatttcttctatgatcaatggtacgaaccaccacgacggcgaaggaaacaacaaaaatcaatagaaaaatattacattttttttttgggtatctacattttttttccaactgggttataggaaacagagagtttatttcattgattcacatttgttctgtttcgtaccaaaatcccagtaaatatacaaaagcaaactatactcaagttcatattcgtaaacactataaatagt

SEQ ID NO: 94 - protein, 553 aa, Arabidopsis thaliana
  G186
MDRGWSGLTLDSSSLDLLNPNRISHKNHRRFSNPLAMSRIDEEDDQKTRISTNGSEFRFPVSLSGIRDREDEDFSSGVAGDNDREVPGEVDFFSDKKSRVCREDDEGFRVKKEEQDDRTDVNTGLNLRTTGNTKSDESMIDDGESSEMEDKRAKNELVKLQDELKKMTMDNQKLRELLTQVSNSYTSLQMHLVSLMQQQQQQNNKVIEAAEKPEETIVPRQFIDLGPTRAVGEAEDVSNSSSEDRTRSGGSSAAERRSNGKRLGREESPETESNKIQKVNSTTPTTFDQTAEATMRKARVSVRARSEAPMISDGCQWRKYGQKMAKGNPCPRAYYRCTMATGCPVRKQVQRCAEDRSILITTYEGNHNHPLPPAAVAMASTTTAAANMLLSGSMSSHDGMMNPTNLLARAVLPCSTSMATISASAPFPTVTLDLTHSPPPPNGSNPSSSAATNNNHNSLMQRPQQQQQQMTNLPPGMLPHVIGQALYNQSKFSGLQFSGGSPSTAAFSQSHAVADTITALTADPNFTAALAAVISSMINGTNHHDGEGNNKNQ

SEQ ID NO: 95 - DNA, 1136 bp, Arabidopsis thaliana
  G187
tagacctcttaggaaaaaaacctaaaaacctaatccccaaacctaaaaggcttatctcatctcttcttctttgtcttctttactctttttttacctctctcttcattgttcttcaccatgtctaatgaaaccagagatctctacaactaccaatacccttcatcgttttcgttgcacgaaatgatgaatctgcctacttcaaatccatcttcttatggaaacctcccatcacaaaacggttttaatccatctacttattccttcaccgattgtctccaaagttctccagcagcgtatgaatctctacttcagaaaacttttggtctttctccctcttcctcagaggttttcaattcttcgatcgatcaagaaccgaaccgtgatgttactaatgacgtaatcaatggtggtgcatgcaacgagactgaaactagggtttctccttctaattcttcctctagtgaggctgatcaccccggtgaagattccggtaagagccggaggaaacgagagttagtcggtgaagaagatcaaatttccaaaaaagttgggaaaacgaaaaagactgaggtgaagaaacaaagagagccacgagtctcgtttatgactaaaagtgaagttgatcatcttgaagatggttatagatggagaaaatacggccaaaaggctgtaaaaaatagcccttatccaaggagttactatagatgtacaacacaaaagtgcaacgtgaagaaacgagtggagagatcgttccaagatccaacggttgtgattacaacttacgagggtcaacacaaccacccgattccgactaatcttcgaggaagttctgccgcggctgctatgttctccgcagacctcatgactccaagaagctttgcacatgatatgtttaggacggcagcttatactaacggcggttctgtggcggcggctttggattatggatatggacaaagtggttatggtagtgtgaattcaaaccctagttctcaccaagtgtatcatcaagggggtgagtatgagctcttgagggagatttttccttcaattttctttaagcaagagccttgatcgatcattgttataactacatatattatatatattgagagagagaggtagagaaaaaaaaa

SEQ ID NO: 96 - protein, 318 aa, Arabidopsis thaliana
  G187
MSNETRDLYNYQYPSSFSLHEMMNLPTSNPSSYGNLPSQNGFNPSTYSFTDCLQSSPAAYESLLQKTFGLSPSSSEVFNSSIDQEPNRDVTNDVINGGACNETETRVSPSNSSSSEADHPGEDSGKSRRKRELVGEEDQISKKVGKTKKTEVKKQREPRVSFMTKSEVDHLEDGYRWRKYGQKAVKNSPYPRSYYRCTTQKCNVKKRVERSFQDPTVVITTYEGQHNHPIPTNLRGSSAAAAMFSADLMTPRSFAHDMFRTAAYTNGGSVAAALDYGYGQSGYGSVNSNPSSHQVYHQGGEYELLREIFPSIFFKQEP

SEQ ID NO: 97 - DNA, 1191 bp, Arabidopsis thaliana
  G188
ctctcaccaacataatcaaagaagctttcctcacgaattcaagatcgccatgtcctccgaggattgggatctcttcgccgtcgtcagaagctgcagctcttctgtttccaccaccaattcttgtgctggtcatgaagacgacataggaaactgtaaacaacaacaagatcctcctcctcctcctctgtttcaagcttcttcttcttgcaacgagttacaagattcttgcaaaccatttttacccgttactactactactactactacttggtctcctcctcctctacttcctcctcctaaagcctcatcaccatctcccaatatcttactaaaacaagaacaagtacttctcgaatcacaagatcaaaaacctcctcttagtgttagggttttcccaccatccacttcttcttctgtctttgtttttagaggtcaacgcgaccagcttcttcaacaacaatcccaacctccccttcgatctagaaaaagaaagaatcagcaaaaaagaaccatatgtcatgtaacgcaagagaatctttcttctgatttgtgggcttggcgtaaatacggtcaaaaacccatcaaaggctctccttatccaaggaattattacagatgtagtagctcaaaaggatgtttagcacgaaaacaagttgaaagaagtaatttagatcctaatatcttcatcgttacttacaccggagaacacactcatccacgtcctactcaccggaactctctcgccggaagtactcgtaacaaatctcagcccgttaacccggttcctaaaccggacacatctcctttatcggatacagtaaaagaagagattcatctttctccgacgacaccgttgaaaggaaacgatgacgttcaagaaacgaatggagatgaagatatggttggtcaagaagtcaacatggaagaggaagaggaggaagaagaagtggaagaagatgatgaagaagaagaagatgatgatgacgtggatgatcttttgataccaaatttagcggtgagagatcgagatgatttgttcttcgctggaagttttccatcttggtccgccggatccgccggtgacggtggtggatgatgaaaacgaataaaatctcaatttacaatttacaaaaagaaaaaagtcagtttttaattattatttttgtttgttaaaacttgacatttattgtg

SEQ ID NO: 98 - protein, 348 aa, Arabidopsis thaliana
  G188
MSSEDWDLFAVVRSCSSSVSTTNSCAGHEDDIGNCKQQQDPPPPPLFQASSSCNELQDSCKPFLPVTTTTTTTWSPPPLLPPPKASSPSPNILLKQEQVLLESQDQKPPLSVRVFPPSTSSSVFVFRGQRDQLLQQQSQPPLRSRKRKNQQKRTICHVTQENLSSDLWAWRKYGQKPIKGSPYPRNYYRCSSSKGCLARKQVERSNLDPNIFIVTYTGEHTHPRPTHRNSLAGSTRNKSQPVNPVPKPDTSPLSDTVKEEIHLSPTTPLKGNDDVQETNGDEDMVGQEVNMEEEEEEEEVEEDDEEEEDDDDVDDLLIPNLAVRDRDDLFFAGSFPSWSAGSAGDGGG

SEQ ID NO: 99 - DNA, 1034 bp, Arabidopsis thaliana
  G190
gaaaaagaaaacaaacaagaaacacatacacacacacacaagttcactatactctatggaaatgaactccccacacgaaaaggcggtgcaagctatccgttatggccatagctgcgccatgcggttgaagaggcggctcaaccatccaatggctgatggtggaccgctttcaagttatgatcttgctaaatcgatcgttgaaagtttttccaatgccatttcaatcttatctgctaaaccagaaaccgaagatgatcagttttctgatttatcttctagggattcttctcctcctccacaggggagcccctccaagaaaagaaagattgatagtacaaattcaagtgagaattggagggacgattcaccggatccgatttactacgacgggtatctttggaggaaatatggtcaaaagagtataaaaaaatctaatcaccaaaggagttactatagatgttcttacaacaaagatcataactgcgaagcaagaaagcatgaacaaaagatcaaagacaatcctccggtttaccgaaccacttactttggccaccacacttgcaaaaccgaacataatctagatgccatttttattgccggacaagatcccctagatgactttaaaagtacccaaatgatccgattcggaaaagatcaggatcaggagaaggaaagccgctcgaacggtttctccttatcggttaagcatgaagaagatatcatcaaagagcaagctatagatcagtaccgtgagataaccagtaatgaccaagattgtcaagatgttatagaagaatatctatcatcaccatcaggctcttatcctccttcatcgtcatctggcagtgaaagtgctgactttaattctgatttgttatttgacaacccagactcgtgggatcgttatgatcagttttacttttgattgcactagatttttcagctaaaactatttaataatgttttcctttttatgagattgtatatatttgagaattgtgactatttaagtatttatgttattgattagataa

SEQ ID NO: 100 - protein, 289 aa, Arabidopsis thaliana
  G190
MEMNSPHEKAVQAIRYGHSCAMRLKRRLNHPMADGGPLSSYDLAKSIVESFSNAISILSAKPETEDDQFSDLSSRDSSPPPQGSPSKKRKIDSTNSSENWRDDSPDPIYYDGYLWRKYGQKSIKKSNHQRSYYRCSYNKDHNCEARKHEQKIKDNPPVYRTTYFGHHTCKTEHNLDAIFIAGQDPLDDFKSTQMIRFGKDQDQEKESRSNGFSLSVKHEEDIIKEQAIDQYREITSNDQDCQDVIEEYLSSPSGSYPPSSSSGSESADFNSDLLFDNPDSWDRYDQFYF

SEQ ID NO: 101 - DNA, 1171 bp, Arabidopsis thaliana
  G192
cttttttctcttctctcctcagagattcgaagctttttgtctcccctgagtaaccaaattcaatggccgacgattgggatctccacgccgtagtcagaggctgctcagccgtaagctcatcagctactaccaccgtatattcccccggcgtttcatctcacacaaaccctatattcaccgtcggacgacaaagtaatgccgtctccttcggagagattcgagatctctacacaccgttcacacaagaatctgtcgtctcttcgttttcttgtataaactacccagaagaacctagaaagccacagaaccagaaacgtcctctttctctctctgcttcttccggtagcgtcactagcaaacccagtggctccaatacctctagatctaaaagaagaaagatacagcataagaaagtgtgccatgtagcagcagaagctttaaactccgatgtctgggcatggcgaaagtacggacagaaacccatcaaaggttcaccatatccaagaggatactacagatgtagtacatcaaaaggttgtttagcccgtaaacaagtggagcgaaatagatccgacccgaagatgtttatcgtcacttacacggcggagcataatcatccagctccgacacaccgtaattctctcgccggaagcacacgtcagaaaccatccgatcaacagacgagtaaatctccgacgaccactattgctacttattcatcgtctccggtgacttcagccgacgaatttgttttgcctgttgaggatcatctagcggtgggagatcttgacggagaagaagatctgttatctttgtcggatacggtggttagcgatgatttcttcgatgggttagaggaattcgcagccggagatagcttttccgggaactcggctccggcgagttttgatctctcttgggttgtgaacagtgccgccactaccaccggaggaatatgattagattacgacggcttagaatactcttattaggacagatttataggattaaggaattattctcggagcatatgtaaaaataggataaaagaaaatgttctttgttactttttttcgggttttcttcctattgtttctaaacatcttagaaaaaatttaattgtatattccttaagctcgatacatcttgttttaaaaaaaaaaaaaaaaaa

SEQ ID NO: 102 - protein, 298 aa, Arabidopsis thaliana
  G192
MADDWDLHAVVRGCSAVSSSATTTVYSPGVSSHTNPIFTVGRQSNAVSFGEIRDLYTPFTQESVVSSFSCINYPEEPRKPQNQKRPLSLSASSGSVTSKPSGSNTSRSKRRKIQHKKVCHVAAEALNSDVWAWRKYGQKPIKGSPYPRGYYRCSTSKGCLARKQVERNRSDPKMFIVTYTAEHNHPAPTHRNSLAGSTRQKPSDQQTSKSPTTTIATYSSSPVTSADEFVLPVEDHLAVGDLDGEEDLLSLSDTVVSDDFFDGLEEFAAGDSFSGNSAPASFDLSWVVNSAATTTGGI

SEQ ID NO: 103 - DNA, 1418 bp, Arabidopsis thaliana
  G194
tctttcttctctctctatctctcctctttgaaccctaaaaactctttctttacaaggattgatctttttgtatttttgattttgacatttgctttgtgttcgatctctgttttgatgcgatttctctgtttttaaagccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatctagtttttttttgtataattgtctaaaagaaacggatcttttgttctgatgaagaagatgttttcttatggttctgaaatcgtaaggtaatgatgattgtaccaagccgagaaagtacttgtgattttcaccattgaatcactataaatgtaatttttatttactgtgaaaaaaaaaaaaaaa

SEQ ID NO: 104 - protein, 337 aa, Arabidopsis thaliana
  G194
MEFTDFSKTSFYYPSSQSVWDFGDLAAAERHSLGFMELLSSQQHQDFATVSPHSFLLQTSQPQTQTQPSAKLSSSIIQAPPSEQLVTSKVESLCSDHLLINPPATPNSSSISSASSEALNEEKPKTEDNEEEGGEDQQEKSHTKKQLKAKKNNQKRQREARVAFMTKSEVDHLEDGYRWRKYGQKAVKNSPFPRSYYRCTTASCNVKKRVERSFRDPSTVVTTYEGQHTHISPLTSRPISTGGFFGSSGAASSLGNGCFGFPIDGSTLISPQFQQLVQYHHQQQQQELMSCFGGVNEYLNSHANEYGDDNRVKKSRVLVKDNGLLQDVVPSHMLKEE

SEQ ID NO: 105 - DNA, 1501 bp, Arabidopsis thaliana
  G196
tcgacatcagatttctctcacggattcctaatcatttttattatatttggatatttgctaattcttcccgtgtataaatctcatataaacacgcatcatacatatatattatgtgcagcgtctttgagtttcaagacatggacaacttccaaggagatctaacagacgtcgtacgaggaataggatcaggccacgtgtcaccatctcctggaccaccggaaggtccatctccgagcagcatgtctccgccgccaacatcagatctccacgtggaattcccctccgccgctacttctgccagctgtctcgcaaatcccttcggagacccgttcgtaagcatgaaggatcctctcatccacctcccggccagctacatctccggcgccggtgataataaaagcaacaaaagttttgcaatctttccaaagatttttgaggatgatcatattaagagtcaatgcagtgtcttcccaagaattaagatctcgcaaagtaacaatatccacgatgcctccacgtgtaattctccggccataaccgtctcctctgccgccgtagcagcttcgccgtggggcatgatcaacgttaataccactaacagtccaagaaactgtttacttgtcgataataataacaacacgtcatcatgctcacaggttcagatctcttcttcccctcggaatctcggaattaagagaaggaagagccaggcaaagaaagtggtgtgcataccggctccagccgctatgaacagccggtccagtggagaagttgttccgtctgatctatgggcttggcgaaagtacggtcaaaaacctatcaaaggttctccttatccaaggggttactacagatgtagcagctcaaaaggttgttcagctaggaaacaagtcgaacgtagccgcactgatccaaacatgttagtcattacttacacctctgagcataaccacccatggcctactcaacgcaacgctctcgcaggttccactcgttcctcttcctcctcctctttaaacccttcttccaaatcctcaaccgcagccgccactacttctccctcatccagagttttccaaaacaacagcagcaaagacgaacccaataactccaacttgccttcctcttccactcatcctccttttgacgccgccgcaattaaggaggagaacgtggaagagcgtcaggaaaagatggagttcgattataatgacgttgaaaatacctatagaccggagttgttgcaagagtttcaacatcagccggaggatttctttgccgatctcgacgagcttgagggagattctttgactatgttgctctctcacagtagcggcggaggcaacatggaaaacaaaacgacgattccagacgtttttagtgatttctttgacgacgacgagtcctcaaggtcgttataaatattgttgttaatgtatacatagaaatgaaattattcatgtaattcgttttgtgttaaatgacggtatttgcctttgca

SEQ ID NO: 106 - protein, 436 aa, Arabidopsis thaliana
  G196
MCSVFEFQDMDNFQGDLTDVVRGIGSGHVSPSPGPPEGPSPSSMSPPPTSDLHVEFPSAATSASCLANPFGDPFVSMKDPLIHLPASYISGAGDNKSNKSFAIFPKIFEDDHIKSQCSVFPRIKISQSNNIHDASTCNSPAITVSSAAVAASPWGMINVNTTNSPRNCLLVDNNNNTSSCSQVQISSSPRNLGIKRRKSQAKKVVCIPAPAAMNSRSSGEVVPSDLWAWRKYGQKPIKGSPYPRGYYRCSSSKGCSARKQVERSRTDPNMLVITYTSEHNHPWPTQRNALAGSTRSSSSSSLNPSSKSSTAAATTSPSSRVFQNNSSKDEPNNSNLPSSSTHPPFDAAAIKEENVEERQEKMEFDYNDVENTYRPELLQEFQHQPEDFFADLDELEGDSLTMLLSHSSGGGNMENKTTIPDVFSDFFDDDESSRSL

SEQ ID NO: 107 - DNA, 825 bp, Arabidopsis thaliana
  G197
atgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgttttggattcgggaacggcaaggagtgtagctgtaataatgtgaaatgtcaaacagaggacagtagtagcagcagttattcttcaaccgacattagtagtagcattggttatgacttcttgggtctaaacaacactagggttttggattttagcactttggaaatgaaatga

SEQ ID NO: 108 - protein, 274 aa, Arabidopsis thaliana
  G197
MGRSPCCEKDHTNKGAWTKEEDDKLISYIKAHGEGCWRSLPRSAGLQRCGKSCRLRWINYLRPDLKRGNFTLEEDDLIIKLHSLLGNKWSLIATRLPGRTDNEIKNYWNTHVKRKLLRKGIDPATHRPINETKTSQDSSDSSKTEDPLVKILSFGPQLEKIANFGDERIQKRVEYSVVEERCLDLNLELRISPPWQDKLHDERNLRFGRVKYRCSACRFGFGNGKECSCNNVKCQTEDSSSSSYSSTDISSSIGYDFLGLNNTRVLDFSTLEMK

SEQ ID NO: 109 - DNA, 1089 bp, Arabidopsis thaliana
  G198
atggcaaggtcaccttgttgcgagaagaacggactcaagaaagggccatggacatctgaagaagaccagaagcttgttgactatatccagaaacatggttatggtaactggagaaccctccccaaaaatgccggtacgtgtttgcaaagatgtggcaaaagttgtaggttaaggtggactaattatctccgaccagatataaaacgaggaagattctcttttgaggaagaagaagccattattcagcttcatagcttcttaggaaacaagtggtctgcgattgcggcgcgtttgccaggaagaacagataatgagatcaagaacttttggaacactcatataagaaagaagctacttagaatggggattgatccagtgactcacagtccacgactcgatctcctcgatatctcatccatcttagcttcatctctatacaattcatcttcacatcacatgaacatgtcaagactcatgatggatactaatcgtcgtcatcagcaacaacatccattggttaaccccgagatactcaagcttgcgacctctatattctctcaaaaccaaaaccaaaaccacaaccaaaatcaaaaccaaaaccaaaacctcgtggtggatcatgagaagcaaacagtttatcatcatcatgatgttaaccaaaccggagtaaaccaataccaaaccgaccaatatttcgagaacgcgattactcaagaactccaatcttccatgccaccattccccaatgaagctcatcagtttaacgacatggatcatcacttcaatggttttggagaacaaaatcttgtttcaacttctactacgtcagtccaagattgctataatccgtcattcaacgattattcaagttcaaattttgtcttagatcattcttattcggatcagagcttcaacttcgcaaattcggtcttaaacacgccatcctcgagcccgagcccgactacgttaaactcgagttacatcaatagtagcagttgcagcactgaggatgaaatagaaagctattgcagtaatctcatgaagtttgatattcccgatttcttggacgttaatggttttattatataa

SEQ ID NO: 110 - protein, 362 aa, Arabidopsis thaliana
  G198
MARSPCCEKNGLKKGPWTSEEDQKLVDYIQKHGYGNWRTLPKNAGTCLQRCGKSCRLRWTNYLRPDIKRGRFSFEEEEAIIQLHSFLGNKWSAIAARLPGRTDNEIKNFWNTHIRKKLLRMGIDPVTHSPRLDLLDISSILASSLYNSSSHHMNMSRLMMDTNRRHQQQHPLVNPEILKLATSIFSQNQNQNHNQNQNQNQNLVVDHEKQTVYHHHDVNQTGVNQYQTDQYFENAITQELQSSMPPFPNEAHQFNDMDHHFNGFGEQNLVSTSTTSVQDCYNPSFNDYSSSNFVLDHSYSDQSFNFANSVLNTPSSSPSPTTLNSSYINSSSCSTEDEIESYCSNLMKFDIPDFLDVNGFII

SEQ ID NO: 111 - DNA, 1292 bp, Arabidopsis thaliana
  G201
atgtcaagaaagccatgttgtgtgggagaaggactgaagaaaggagcatggactgccgaagaagacaagaaactcatctcttacattcatgaacacggtggaggaggctggcgtgacattccccaaaaagctggactaaaacgatgtggaaagagttgtagattgcgatgggctaactatttgaaacctgacatcaagagaggagagtttagctatgaggaggaacagattatcatcatgctacacgcttctcgcggcaacaagtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacaatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattatgacgacaagaacttcatatgatccgttgattgcttaccggactagagttgaccggttaatgtcatatggttctcttagatatttgtcaagttatagtaaaggtccactatagggtcactatatattaatattcagtaatggattctcttagttagagaaccttgtgatgccgtggatcaattagtatttgatttgcgggagacacgagttttttttccttctattgttgtttgtggatttacgtactataaataataaataaaacacccatttgattgcaaaaaaaaaaaaaaaaaaaaaaa

SEQ ID NO: 112 - protein, 336 aa, Arabidopsis thaliana
  G201
MSRKPCCVGEGLKKGAWTAEEDKKLISYIHEHGGGGWRDIPQKAGLKRCGKSCRLRWANYLKPDIKRGEFSYEEEQIIIMLHASRGNKWSVIARHLPKRTDNEIKNYWNTHLKKLLIDKGIDPVTHKPLAYDSNPDEQSQSGSISPKSLPPSSSKNVPEITSSDETPKYDASLSSKKRCFKRSSSTSKLLNKVAARASSMGTILGASIEGTLISSTPLSSCLNDDFSETSQFQMEEFDPFYQSSEHIIDHMKEDISINNSEYNFSQFLEQFSNNEGEEADNTGGGYNQDLLMSDVSSTSVDEDEMMQNITGWSNYLLDHSDFNYDTSQDYDDKNFI

SEQ ID NO: 113 - DNA, 1046 bp, Arabidopsis thaliana
  G203
ttctcttcccttaatccctaaacccagaaacatgaatccaaatctccttgagaaagatctaagaggtaaggaaactacaaatgggtcaataagatacaaagaagcaaacaacttcagatctctaccaaactcacacactgctgcttgtaaaacttcactcaacaacccctctatctctagaaaccatcctcacaacaaatcagcctcagtcttggagtcggaagatgaacatgggaacgagagaggtgaaaacgaaaagagtttaagaatgaggggcaaaagtggaattaacacaaaagtatgctcacgaggacactggagaccaacagaagatgctaaactcaaggagcttgttgcccagtttggtccccaaaactggaacttgatttctaaccaccttcttggtagatcaggcaagagttgtagattgagatggtttaaccaactagacccaaggattaacaagagggccttcacggaggaagaagagtttaggctgttagcagctcatcgagcctatggcaacaagtgggctttgatctctcgtctctttccaggtcgtaccgataacgctgtcaagaaccattggcacgtcatcatggctcgacggactagagaaagccaaagacaacgtcaacagcctcctccgacgttgtcaagagacgctgaaatgacggtttcgtcctcttgccgctacaatcaaggtaagttcatcaatgaagaagatgacgacgacgatgtgtcagctgtctctacttgtacgacggagctctctctcactccgccttcttcagcttaccagcctcgcttctttaattacgatagtacccttgcatcaggcaaagatggtcagtgtgtgcagagagcagaagtaaatggcatatatggtaaaaagatggaccatcaaaatcaccacaccatctcagtcagtgaaagaaaggtggagatgaagatgaggagtggctattactactttgattttcttggagttggagcttcctgattaattagttgcagagctagggttcaagcggccgcgcgcgcgc

SEQ ID NO: 114 - protein, 323 aa, Arabidopsis thaliana
  G203
MNPNLLEKDLRGKETTNGSIRYKEANNFRSLPNSHTAACKTSLNNPSISRNHPHNKSASVLESEDEHGNERGENEKSLRMRGKSGINTKVCSRGHWRPTEDAKLKELVAQFGPQNWNLISNHLLGRSGKSCRLRWFNQLDPRINKRAFTEEEEFRLLAAHRAYGNKWALISRLFPGRTDNAVKNHWHVIMARRTRESQRQRQQPPPTLSRDAEMTVSSSCRYNQGKFINEEDDDDDVSAVSTCTTELSLTPPSSAYQPRFFNYDSTLASGKDGQCVQRAEVNGIYGKKMDHQNHHTISVSERKVEMKMRSGYYYFDFLGVGAS

SEQ ID NO: 115 - DNA, 741 bp, Arabidopsis thaliana
  G206
atggggagaagaccatgctgtgagaagataggattgaagaaagggccatggagtgctgaagaagatcgaatcttgatcaattatattagtctccatggccatcccaattggagagctctccctaaactagccgggctacttcggtgcggaaaaagttgcaggcttcgttggattaattatttgagaccagacatcaaacgtggcaatttcactcctcatgaagaagatactatcatcagcttacatcaactcttaggcaacagatggtctgcgatagctgcaaaattgcctggacgaacagacaacgaaattaaaaatgtttggcacactcatttaaagaaaagactccaccacagtcaagatcaaaacaacaaggaagatttcgtctctactacagctgcggagatgccaacctctccgcaacaacaatctagtagtagtgccgacatttcagcaattacaacattgggaaacaacaatgacatctccaatagcaacaaagactccgcgacgtcatccgaagatgttcttgcaattatagatgagagcttttggtcagaagtggtattgacggactgtgacatttcaggaaatgagaagaatgagaaaaagatagagaattgggagggctcactagatagaaacgataagggatataaccatgacatggagttttggtttgaccatctcactagtagtagttgtataattggagaaatgtccgacatttctgagttttga

SEQ ID NO: 116 - protein, 246 aa, Arabidopsis thaliana
  G206
MGRRPCCEKIGLKKGPWSAEEDRILINYISLHGHPNWRALPKLAGLLRCGKSCRLRWINYLRPDIKRGNFTPHEEDTIISLHQLLGNRWSAIAAKLPGRTDNEIKNVWHTHLKKRLHHSQDQNNKEDFVSTTAAEMPTSPQQQSSSSADISAITTLGNNNDISNSNKDSATSSEDVLAIIDESFWSEVVLTDCDISGNEKNEKKIENWEGSLDRNDKGYNHDMEFWFDHLTSSSCIIGEMSDISEF

SEQ ID NO: 117 - DNA, 1107 bp, Arabidopsis thaliana
  G207
aaaagatctgtttcaatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgatcctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggaggaggaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagttttggtttagggttaaaacttgaatcgattggggattttcaagagcattcatttttggggtttatggtaaaattaaaaacaaaaacaaaatgtacagaggaattaaaatttctatggaataatcttaaatctcaaatatttgttacttgttttggtgattcataaccaaaatcaaa

SEQ ID NO: 118 - protein, 304 aa, Arabidopsis thaliana
  G207
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDPAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGVITPKVE

SEQ ID NO: 119 - DNA, 764 bp, Arabidopsis thaliana
  G208
cttcttcattcaccatgggaagatctccttgttgtgaaaaagctcacacaaacaaaggagcttggactaaagaagaagatcaacgtctcgtagattatatccgtaatcacggtgaaggttgttggcgttctcttcctaaatccgctggattgttgcgttgtggtaaaagttgtagattgagatggattaattaccttcgtcctgatcttaaacgtggtaattttactgatgatgaagatcaaatcatcatcaaactccatagcttactcggtaacaaatggtcattgatagctggaagattaccaggaagaacagataacgaaataaagaattattggaacactcatattaagaggaagcttcttagtcacggtattgatccacaaactcatcgtcagattaacgaatccaaaacggtgtcgtctcaagttgttgttcctattcaaaacgatgccgttgagtattctttttccaatttagccgttaaaccgaagacggaaaattcctccgataacggagcttcgactagcggcacgacgacggacgaggatctccggcagaatggggagtgttattatagtgataattcaggacatataaagctgaatttggatttaactcttgggtttggatcctggtcgggtcggatagtcggagtcgggtcatcggctgattctaaaccgtggtgcgacccggtgatggaggcgcgtttgtcactgttgtaataatttgtcaaaaaaatcccaaaaaatgggtttgttaaa

SEQ ID NO: 120 - protein, 236 aa, Arabidopsis thaliana
  G208
MGRSPCCEKAHTNKGAWTKEEDQRLVDYIRNHGEGCWRSLPKSAGLLRCGKSCRLRWINYLRPDLKRGNFTDDEDQIIIKLHSLLGNKWSLIAGRLPGRTDNEIKNYWNTHIKRKLLSHGIDPQTHRQINESKTVSSQVVVPIQNDAVEYSFSNLAVKPKTENSSDNGASTSGTTTDEDLRQNGECYYSDNSGHIKLNLDLTLGFGSWSGRIVGVGSSADSKPWCDPVMEARLSLL

SEQ ID NO: 121 - DNA, 750 bp, Arabidopsis thaliana
  G211
atgatgtcatgtggtgggaagaagccagtgtctaagaaaacaacgccgtgttgcacgaagatggggatgaagagaggaccatggacggtggaggaagacgagattcttgtgagcttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggtggacaaaagtaccctctagagcctatttctagttctcatactgatgataccactgttaatggcggggatggagatagcaagaacagtatcaatgtctttggtggtgaacacggctacgaagactttggtttctgctacgacgacaagttctcatcgtttcttaattcgctcatcaacgatgttggtgatccttttggtaatattatcccaatatctcaacctttgcagatggatgattgtaaggatgggattgttggagcgtcgtcttctagcttaggacatgactag

SEQ ID NO: 122 - protein, 249 aa, Arabidopsis thaliana
  G211
MMSCGGKKPVSKKTTPCCTKMGMKRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTHKPLDANNIHKPEEEVSGGQKYPLEPISSSHTDDTTVNGGDGDSKNSINVFGGEHGYEDFGFCYDDKFSSFLNSLINDVGDPFGNIIPISQPLQMDDCKDGIVGASSSSLGHD

SEQ ID NO: 123 - DNA, 687 bp, Arabidopsis thaliana
  G212
atgagaataaggagaagagatgaaaaagagaatcaagaatacaagaaaggtttatggacagttgaagaagacaacatccttatggactatgttcttaatcatggcactggccaatggaaccgcatcgtcagaaaaactgggctaaagagatgtgggaaaagttgtagactgagatggatgaattatttgagccctaatgtgaacaaaggcaatttcactgaacaagaagaagacctcattattcgtctccacaagctcctcggcaatagatggtctttgatagctaaaagagtaccgggaagaacagataaccaagtcaagaactactggaacactcatctcagcaaaaaactcgtcggagattactcctccgccgtcaaaaccaccggagaagacgacgactctccaccgtcattgttcatcactgccgccacaccttcttcttgtcatcatcaacaagaaaatatctacgagaatatagccaagagctttaacggcgtcgtatcagcttcgtacgaggataaaccaaaacaagaactggctcaaaaagatgtcctaatggcaactactaatgatccaagtcactattatggcaataacgctttatgggttcatgacgacgattttgagcttagttcactcgtaatgatgaattttgcttctggtgatgttgagtactgcctttag

SEQ ID NO: 124 - protein, 228 aa, Arabidopsis thaliana
  G212
MRIRRRDEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSPPSLFITAATPSSCHHQQENIYENIAKSFNGVVSASYEDKPKQELAQKDVLMATTNDPSHYYGNNALWVHDDDFELSSLVMMNFASGDVEYCL

SEQ ID NO: 125 - DNA, 1070 bp, Arabidopsis thaliana
  G213
accacgcgtccgttcactaaagaaaaaaaaactaagaagtaataatgagtttgtggggagggatgggaggaggatggggaatggtagaagaaggttggagaaaaggaccttggactgctgaagaagaccgccttttgatcgattatgtgcagcttcacggtgaagggcgatggaactctgttgcgaggctccgggggttgaagagaaatgggaaaagctgcaggttaagatgggttaactacctaagaccagacctcaagagaggacaaatcactcctcatgaagaaaccattatccttgagttacatgctaagtggggcaataggtggtccacgattgcacgtagtttaccgggaagaacagacaacgaaatcaagaactattggcgaacccatttcaagaagaagacgaagctccaactaacagtgcggagaagacaaagaaccgaatcttgaagaggcaacaatttcagcagcaaagacaaatggagttgcagcaagaacaacagttgcttcaattcaatcaaatcgacatgaaaagatcatgtcgttactagatgacgacaacaacatggtgataacaccttcagcagtagcagtagtggcgaaagtggagcattatatgtacctcatcagatcacacattcaacaacaacttctggttgtgaaccaaatagtaacgggtattaccggtggttccggtaacaatacctgaggctaatgtgaatgaagataacgctatttgggacggtttatggaatctggattttgaaggacaaggaagttttggtggcgctgcttgtgccccaaggaagcactatttccagaacatggtcattcccttctgttaacttgacctttaaaatatcttatctgccggataatgaaagagaaaaacttgaccgacaacttaggtcgagtttgagtttagtttgtggtttcatttatttgagatttttggttttaacatatataattttggtatgaattgtgtgtgatgtaagaagctcatttggttttatcataaaagagtgatgtagtagaatttaagaaagtaaaaaaaaaaaaaaa

SEQ ID NO: 126 - protein, 136 aa, Arabidopsis thaliana
  G213
MSLWGGMGGGWGMVEEGWRKGPWTAEEDRLLIDYVQLHGEGRWNSVARLRGLKRNGKSCRLRWVNYLRPDLKRGQITPHEETIILELHAKWGNRWSTIARSLPGRTDNEIKNYWRTHFKKKTKLQLTVRRRQRTES

SEQ ID NO: 127 - DNA, 2240 bp, Arabidopsis thaliana
  G214
tgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaagtggaattttgtaaagagaagatctgaagttgtgtagaggagcttagtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatgagactctattttcatctgatctgttgtttgtactctgtttttaagttttcaagaccactgctacattttctttttcttttgaggcctttgtatttgtttccttgtccatagtcttcctgtaacatttgactctgtattattcaacaaatcataaactgtttaatctttttttttcca

SEQ ID NO: 128 - protein, 608 aa, Arabidopsis thaliana
  G214
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 129 - DNA, 1110 bp, Arabidopsis thaliana
  G215
atgactcgtcggtgttcgcattgtagcaacaatgggcacaattcacgcacgtgtccaacgcgtgggtctggttcctcctccgccgtgaagttatttggtgtgaggttaacggatggctcgattattaaaaagagtgcgagtatgggtaatctctcggcattggctgttgcggcggcggcggcaacgcaccaccgtttatctccgtcgtctcctctggcgacgtcaaatcttaatgattcgccgttatcggatcatgcccgatactctaatttgcatcataatgaagggtatttatctgatgatcctgctcatggttctgggtctagtcaccgtcgtggtgagaggaagagaggtgttccttggactgaagaggaacatagactattcttagtcggtcttcagaaactcgggaaaggagattggcgcggtatttcgagaaactatgtaacgtcaagaactcctacacaagtggctagtcatgctcaaaagtattttattcgacatactagttcaagccgcaggaaaagacggtctagcctcttcgacatggttacagatgagatggtaaccgattcatcgccaacacaggaagagcagaccttaaacggttcctctccaagcaaggaacctgaaaagaaaagctaccttccttcacttgagctctcactcaataataccacagaagctgaagaggtcgtagccacggcgccacgacaggaaaaatctcaagaagctatagaaccatcaaatggtgtttcaccaatgctagtcccgggtggcttctttcctccttgttttccagtgacttacacgatttggctccctgcgtcacttcacggaacagaacatgccttaaacgctgagacttcttctcagcagcatcaggtcctaaaaccaaaacctggatttgctaaagaacgtgtgaacatggacgagttggtcggtatgtctcagcttagcataggaatggcgacaagacacgaaaccgaaacttccccttccccgctatctttgagactagagccctcaaggccatcagcgtttcactcgaatggctcggttaatggtgcagatttgagtaaaggcaacagcgcgattcaggctatctaa

SEQ ID NO: 130 - protein, 369 aa, Arabidopsis thaliana
  G215
MTRRCSHCSNNGHNSRTCPTRGSGSSSAVKLFGVRLTDGSIIKKSASMGNLSALAVAAAAATHHRLSPSSPLATSNLNDSPLSDHARYSNLHHNEGYLSDDPAHGSGSSHRRGERKRGVPWTEEEHRLFLVGLQKLGKGDWRGISRNYVTSRTPTQVASHAQKYFIRHTSSSRRKRRSSLFDMVTDEMVTDSSPTQEEQTLNGSSPSKEPEKKSYLPSLELSLNNTTEAEEVVATAPRQEKSQEAIEPSNGVSPMLVPGGFFPPCFPVTYTIWLPASLHGTEHALNAETSSQQHQVLKPKPGFAKERVNMDELVGMSQLSIGMATRHETETSPSPLSLRLEPSRPSAFHSNGSVNGADLSKGNSAIQAI

SEQ ID NO: 131 - DNA, 1104 bp, Arabidopsis thaliana
  G216
atgaacggagaaatctctcgtccgccggagctaatatcgtcccggaatccttgcaagagttttgaaaatgcaatacacaaagcagttgaggcagagctcgccgagctagcgaaaagcgacgcgaacggcggcggaaagagtaaagtgaaaggaccttggttgccggagcaagatgaggctctcacgaggcttgtgaaaatgtgtgggccgaggaactggaatctaatctcccgtggaatcccaggtcgctctggtaaatcttgccgattacgttggtgtaatcagctcgatcctatcctcaaacgaaaacctttctctgatgaggaggagcatatgataatgtctgcacaggcggttcttgggaacaaatggtctgtgattgctaaactcttacctgggagaacagataatgccattaagaatcattggaactctaatcttagacgtaaaccagcagaacaatggaagattcctctattgatgtctaatacagagatagtatatcaactgtatccatcaatggtcagaaggatatcaaacgcatcccccaaagaacatctacctcaagaagaagaaaccggtgtattaagtgatgataaaatggatgatgaagcaaaggagcctcctcgggagcaaaatagtaaaactggtgtttatcgtccagtggctcgaatgggtgctttcagtgtctgtaaaccaggatacatggctccatgtgagggacctttggttcaagcatcaagacctgactcattggctggtaaatttcttcagtctctttgttatgatcctattatcccttcaaaatgcggtcacggttgctgcaaccatcaagacagcacaacactgtcatcatcgtcggtgctgggatcagagtttgtggattatgaggaacattcttctgcagagttagataaagaattgatctctatatcaaatgacctgaacaatactgcttggattaggagtgggaaggaagctgaacagagtttgaaggctgatgatcagtttcgtcgtgagtatgctcactcgaaatttagtggaatggtaaacaatggtgtatcaagtcagatggtgagacaagatttaagggctttgagctaa

SEQ ID NO: 132 - protein, 367 aa, Arabidopsis thaliana
  G216
MNGEISRPPELISSRNPCKSFENAIHKAVEAELAELAKSDANGGGKSKVKGPWLPEQDEALTRLVKMCGPRNWNLISRGIPGRSGKSCRLRWCNQLDPILKRKPFSDEEEHMIMSAQAVLGNKWSVIAKLLPGRTDNAIKNHWNSNLRRKPAEQWKIPLLMSNTEIVYQLYPSMVRRISNASPKEHLPQEEETGVLSDDKMDDEAKEPPREQNSKTGVYRPVARMGAFSVCKPGYMAPCEGPLVQASRPDSLAGKFLQSLCYDPIIPSKCGHGCCNHQDSTTLSSSSVLGSEFVDYEEHSSAELDKELISISNDLNNTAWIRSGKEAEQSLKADDQFRREYAHSKFSGMVNNGVSSQMVRQDLRALS

SEQ ID NO: 133 - DNA, 1050 bp, Arabidopsis thaliana
  G220
atgggaagatcaccgtgttgcgatcaagacaaaggcgtgaagaaaggaccgtggctgccagaagaagatgataagctcactgcttatataaacgagaatggttatgggaattggcggtcgcttcctaagctcgctggacttaaccgctgtggcaagagctgtcggctccggtggatgaattatctccggcctgatatccggagaggcaaattttccgatggagaagagagtactatcgttagactccatgccctccttggcaacaaatggtcgaaaattgcgggtcatcttccaggaagaacagataatgaaattaaaaactattggaacactcatatgaggaagaagttattgcaaatggggattgatccagtgacgcacgagccaagaaccaacgatcttagccctatcctcgatgtttctcaaatgctcgcggcagcaatcaacaatggccaatttggtaacaataacctcctcaacaataacaccgctttggaagatattcttaaactccaattgatccataaaatgcttcaaatcataacccccaaagccataccaaacatcagtagcttcaagaccaatttactgaatcctaaaccagaaccggtagtcaatagcttcaataccaattcagtgaatcctaaaccggatcccccggctggtcttttcataaaccaaagtggaatcactcctgaggccgcctcggatttcattccatcttatgaaaatgtttgggatggttttgaagataaccagcttcctggtttggttacggtttctcaagagagtttaaatacagcaaaaccgggtaccagtacgaccaccaaggtaaatgatcatatcagaaccggtatgatgccgtgttactatggtgatcaactactagaaaccccatctactggttcggtatcggtctctcccgagacaaccagtttgaaccatcccagtacagctcaacactcatccggttcagatttcctagaggactgggagaagtttcttgatgatgaaacaagtgattcttgctggaaaagtttcttagagtaa

SEQ ID NO: 134 - protein, 349 aa, Arabidopsis thaliana
  G220
MGRSPCCDQDKGVKKGPWLPEEDDKLTAYINENGYGNWRSLPKLAGLNRCGKSCRLRWMNYLRPDIRRGKFSDGEESTIVRLHALLGNKWSKIAGHLPGRTDNEIKNYWNTHMRKKLLQMGIDPVTHEPRTNDLSPILDVSQMLAAAINNGQFGNNNLLNNNTALEDILKLQLIHKMLQIITPKAIPNISSFKTNLLNPKPEPVVNSFNTNSVNPKPDPPAGLFINQSGITPEAASDFIPSYENVWDGFEDNQLPGLVTVSQESLNTAKPGTSTTTKVNDHIRTGMMPCYYGDQLLETPSTGSVSVSPETTSLNHPSTAQHSSGSDFLEDWEKFLDDETSDSCWKSFLE

SEQ ID NO: 135 - DNA, 1364 bp, Arabidopsis thaliana
  G222
ctcattttataataattttctccatcttcttccttcctcttcaagcttatagaacctccaagaaccataaaactctctctgcaacaatctatactttcttcattacttttataaaaaatgggaagacattcttgttgttttaagcagaagctaagaaaaggcctttggtctcctgaagaagatgagaaacttctcaattacatcactagacatggtcatggctgttggagttctgtccctaaactcgcaggtttgcaaagatgtggaaagagttgtagacttaggtggataaattatttgagaccagatttaaagagaggagctttctctcaagacgaagaaagcttgatcattgagctccatgctgcattaggcaacagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatcttcagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacacggtgtttgatcagagcctttagattattaacatgtgttatagagagtttcattttctattcatattcatagacctgagtttattgattgatccatacatttgttatgcttgtgtgtaaagtatgtatatggtttttgatttatgtaaattttctgctcgagtgaatttttttggtgctaagatgtagttctttattccaaaaaaaaaaaa

SEQ ID NO: 136 - protein, 352 aa, Arabidopsis thaliana
  G222
MGRHSCCFKQKLRKGLWSPEEDEKLLNYITRHGHGCWSSVPKLAGLQRCGKSCRLRWINYLRPDLKRGAFSQDEESLIIELHAALGNRWSQIATRLPGRTDNEIKNFWNSCLKKKLRRKGIDPTTHKPLITNELQSLNVIDQKLTSSEVVKSTGSINNLHDQSMVVSSQQGPWWFPANTTTTNQNSAFCFSSSNTTTVSDQIVSLISSMSTSSSPTPMTSNFSPAPNNWEQLNYCNTVPSQSNSIFSAFFGNQYTEASQTMNNNNPLVDQHHHHQDMKSWASEILHYTEHNQSSETVIEAEVKPDIANYYWRSASSSSSPNQEAATLLHDANVEVYGKNLQKLNNTVFDQSL

SEQ ID NO: 137 - DNA, 1164 bp, Arabidopsis thaliana
  G224
atgatttacgtagttcccgatctacttgaagaaattttccttggattgcctttaaaatcaatcctcagattcaaaaccgtctcaaaacaatggagatcaatcctggaatcgaagagtttcgcggagaggcgtttgaacgttgagaagaaggagaaaattctggctgttggagaccggactgagttgggattcgaaggtgaggaagagatccagatggtctatttacactgcgatattgacgccacacgaccctctctgacatgtgagggtttggtgtgtatcccagcaccaggttggatcaacgttttgaacccatcgaccagacaactccggagatttccttgtagccctaatcatcacgtgccctctgatcgtattcgttttcagttcagagacgaactatacctcacttcctttccggggaattgggagatgggatttggtagagacaaatttaatggtagctataaagtggtgaggatgtgttttagtcctgtggaaaaatgcgaggttcttgatgttgaaactggggaatggagtgaactgaatccacctcctaacgatattgacgtgggaaggaagtcacgtttcggaatcctagccttggatcttcacacactagagttccacaatgtttccgttccatctacgtgttgcaccatgagtgcccagatggtgaaccttgatgaccgtctagccataactaaaacaaacggtgcgccagaatgggagctagagatactgagcctgatggatgtagacaaagaaatatggagcaagacttactccataactttagccagtatcattattaaccacccatgggagtctagttggttcacggtgttgacggtttctaagctagggaatcttgtcttttgtgacaatcacaagcggttgtttaaatataataccgagacaaatgagatttgctgtctctcctcagatatttctgttatatctccttatctcgaggatttggtaccacttcgtttggactcaggacatgatcatcgggattacaaaatcaggacatctagttgcggattgttttcgaagcatccggaggcagggttattcaaggagatcatcacttttcggtttgtgtttgccactctagttctagttggttatcagtattatagatcattaaaattcaagtag

SEQ ID NO: 138 - protein, 387 aa, Arabidopsis thaliana
  G224
MIYVVPDLLEEIFLGLPLKSILRFKTVSKQWRSILESKSFAERRLNVEKKEKILAVGDRTELGFEGEEEIQMVYLHCDIDATRPSLTCEGLVCIPAPGWINVLNPSTRQLRRFPCSPNHHVPSDRIRFQFRDELYLTSFPGNWEMGFGRDKFNGSYKVVRMCFSPVEKCEVLDVETGEWSELNPPPNDIDVGRKSRFGILALDLHTLEFHNVSVPSTCCTMSAQMVNLDDRLAITKTNGAPEWELEILSLMDVDKEIWSKTYSITLASIIINHPWESSWFTVLTVSKLGNLVFCDNHKRLFKYNTETNEICCLSSDISVISPYLEDLVPLRLDSGHDHRDYKIRTSSCGLFSKHPEAGLFKEIITFRFVFATLVLVGYQYYRSLKFK

SEQ ID NO: 139 - DNA, 584 bp, Arabidopsis thaliana
  G225
ctctctctctcactcttttcttttccgagaacccaacaaaaaaaaagctactattaatccttcccctcgtgaggaaatcatttcttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaagaggtgagtagtatcgaatgggaagctgtgaagatgtcagaagaagaagaagatctcatttctcggatgtataaactcgttggcgacaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattactattttggaatgtataattatctatatatataagaagaaaaaattgcttaggaattt

SEQ ID NO: 140 - protein, 94 aa, Arabidopsis thaliana
  G225
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 141 - DNA, 407 bp, Arabidopsis thaliana
  G226
ccagtagttatggataataccaaccgtcttcgtcttcgtcgcggtcccagtcttaggcaaactaagttcactcgatcccgatatgactctgaagaagtgagtagcatcgaatgggagtttatcagtatgaccgaacaagaagaagatctcatctctcgaatgtacagacttgtcggtaataggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaaagaaatcaaaataaaagctttcaatcataaaagtagaacaaatcttgaatgtcttctca

SEQ ID NO: 142 - protein, 112 aa, Arabidopsis thaliana
  G226
MDNTNRLRLRRGPSLRQTKFTRSRYDSEEVSSIEWEFISMTEQEEDLISRMYRLVGNRWDLIAGRVVGRKANEIERYWIMRNSDYFSHKRRRLNNSPFFSTSPLNLQENLKL

SEQ ID NO: 143 - DNA, 989 bp, Arabidopsis thaliana
  G227
gtaccgtcgacgatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtggttatacggcggagctgtttccggttagaaaggaagagcaagtggaagtagaagaagaagaagcgaaggggatatctggtggattcggtggtgagttcatgacggtggttcaggagatgataaggacggaggtgaggagttacatggcggatttacagcgaggaaacgtcggtggtagtagttctggcggcggaggtggcggttcgtgtatgccacaaagtgtaaacagccgtcgtgttgggtttagagagtttatagtgaaccaaatcggaattgggaagatggagtaggcggcc

SEQ ID NO: 144 - protein, 320 aa, Arabidopsis thaliana
  G227
MSNPTRKNMERIKGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRKCSVEGQSCDFGGNGGYDGNLGEEQPLKRTASGGGGVSTGLYMSPGSPSGSDVSEQSSGGAHVFKPTVRSEVTASSSGEDPPTYLSLSLPWTDETVRVNEPVQLNQNTVMDGGYTAELFPVRKEEQVEVEEEEAKGISGGFGGEFMTVVQEMIRTEVRSYMADLQRGNVGGSSSGGGGGGSCMPQSVNSRRVGFREFIVNQIGIGKME

SEQ ID NO: 145 - DNA, 864 bp, Arabidopsis thaliana
  G228
atggtgactgtaaaccctagccaagctcattgtttgcctatgaaaatgagtctaccgggtttcaatactcttccccacacggcaacaacgataccggtttccatacggagcaataggacgatgtcgttttttgaggatccaacaaagaaggttagaaagccttacactatcaccaaatctagagagaactggacggagcaagaacacgacaagttccttgaagcccttcatctatttgaccgggattggaagaaaataaaggcctttgttggatcaaaaacagtgatacagatacgaagccacgcacagaagtactttctcaaagttcagaagaatgggactaaagaacatctcccacctcctcgaccaaagaggaaagccaatcacccatatccacaaaaagctcctaaatttactctttcttcttcaaacgcattatttcaacatgactacttatacaacactaattcacatccggtgattagcaccacccgtaagcatggattagtgcattgcgatgttagtataccaagttctgttatcaaagaggaatttggtgtctcagagaactgttgcagcactagtagtagtagagataagcagaggactagaatcgttacagagacaaatgaccaagaaagttgtggaaagccacatagagtggcgccaaatttcgctgaagtttacaattttataggaagtgtgtttgatcctaaaacaacaggtcatgtcaagagattaaaggaaatggatccaataaatcttgagacggttctcttactgatgaaaaatttatctgtaaacctgacgagtcccgagtttgatgaacaacggaagttgatatcatcttacaacgccagttag

SEQ ID NO: 146 - protein, 287 aa, Arabidopsis thaliana
  G228
MVTVNPSQAHCLPMKMSLPGFNTLPHTATTIPVSIRSNRTMSFFEDPTKKVRKPYTITKSRENWTEQEHDKFLEALHLFDRDWKKIKAFVGSKTVIQIRSHAQKYFLKVQKNGTKEHLPPPRPKRKANHPYPQKAPKFTLSSSNALFQHDYLYNTNSHPVISTTRKHGLVHCDVSIPSSVIKEEFGVSENCCSTSSSRDKQRTRIVTETNDQESCGKPHRVAPNFAEVYNFIGSVFDPKTTGHVKRLKEMDPINLETVLLLMKNLSVNLTSPEFDEQRKLISSYNAS

SEQ ID NO: 147 - DNA, 1209 bp, Arabidopsis thaliana
  G229
ttgtggtcagtggaataaacacatataaccgccggagaaaatgggaagagcgccatgttgcgagaaggtcggtatcaagagagggcggtggacggcggaggaggaccagattctctccaactacattcaatccaatggtgaaggttcttggagatctctccccaaaaatgccggattaaaaaggtgtggaaagagctgtagattgagatggataaactatctaagatcagacctcaagcgtggaaacataactccagaagaagaagaactcgttgttaaattgcattccactttgggaaacaggtggtcactaatcgcgggtcatctaccagggagaacagacaacgaaataaaaaattattggaactctcatctcagccgtaaactccacaacttcattaggaagccatccatctctcaagacgtctccgccgtaatcatggcgaacgcttcttcagcgccaccgccgccgcaggcaaaacgcagacttgggagaacgagtaggtccgctatgaaaccaaaaatccgcagaacaaaaactcgtaaaacgaagaaaacgtctgcaccaccggagcctaacgccgatgtagctggggctgataaagaagcattaatggtggagtcaagtggagccgaggctgagctaggacgaccatgtgactactatggagatgattgtaacaaaaatctcatgagcattaatggcgataatggagttttaacgtttgatgatgatatcatcgatcttttgttggacgagtcagatcctggccacttgtacacaaacacaacgtgcggtggtggtggggagttgcataacataagagactctgaaggagccagagggttctcggatacttggaaccaagggaatctcgactgtcttcttcagtcttgtccatctgtggagtcgtttctcaactacgaccaccaagttaacgacgcgtcgacggatgagtttatcgattgggattgtgtttggcaagaaggtagtgataataatctttggcatgagaaagagaatcccgactcaatggtctcgtggcttttagacggtgatgatgaggccacgatcgggaatagtaattgtgagaactttggagaaccgttagatcatgacgacgaaagcgctttggtcgcttggcttctgtcatgatgatattgattgatccgttatgtaatcttttttgtgcattcacagtttgaatc

SEQ ID NO: 148 - protein, 371 aa, Arabidopsis thaliana
  G229
MGRAPCCEKVGIKRGRWTAEEDQILSNYIQSNGEGSWRSLPKNAGLKRCGKSCRLRWINYLRSDLKRGNITPEEEELVVKLHSTLGNRWSLIAGHLPGRTDNEIKNYWNSHLSRKLHNFIRKPSISQDVSAVIMANASSAPPPPQAKRRLGRTSRSAMKPKIRRTKTRKTKKTSAPPEPNADVAGADKEALMVESSGAEAELGRPCDYYGDDCNKNLMSINGDNGVLTFDDDIIDLLLDESDPGHLYTNTTCGGGGELHNIRDSEGARGFSDTWNQGNLDCLLQSCPSVESFLNYDHQVNDASTDEFIDWDCVWQEGSDNNLWHEKENPDSMVSWLLDGDDEATIGNSNCENFGEPLDHDDESALVAWLLS

SEQ ID NO: 149 - DNA, 930 bp, Arabidopsis thaliana
  G230
atgtctggttcgacccggaaagaaatggatcggatcaaaggaccatggagtcctgaagaagacgatctgttacaatcgttggttcagaagcacggaccaaggaactggtctctgataagcaaatcaatccctggacgttccggtaaatcttgccgtctccgttggtgtaatcagctttctccggaggtagagcaccgtggattcacggcggaggaagatgatacgattatactagcgcacgctcggtttggtaacaagtgggcgacgattgcacggcttctcaatggtcgcactgataacgcgattaagaatcactggaactcaacgctgaagcggaaatgtagcggcggaggcggcggaggagaggaagggcagagttgtgatttcggtggtaatggagggtatgatggtaatttaactgatgaaaaaccgttaaaacggagggcgagtggtggaggaggagttgttgtggtgacggcgttaagtccaacgggatctgacgtcagcgagcaatcgcaatctagtggatctgttttaccggtttcttcttcttgtcatgtttttaaaccgacggcgagagctggtggagtggtgattgagtcatcatcgccggaggaggaggagaaagatccgatgacttgtttgaggttgtctttgccttgggtcaatgagtcaacaactccaccggagttgtttccggtgaagagagaagaagaagaagagaaggaaagagagatttctggacttggtggagattttatgacggtggtgcaggagatgattaagacggaggttaggagttacatggcggatttacagctaggaaacggcggaggagctggaggaggagcaagttcgtgtatggtgcaaggaactaatggtcgtaatgtagggtttagagagtttattggattaggtaggatcgagtag

SEQ ID NO: 150 - protein, 309 aa, Arabidopsis thaliana
  G230
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRRASGGGGVVVVTALSPTGSDVSEQSQSSGSVLPVSSSCHVFKPTARAGGVVIESSSPEEEEKDPMTCLRLSLPWVNESTTPPELFPVKREEEEEKEREISGLGGDFMTVVQEMIKTEVRSYMADLQLGNGGGAGGGASSCMVQGTNGRNVGFREFIGLGRIE

SEQ ID NO: 151 - DNA, 916 bp, Arabidopsis thaliana
  G231
ttccatatctcttccatttcgctctctatttcacatccccatataacataatatacaatcacacatatcatttctatatagtatttaatggggagacagccatgctgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctggcttaaaacgaggccttctctcgcatgatgaagaacaacttgtcatagatcttcatgctaatctcggcaataagtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactactaaagatgaggcctcttggagtgatagtaactttggtgttggtggaacattatatgaccacaatatctccggcgccgatgcagattttccgatatggtcaccggaaagaatcaatgacgagaagatgtttttggattattgtcaagactttggtgttcatgattttgggttttgactgttcaccattgacatattggcaacgc

SEQ ID NO: 152 - protein, 266 aa, Arabidopsis thaliana
  G231
MGRQPCCDKLGVKKGPWTVEEDKKLINFILTNGHCCWRALPKLAGLRRCGKSCRLRWTNYLRPGLKRGLLSHDEEQLVIDLHANLGNKWSKIASRLPGRTDNEIKNHWNTHIKKKLLKMGIDPMTHQPLNQEPSNIDNSKTIPSNPDDVSVEPKTTNTKYVEISVTTTEEESSSTVTDQNSSMDNENHLIDNIYDDDELFSYLWSDETTKDEASWSDSNFGVGGTLYDHNISGADADFPIWSPERINDEKMFLDYCQDFGVHDFGF

SEQ ID NO: 153 - DNA, 1256 bp, Arabidopsis thaliana
  G232
aaaaaaagaattacaattaataagaacaagatcaagaatcaagaatcaagaaaatgggaagagcaccgtgttgtgataaggccaacgtgaagaaagggccttggtctcctgaggaagacgccaaactcaaagattacatcgagaatagtggcacaggaggcaactggattgctttgcctcagaaaattggtttaaggagatgtgggaagagttgcaggctaaggtggctcaactatttgagaccaaacatcaaacatggtggcttctccgaggaagaagacaacatcatttgtaacctctatgttactattggtagcaggtggtctataattgctgcacaattgccgggaagaaccgacaacgatatcaaaaactattggaacacgaggctgaagaagaagcttctgaacaaacaaaggaaagagttccaagaagcgcgaatgaagcaagagatggtgatgatgaaaaggcaacaacaaggacaaggacaaggtcaaagtaatggtagtacggatctttatcttaacaacatgtttggatcatcaccatggccattactaccacaacttcctcctccacatcatcaaatacctcttggaatgatggaaccaacaagctgtaactactaccaaacgacaccgtcttgtaacctagaacaaaagccattgatcacactcaagaacatggtcaagattgaagaagaacaggaaaggacaaaccctgatcatcatcatcaagattctgtcacaaacccttttgatttctctttctctcagcttttgttagatcccaattactatctgggatcaggagggggaggagaaggagattttgctatcatgagcagcagcacaaactcaccattaccaaacacaagtagtgatcaacatccaagtcaacagcaagagattcttcaatggtttgggagcagtaactttcagacagaagcaatcaacgatatgttcataaacaacaacaacaacaacaacatagtgaatcttgagaccatcgagaacacaaaagtctatggagacgcctcagtagccggagccgctgtccgagcagctttggccggagggacaacgagtacatcggcggatcaaagtacaataagttgggaggatataacttctctagttaattccgaagatgcaagttacttcaatgcgccaaatcatgtgtaacattttgtttaaaactttatttgtacttacatacataaagaggggttttctattttgtaaaaaaaaaaaaaa

SEQ ID NO: 154 - protein, 376 aa, Arabidopsis thaliana
  G232
MGRAPCCDKANVKKGPWSPEEDAKLKDYIENSGTGGNWIALPQKIGLRRCGKSCRLRWLNYLRPNIKHGGFSEEEDNIICNLYVTIGSRWSIIAAQLPGRTDNDIKNYWNTRLKKKLLNKQRKEFQEARMKQEMVMMKRQQQGQGQGQSNGSTDLYLNNMFGSSPWPLLPQLPPPHHQIPLGMMEPTSCNYYQTTPSCNLEQKPLITLKNMVKIEEEQERTNPDHHHQDSVTNPFDFSFSQLLLDPNYYLGSGGGGEGDFAIMSSSTNSPLPNTSSDQHPSQQQEILQWFGSSNFQTEAINDMFINNNNNNNIVNLETIENTKVYGDASVAGAAVRAALAGGTTSTSADQSTISWEDITSLVNSEDASYFNAPNHV

SEQ ID NO: 155 - DNA, 1046 bp, Arabidopsis thaliana
  G233
gaaaaacatttcaacttcttttatcagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtcgctggtttagttgagatacaacaagagtttcaaaacttgggctccgctaataatgagatgatttttgacagtgagatggaacttctggttcgatgtattggctagaaccggcggggaacaagatctcttagccgggctctagttaacatgtttgaggagtaaagtgaaatggtgcaaattagttaaggctaagaaattcaaaagcttttgtttaccgagaaaaaaacacactctaactcttgatgtgatgtagttagtgtattaattagaggctgcgttttcaa

SEQ ID NO: 156 - protein, 273 aa, Arabidopsis thaliana
  G233
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMELLVRCIG

SEQ ID NO: 157 - DNA, 1139 bp, Arabidopsis thaliana
  G234
cacaacatcatacccaccaacatatataatcttgatcatagagagataaacagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcagaatcaaaccaactcgttttgcgaccaagaagatgttaagccagtgctcatcaagaacatggtcaagatcgaagatcaagaactggagaaaacaaacctcatcatcatcaagattcaatgacaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattcttaagatgaaacgtacatcattattattaattgggggtacgtaacgtatatatggaataacgatctagtttgtttaaatttaaaa

SEQ ID NO: 158 - protein, 309 aa, Arabidopsis thaliana
  G234
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFRIKPTRFATKKMLSQCSSRTWSRSKIKNWRKQTSSSSRFNDNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 159 - DNA, 920 bp, Arabidopsis thaliana
  G237
atggcgaagacgaaatatggagagagacataggaaagggttatggtcacctgaagaagacgagaagctaaggagcttcatcctctcttatggccattcttgctggaccactgttcccatcaaagctgggttacaaaggaatgggaagagctgcagattaagatggattaattacctaagaccagggttaaagagggatatgattagtgcagaagaagaagagactatcttgacgtttcattctcccttgggtaacaagtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggagaaagaaatccggaaaccttgatctcgaatcacgtgttctccctccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccaccaacaacgacgtaaattgcgtttattgtaatgtaaatcaaatttctaaggcaaaaccggaaaaaaaaaaaaaaaaaaaaaaa

SEQ ID NO: 160 - protein, 283 aa, Arabidopsis thaliana
  G237
MAKTKYGERHRKGLWSPEEDEKLRSFILSYGHSCWTTVPIKAGLQRNGKSCRLRWINYLRPGLKRDMISAEEEETILTFHSPLGNKWSQIAKFLPGRTDNEIKNYWHSHLKKKWLKSQSLQDAKSISPPSSSSSSLVACGERNPETLISNHVFSLQRLLENKSSSPSQESNGNNSHQCSSAPEIPRLFFSEWLSSSYPHTDYSSEFTDSKHSQAPNVEETLSAYEEMGDVDQFHYNEMMINNSNWTLNDIVFGSKCKKQEHHIYREASDCNSSAEFFSPPTTT

SEQ ID NO: 161 - DNA, 1347 bp, Arabidopsis thaliana
  G239
atggaagattacgagcgaataaactcaaactctccaacacatgaagaagattctgatgtacggaaaggtccatggaccgaggaagaagatgcaatcctagtcaacttcgtctctattcatggcgatgctcgttggaaccacatcgctcgttcctctgggctaaagcgaactggtaagagttgtagattaagatggcttaattacttacgtccagatgttagaagaggcaacatcactctcgaagaacaatttatgatcctcaaactccattctctttggggcaataggtggtcgaagattgcgcaatatctaccgggaagaacagataatgaaataaagaattattggagaactcgagtccaaaagcaagccaaacacctaagatgcgatgttaacagtaatcttttcaaggagactatgagaaatgtttggatgccgagattagtggaacgaatcaacgcccaatcattacccaccacgtgtgaacaagtggagtcaatgatcaccgacccaagtcaaccagttaacgaaccgagtccggtcgagccgggtttcgttcaattcagccagaatcatcatcagcaattcgtaccggctacggaattgtcagcaacgtcttcgaattctccggctgagacgttttcggacgttcgaggtggggtggtgaacgggtcaggttatgatccgtcgggtcaaacgggtttcggagagttcaacgattggggctgtgttggtggggacaacatgtggactgacgaggagagtttttggttcttgcaggaccagttctgccccgatacgacatcgtattcgtataattaaggaaatatacgattactatacgtaacgaggaattcaattgcgtcacgtttggtgtaatattcattcgtgcgtgatgccaattttagatacggccttggtatacgaatctttgacttaattattatcttttcttttcctctcttgttttaaacccctgattaaattaagatttgatcatcagacgaggatatttgtgattcactgatttgtgatattgatatatgtgaattatttgatataacgttttaaaaaccaacaaaaaaaaaaaatcattccaaggaaaagttcttaattttgatactcgaaaagagcgtagactgactcgaatcagttcatattttctttggttcgttttatttacgacaaaattcactaacaaaaattaaaaaacgacaaaacgaaaatatgactaaatttatttttttgtcagttaaccactgattataggttgaaattgtcacaacacatgatttatcttgatagaaatttagtagtccagaatgctgcatggttgatcctaagaaa

SEQ ID NO: 162 - protein, 273 aa, Arabidopsis thaliana
  G239
MEDYERINSNSPTHEEDSDVRKGPWTEEEDAILVNFVSIHGDARWNHIARSSGLKRTGKSCRLRWLNYLRPDVRRGNITLEEQFMILKLHSLWGNRWSKIAQYLPGRTDNEIKNYWRTRVQKQAKHLRCDVNSNLFKETMRNVWMPRLVERINAQSLPTTCEQVESMITDPSQPVNEPSPVEPGFVQFSQNHHQQFVPATELSATSSNSPAETFSDVRGGVVNGSGYDPSGQTGFGEFNDWGCVGGDNMWTDEESFWFLQDQFCPDTTSYSYN

SEQ ID NO: 163 - DNA, 1046 bp, Arabidopsis thaliana; identical to SEQ ID NO: 155
  G241

SEQ ID NO: 164 - protein, 273 aa, Arabidopsis thaliana; identical to SEQ ID NO: 156
  G241

SEQ ID NO: 165 - DNA, 1195 bp, Arabidopsis thaliana
  G242
ctctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcgggaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtctttttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagacaaagtgagattattaggaaactgtttaaattggagaagaagaaaaatgctctgtttttttctcctttggattaggcttaagaattttgggttttaaggaaatgtatagaggaaatcgagtgaacaaagctcgagagctggggacgtagtgacgaagacgaagatcaaatttctcttaagctattcaggaaaataaaataaatttttattt

SEQ ID NO: 166 - protein, 305 aa, Arabidopsis thaliana
  G242
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSFSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 167 - DNA, 1080 bp, Arabidopsis thaliana
  G245
atgggaaaatcttcaagctcggaggaaagtgaagtgaagaaagggccatggactccggaggaagacgagaagctcgtaggctatattcaaacgcacggtcccggcaaatggcgtacccttcccaagaacgccgggttaaaaagatgcgggaagagttgtagattgcgatggacgaattatctaagacccgatatcaagagaggagagttctctcttcaagaggaagaaaccatcattcaacttcatcgtcttcttggaaacgaatggtccgcaattgctattcacttaccaggaagaacagataatgaaatcaaagactattggaacacacatattaaaaagaaactcttacgaatggggattgatccggtgactcattgtccccgcattaatcttctccagctctcttcgtttcttacctcatcattgtttaaatctatgtcacaaccgatgaatactccatttgatctcactacttcaaatattaatcctgatatcttgaatcatctcactgcctctctcaacaacgttcagaccgaatcataccaaccaaaccaacagcttcaaaacgacctaaacactgaccaaaccactttcaccggtttgctcaactcaacaccacccgttcaatggcaaaacaatggagaatacttgggagattatcacagttataccggtacaggtgatccatctaataacaaagtccctcaagccggaaactactcatcagccgcatttgtatccgaccacattaatgatggtgagaattttaaggccggatggaatttcagttcatcaatgctagcgggaacttcatcgagcagctcgacaccgttgaattcgtcttcgactttttatgtcaatggtggaagcgaagatgatagagagagttttggtagcgacatgttgatgtttcatcatcatcatgatcataataataatgctttgaatctatcataatgtcttatttattttgcttcttgatcttatttgttttatttttacttttttttaatgggggtttgtaattgtgttacatactttgtaatataagagcttagtctattattatgttgactc

SEQ ID NO: 168 - protein, 319 aa, Arabidopsis thaliana
  G245
MGKSSSSEESEVKKGPWTPEEDEKLVGYIQTHGPGKWRTLPKNAGLKRCGKSCRLRWTNYLRPDIKRGEFSLQEEETIIQLHRLLGNEWSAIAIHLPGRTDNEIKDYWNTHIKKKLLRMGIDPVTHCPRINLLQLSSFLTSSLFKSMSQPMNTPFDLTTSNINPDILNHLTASLNNVQTESYQPNQQLQNDLNTDQTTFTGLLNSTPPVQWQNNGEYLGDYHSYTGTGDPSNNKVPQAGNYSSAAFVSDHINDGENFKAGWNFSSSMLAGTSSSSSTPLNSSSTFYVNGGSEDDRESFGSDMLMFHHHHDHNNNALNLS

SEQ ID NO: 169 - DNA, 660 bp, Arabidopsis thaliana
  G247
atgagaatgacaagagatggaaaagaacatgaatacaagaaaggtttatggacagtggaagaagacaagatcctcatggattatgtccgaactcatggccagggccactggaaccgcatcgccaagaaaactgggctcaagagatgtgggaaaagctgtaggttgagatggatgaactacttaagccctaatgttaacagaggcaattttactgaccaagaagaagatctcatcatcagactccacaagctcctcggcaacagatggtcgttgatagcgaaaagagttccgggaagaacagacaaccaagtaaagaattactggaacacacatctcagcaagaaacttggtctcggagatcattcaactgccgtcaaagccgcatgcggtgtagagtctccaccgtctatggcccttataaccacaacgtcctcctctcatcaagagatctccggtggaaaaaattcaactctaaggttcgacactttagttgacgaatccaaactcaaaccaaaatccaaactagtccacgcaacaccaactgacgtagaagttgcagctacggttccaaatctgttcgataccttttgggttcttgaagacgacttcgagcttagttcactcactatgatggattttactaatgggtattgcctttga

SEQ ID NO: 170 - protein, 219 aa, Arabidopsis thaliana
  G247
MRMTRDGKEHEYKKGLWTVEEDKILMDYVRTHGQGHWNRIAKKTGLKRCGKSCRLRWMNYLSPNVNRGNFTDQEEDLIIRLHKLLGNRWSLIAKRVPGRTDNQVKNYWNTHLSKKLGLGDHSTAVKAACGVESPPSMALITTTSSSHQEISGGKNSTLRFDTLVDESKLKPKSKLVHATPTDVEVAATVPNLFDTFWVLEDDFELSSLTMMDFTNGYCL

SEQ ID NO: 171 - DNA, 1317 bp, Arabidopsis thaliana
  G248
tcgacagttggtgtttaaatggaattctcattgatctccgatgaaaatttcatcttaaacgatgctcatcgatgtcctgttaatgatgatgcatcgcatataccaaaaaataatcttaactttttcaatgacaatttaggtcaatcttctcgtactggatggtctttttcaccagatctgactgatatctctaatcagcaccaccaaaatcttatacctttgatcccaaattatgattctcaaaatcagaatttggatactaatcaaaaccatttggtttacaactcttcctcctatgaaattccatcaaactacccattcatgagtatcaaatcctactcaaatattgatactcttgagcaatctatgaataacatagtcaacaacggaaaaatccatatgatcgataatcccccaatttttgcaaaccctaagggtatattcgaaaattttcatgatttgcaggaatacactatagggaatgagattgtacacaatgaagaactgactaataagggttatgagccaactcttgataaggtaatgggtgaacctcaattatttgatgtgccagtgctagaaggtatcaaaaatacaaccaacgaaatcatgaatcaacttgaagatgataagatgaaaaaaacttatgagaataaaaaggaggcgagcacaagcaaatatttgaagaaaagtgacatcaccaaaaaaagatggacagaatctgaggacataaaattgaaagagatggtggcacttgaacccaaaaaatggacaaaggtcgcaaaacattttgaaggacgaacaccaaaacaatgcagagagaggtggcataaccatgctcgtcctaacgttaagaaaactacttggagtgaagaagaagatcaaatactaattgaagtacacaaagtaattggtgccaaatggatccagatctcagagcaacttccggggaggagctataacaatgttaagaaccattggaataccacaaagcgtcgggtgcaaaataaaagtggtcgaactgtcaaccgtgtcggcaataacatccttgaaaactacataaggagtatcacaatcaacaacgatgatgaatctgatggtgaaccgacaaacattgagaattatcatgatgactctgaagatatgttatatggggagatgaatttgagtccagaggctataacgcagaccaccaaaccattgaccgatgcttctacaatatcaccttatattccgatgccaaaagaaaactatactctggaggtttgtgaatcactggaggactatctagagctgctgcgttggtgggattaatgc

SEQ ID NO: 172 - protein, 431 aa, Arabidopsis thaliana
  G248
MEFSLISDENFILNDAHRCPVNDDASHIPKNNLNFFNDNLGQSSRTGWSFSPDLTDISNQHHQNLIPLIPNYDSQNQNLDTNQNHLVYNSSSYEIPSNYPFMSIKSYSNIDTLEQSMNNIVNNGKIHMIDNPPIFANPKGIFENFHDLQEYTIGNEIVHNEELTNKGYEPTLDKVMGEPQLFDVPVLEGIKNTTNEIMNQLEDDKMKKTYENKKEASTSKYLKKSDITKKRWTESEDIKLKEMVALEPKKWTKVAKHFEGRTPKQCRERWHNHARPNVKKTTWSEEEDQILIEVHKVIGAKWIQISEQLPGRSYNNVKNHWNTTKRRVQNKSGRTVNRVGNNILENYIRSITINNDDESDGEPTNIENYHDDSEDMLYGEMNLSPEAITQTTKPLTDASTISPYIPMPKENYTLEVCESLEDYLELLRWWD

SEQ ID NO: 173 - DNA, 731 bp, Arabidopsis thaliana
  G249
ccgccgacatggagaaaagagaaagtagtggtgggtctggatcaggagatgcagaggtgagaaaagggccatggacgatggaagaagatttgattctcatcaattatatcgccaatcatggtgaaggtgtttggaactctctcgccaaatctgcaggactaaaacgcaccgggaaaagttgccggctccggtggctgaactacctccgacctgatgcgcgacggggaaatatcacaccagaagaacagctcaccatcatggaacttcatgcaaaatggggaaataggtggtcaaaaattgcaaagcatttaccaggaagaaccgacaatgagataaagaatttttggaggactaagatccagaaatacatcatcaagagcggagaaacgacgaccgttggatcacaaagctccgagtttataaaccatcatgcgacaacgagccatgtcatgaatgatactcaagaaaccatggatatgtattctccaacgacgtcgtatcaacatgccagcaatattaatcagcagcttaattatggtaattatgtgcctgaatccggttcgatcatgatgccattatctgttgatcagtccgaacaaaactattggagcgtcgatgatctttggcccatgaatatatataatggtaattaataaataagttcgttaaaacttatatatatttacggtccaaagagggttctatataaacagagtactgtatgggattgc

SEQ ID NO: 174 - protein, 214 aa, Arabidopsis thaliana
  G249
MEKRESSGGSGSGDAEVRKGPWTMEEDLILINYIANHGEGVWNSLAKSAGLKRTGKSCRLRWLNYLRPDARRGNITPEEQLTIMELHAKWGNRWSKIAKHLPGRTDNEIKNFWRTKIQKYIIKSGETTTVGSQSSEFINHHATTSHVMNDTQETMDMYSPTTSYQHASNINQQLNYGNYVPESGSIMMPLSVDQSEQNYWSVDDLWPMNIYNGN

SEQ ID NO: 175 - DNA, 1024 bp, Arabidopsis thaliana
  G251
acccacgcgtccggagaagtaaaattttctattgcagagagaaagagagttagagaaagagagagagagatgaaacttgtgcaagaagaataccgtaaaggaccgtggacagaacaggaggacatcctcttggtcaactttgtccacttgttcggagatcgaagatgggattttgtagcgaaagtttcaggtttaaacagaacaggaaagagttgcaggttaaggtgggttaattacctgcatcctggtctcaaacgtggtaagatgactccacaagaagagcgtttagtccttgagcttcacgccaaatggggaaacaggtggtcaaaaattgcccggaaattaccggggagaacagataatgagataaagaactactggaggactcatatgaggaagaaggctcaagagaagaagcgacctatgtctcctacttcctcatcttcaaactgttgctcatcatctatgaccactactactactcaagacactggaggctccaacgggaaaatgaatcaagaaggcgaagacgggtactactccatggatgacatatggagagagattgatcagtctggacacgttattaaaccggtaaaagacaactactactcagagcaaagttgttacttgaatttccctcctctggcttctccaacatgggaaagttccttggagtctatatggaacatggatgcagatgaaagtaagatgtcttcttttgctattgatcagtttcctctaagttttgaacatggtagtggtcgcctttagtctaggatttgattcatttggaatgtttatatgtgcagcatatatatgttatcaaacgacgactgtagtagtttcctatgacttacatcaaaaaacaccacccactgtactaatctcataagtagtcatcatcctatgcctttgtttagtttgtagagtgagtgaaaagatgtgtaatacaagtcagaactctaattccaaaataaatagacttttgaagcttctgtgaaaaaaaaaaaaaaaaaaaaaa

SEQ ID NO: 176 - protein, 234 aa, Arabidopsis thaliana
  G251
MKLVQEEYRKGPWTEQEDILLVNFVHLFGDRRWDFVAKVSGLNRTGKSCRLRWVNYLHPGLKRGKMTPQEERLVLELHAKWGNRWSKIARKLPGRTDNEIKNYWRTHMRKKAQEKKRPMSPTSSSSNCCSSSMTTTTTQDTGGSNGKMNQEGEDGYYSMDDIWREIDQSGHVIKPVKDNYYSEQSCYLNFPPLASPTWESSLESIWNMDADESKMSSFAIDQFPLSFEHGSGRL

SEQ ID NO: 177 - DNA, 1086 bp, Arabidopsis thaliana
  G252
acaacgacaagatcaagaaaagacaaagatttgtaagaaaatgggaagagctccatgctgcgacaaggcaaacgtgaagaaaggaccatggtcaccggaagaagatgtgaagctcaaggattacatcgacaaatatggcactggtggcaactggatcgcactgcctcagaaaattgggctgaagagatgtggtaagagttgcagactgagatggcttaattacttaagaccaaacatcaaacatggtggtttttcggaggaagaagatagaatcatcttgagtctctacattagcattggaagccggtggtccataattgcagctcagcttcctggaaggactgacaatgatatcaagaattattggaacacaaaactgaagaagaaacttctaggaagacagaaacaaatgaatcgtcaagactccataaccgattctactgagaacaacctcagcaacaataacaacaataagagtcctcagaatctgagcaattcggcactggagaggctccagcttcacatgcagcttcagaatctacagagccctttctctagtttctacaacaaccctatcttgtggcccaagcttcatccattgctccagagcactacaactaatcaaaaccctaagcttgcatctcaagaaagcttccaccctttaggagttaacgttgatcatcagcacaacaataccaagctagctcagataaacaatggagcctcttctcactattcggagaacgtagagcaatcccaaaaccctgctcatgaatttcaacctaatttcggttttccacaggaccttcgattagataatcataacatggactttatgaacagaggggtttctaaagaactgtttcaagtgggcaacgagtttgagctaacgaacggttcgagttggtggtcagaggaagtggaactagagaggaaaacgacgtcgtcgagttcttgggggtcagcttctgtgcttgatcagacaactgagggaatggttatgcttcaagattacgctcagatgagctaccacagtgtttaataagttatatcatgcatatatataaatgcgtaactatagggatg

SEQ ID NO: 178 - protein, 333 aa, Arabidopsis thaliana
  G252
MGRAPCCDKANVKKGPWSPEEDVKLKDYIDKYGTGGNWIALPQKIGLKRCGKSCRLRWLNYLRPNIKHGGFSEEEDRIILSLYISIGSRWSIIAAQLPGRTDNDIKNYWNTKLKKKLLGRQKQMNRQDSITDSTENNLSNNNNNKSPQNLSNSALERLQLHMQLQNLQSPFSSFYNNPILWPKLHPLLQSTTTNQNPKLASQESFHPLGVNVDHQHNNTKLAQINNGASSHYSENVEQSQNPAHEFQPNFGFPQDLRLDNHNMDFMNRGVSKELFQVGNEFELTNGSSWWSEEVELERKTTSSSSWGSASVLDQTTEGMVMLQDYAQMSYHSV

SEQ ID NO: 179 - DNA, 1391 bp, Arabidopsis thaliana
  G254
cgatttcgagctctatggtgtccgtaaaccctagacctaagggttttccagttttcgattcctcgaatatgagtttaccaagctccgatggatttggttcgattccggccacgggacggaccagtacggtgtcgttttctgaggatccgacgacgaagattcggaagccgtacacaatcaagaagtcgagagagaattggacagatcaagagcacgataaatttctagaagctcttcacttattcgatagggattggaagaaaatagaagcctttgttggatcaaaaacagtagttcagatacgaagccacgctcagaaatactttctcaaagttcagaagagtggtgctaacgaacatcttccacttcctcgacctaagaggaaagcgagtcatccttatcctataaaggctcctaaaaatgttgcttatacctctctcccgtcttcgagtacattaccgttgcttgagcctggttatttgtatagctctgattcgaagtcattgatgggaaaccaggctgtttgtgcatctacctcttcttcgtggaatcatgaatcgacaaatctgccaaaaccggtgattgaagaggaaccgggagtctcggccacggctcctctcccaaataatcgctgcagacaggaagatacagagagggtacgagcagtgacaaagccaaataacgaagaaagttgtgaaaagccacatagagtgatgccgaattttgctgaagtttacagcttcattggaagtgtcttcgatcccaacacatcaggccacctccagagattaaagcagatggatccaataaatatggaaacggttcttttactgatgcaaaacctgtctgtaaatctgacaagtcccgagtttgcagagcaaaggaggttgatatcatcatacagcgctaaagctttgaaatagagatagaataaaacaataatgtaccttatgtgagatcaagagacaatcatccaaggtctgtatgcattgcttggatttaggcctcgtgttctcactacaggagcagaaccaatcgcaaagactcttagatggctactgagttgtggtttttatgtctctgtaagtcgcggtggagcacacgtgtttgtcctgtcttgtgtatgtgtgtatagataatacaaggttttgcagagtaaggtcacagttagctgcaagtgagtttggatcaatcttaagattaaaaccctgagagtgagtgtccaaagagactgtgtaatattggtttggcggtcagcagaagagttttgaagtgcacatccagttagtgataacacggttgaagaaaaggtaaggttacaagtttagttttgaataattgtatactcaaaaaatatgaatgtataaagaataatcacttgagtcgcctta

SEQ ID NO: 180 - protein, 302 aa, Arabidopsis thaliana
  G254
MVSVNPRPKGFPVFDSSNMSLPSSDGFGSIPATGRTSTVSFSEDPTTKIRKPYTIKKSRENWTDQEHDKFLEALHLFDRDWKKIEAFVGSKTVVQIRSHAQKYFLKVQKSGANEHLPLPRPKRKASHPYPIKAPKNVAYTSLPSSSTLPLLEPGYLYSSDSKSLMGNQAVCASTSSSWNHESTNLPKPVIEEEPGVSATAPLPNNRCRQEDTERVRAVTKPNNEESCEKPHRVMPNFAEVYSFIGSVFDPNTSGHLQRLKQMDPINMETVLLLMQNLSVNLTSPEFAEQRRLISSYSAKALK

SEQ ID NO: 181 - DNA, 918 bp, Arabidopsis thaliana
  G255
agcatcatcatcatcagaagaagagagtcatgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataaatgaatagtattagattcttaatttgtaggtctgataatgaatgttagattcgcggccctctagacaggcctcgtaccg

SEQ ID NO: 182 - protein, 269 aa, Arabidopsis thaliana
  G255
MGRSPCCEKEHMNKGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKLLSKGIDPATHRGINEAKISDLKKTKDQIVKDVSFVTKFEETDKSGDQKQNKYIRNGLVCKEERVVVEEKIGPDLNLELRISPPWQNQREISTCTASRFYMENDMECSSETVKCQTENSSSISYSSIDISSSNVGYDFLGLKTRILDFRSLEMK

SEQ ID NO: 183 - DNA, 1547 bp, Arabidopsis thaliana
  G256
tcgtgagcgttgtgtttctcctcaacattcaaagtctttagtgaaacctctcttgtaagaagccaaaaaaataaagagaaagattcaaagaaggaaagaaattgaggatgactatttcaagtccaaagagagattttgagtagaccctcttcacaaaaatccaatcttagagtcttactagttactatctagcttacatacacagagacactataccaaaaatccaatcttattagagtacttactatatagcttacacatacacacacacgaagtactatttcaacgatcaagagcgtgtgcgtgaggatatgggtagaccaccttgttgcgagaagattgaggtgaagaaaggaccatggactcccgaagaagacataatcttggtctcttatatccaacaacacggccctggaaattggagatctgtccctgcaaacaccggtttgctaaggtgtagcaagagttgcagacttagatggactaattaccttcgtcccgggatcaaacgaggaaatttcactcaaccggaagagaagatgatcatccaccttcaagctcttttgggaaatagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactactactgatgatcaaggctcgttgtcattgatcgagaaatggttgtttgatgatcaaggcttggttcagtgtgatgatagtcaagaagatctcatcgacgtgtctttagaggagttaaaataatgataacaacagtcaagatttgttctataagaaaataaaacgtatagaacaacgataaagctagctaggtttattaatttttctttcttttgtcttttctctatgatctttagttacattttattttactgtgtggcttgcttgtggtcaagtcgatgaagatcaaactgtgatatactatttatatgtaaagtactataaagttaagagtagttgaataaaaaaaaaaaaaaaaaa

SEQ ID NO: 184 - protein, 332 aa, Arabidopsis thaliana
  G256
MGRPPCCEKIEVKKGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKLVMMKFQNGIINENKTNLATDISSCNNNNNGCNHNKRTTNKGQWEKKLQTDINMAKQALFQALSLDQPSSLIPPDPDSPKPHHHSTTTYASSTDNISKLLQNWTSSSSSKPNTSSVSNNRSSSPGEGGLFDHHSLFSSNSESGSVDEKLNLMSETSMFKGESKPDIDMEATPTTTTTTTDDQGSLSLIEKWLFDDQGLVQCDDSQEDLIDVSLEELK

SEQ ID NO: 185 - DNA, 1473 bp, Arabidopsis thaliana
  G257
atggatggtggtggagagacgacggcgacggctacgatggaggggagagggttgaagaaagggccgtggacaacgacggaggatgcgatcttgacggagtacgtgagaaaacacggtgaaggtaattggaacgccgtgcaaaagaactcaggtttgctccggtgtggcaaaagttgccgtctacggtgggcgaatcatctccggccaaatctaaagaaaggatcttttactcctgatgaagaaaagatcatcatcgaccttcacgctaagcttggaaacaaatgggctcgtatggcttctcagttacctggaagaacagacaatgagatcaagaactattggaacacgaggatgaagagaagacaaagagctggtttgcctttataccctcatgagattcaacatcaagggattgatattgatgatgagtttgagtttgatttaacttcctttcagttccaaaaccaagatcttgatcataaccaccaaaatatgattcagtacactaattcttctaatacttcatcatcctcgtcttcattctcttcttcatcttctcaaccatcaaaaaggctgcgtcctgatcctttagtctctactaatcccggcctaaacccgatccccgattcttcgatggattttcaaatgttctctctttacaacaatagccttgagaatgacaataaccagtttggtttctctgttcctttgtcctcatcatcctcgtctaacgaggtgtgtaatcccaaccacatccttgagtacatctccgagaattcggacacaagaaataccaataagaaagacattgatgctatgagttatagttcattgcttatgggagatcttgagataagatcgagttctttccctttaggactagacaatagcgtcctagagcttccttcaaaccaaagaccgacccattcgttcagttctagtcctattattgacaatggtgtccatcttgagccaccttctggcaatagtggactacttgatgccctcttggaggagtctcaagccttgtctcgaggcggactcttcaaggacgttagggtttcctccagtgacctatgtgaggttcaagataaaagggtgaagatggactttgagaatcttttaatagatcatctaaactcttctaatcattcatcattgggagcaaaccctaatattcacaacaagtacaatgagccaacaatggtaaaagtaacggtggatgatgatgatgaattattgacgagccttctcaacaacttcccttcaaccacaacacctttgcctgattggtatcgggtgacagaaatgcaaaacgaggcctcatatcttgccccaccaagtggaattcttatgggaaaccatcaaggtaacggcagggtggaaccacccacggtgccgccttcgtccagtgtagatcctatggcctcgttggggtcatgctattggagcaacatgcctagcatctgttag

SEQ ID NO: 186 - protein, 490 aa, Arabidopsis thaliana
  G257
MDGGGETTATATMEGRGLKKGPWTTTEDAILTEYVRKHGEGNWNAVQKNSGLLRCGKSCRLRWANHLRPNLKKGSFTPDEEKIIIDLHAKLGNKWARMASQLPGRTDNEIKNYWNTRMKRRQRAGLPLYPHEIQHQGIDIDDEFEFDLTSFQFQNQDLDHNHQNMIQYTNSSNTSSSSSSFSSSSSQPSKRLRPDPLVSTNPGLNPIPDSSMDFQMFSLYNNSLENDNNQFGFSVPLSSSSSSNEVCNPNHILEYISENSDTRNTNKKDIDAMSYSSLLMGDLEIRSSSFPLGLDNSVLELPSNQRPTHSFSSSPIIDNGVHLEPPSGNSGLLDALLEESQALSRGGLFKDVRVSSSDLCEVQDKRVKMDFENLLIDHLNSSNHSSLGANPNIHNKYNEPTMVKVTVDDDDELLTSLLNNFPSTTTPLPDWYRVTEMQNEASYLAPPSGILMGNHQGNGRVEPPTVPPSSSVDPMASLGSCYWSNMPSIC

SEQ ID NO: 187 - DNA, 998 bp, Arabidopsis thaliana
  G258
agtgaccaccctgctggttaatcaacaccaagagaccttgtaatatataagttaggaagatgagagagaagtgggaaatgaaaagagatgaaatgggacatcgatgttgtggaaaacacaaagtgaagagaggtctttggtctccagaggaagacgagaagcttcttcgttatatcaccactcatggtcatcctagttggagttccgttccaaagcttgccgggttgcagagatgtgggaagagttgcagattaaggtggataaactatctaaggcctgatctgaggagaggttcgtttaatgaggaagaagagcagattatcatcgacgtacatcgtattcttggtaacaaatgggctcagattgctaagcacttacctggacgcactgataatgaagtcaagaacttttggaactcatgcattaagaagaaacttctttctcaaggcttagatccttctacacataatcttatgccttcacacaaaagatcttcttcttcaaacaataataatatccccaagccaaacaaaacgacgtccatcatgaagaaccctactgatcttgatcaatcaaccactgctttttcaatcacaaacatcaatccacccacttccactaaaccaaacaaacttaaatctcctaaccagactacaatcccatctcaaaccgtgatccctatcaatgataacatgtcaagtactcaaaccatgatccctatcaatgatcccatgtcaagtcttttagatgatgagaatatgattcctcactggtcagatgttgatggaatggcgatccacgaagctccgatgttgcctagtgataaggcagtagtgggagtggatgatgatgatctcaacatggacattttgtttaacactccttcttcttctgcttttgatcctgattttgcttccattttctcctctgcaatgtctatcgatttcaatcccatggatgatcttggcagctggaccttttagcttttactctacagc

SEQ ID NO: 188 - protein, 307 aa, Arabidopsis thaliana
  G258
MREKWEMKRDEMGHRCCGKHKVKRGLWSPEEDEKLLRYITTHGHPSWSSVPKLAGLQRCGKSCRLRWINYLRPDLRRGSFNEEEEQIIIDVHRILGNKWAQIAKHLPGRTDNEVKNFWNSCIKKKLLSQGLDPSTHNLMPSHKRSSSSNNNNIPKPNKTTSIMKNPTDLDQSTTAFSITNINPPTSTKPNKLKSPNQTTIPSQTVIPINDNMSSTQTMIPINDPMSSLLDDENMIPHWSDVDGMAIHEAPMLPSDKAVVGVDDDDLNMDILFNTPSSSAFDPDFASIFSSAMSIDFNPMDDLGSWTF

SEQ ID NO: 189 - DNA, 1136 bp, Arabidopsis thaliana
  G260
gttaaagagtgcttttgatccaaaatgttaaacatgagcaaaaatgaaggttcattaacctcagtatcatatttcatcaccacaacgtatgatatggtcgatgatctttcattagattcaataatttcttggagccagagcggcaagagtttcatcatttggaatccagaagaattttacaacaatcttcttcaaagattctgcttccaacgcataaatacctttttctctttccttttttcacatggtttcagaaaaatcgactctggaaaatgggaattcgcgaatgataattttgtgcgaggtcaacgtcacctcataaataacattataagtgatgtaatagagcaggaggttcaatatgatcaaggaatggaattgtttaaagcagaaaaattatttgcacgactagtgaaaaaagtacaggatcaattgccacctcataacagttatccaacctcaaaacttcctttccccaccaaaatctatgagatggtggacgatccttcatcggatgctattatctcatggagccaaagtggcaagagtttcatcatttggaatccacaagaattttgcaaagatcatcttcgtagactcttcaataccctccatatacattttttcttctataaacttaaaatatttggtttcaaaaaaattaatccaaagaaatgggaatttgcaaatgataattttgtccggggtcaacgtcaccttgtggaaatcattataagcaatgataaaaagaagaatgatcaactacgtaaacaggatgccagagagaaaaaaatggcggaggcaggagaattgtttaagttgcaaattgaggaaatgtcggatatgagaaagaaaatgaagaaggccaaggaagtaaaggaacaagaggttcgactctgcaaattatgagtttgttggaggtcaatcttattttatgaataatatccataagaagctctagcttgtcattaccattaaagtttgtatttattagttttctttgagattatgtttaatgtttttgtttgtgcaacagttgcttctttggctttctgctttctgtaaaatcccttaaaaaggatgtaataattattctttgatttggcatagtactcgttataagtctcttgtaaaaa

SEQ ID NO: 190 - protein, 294 aa, Arabidopsis thaliana
  G260
MLNMSKNEGSLTSVSYFITTTYDMVDDLSLDSIISWSQSGKSFIIWNPEEFYNNLLQRFCFQRINTFFSFLFSHGFRKIDSGKWEFANDNFVRGQRHLINNIISDVIEQEVQYDQGMELFKAEKLFARLVKKVQDQLPPHNSYPTSKLPFPTKIYEMVDDPSSDAIISWSQSGKSFIIWNPQEFCKDHLRRLFNTLHIHFFFYKLKIFGFKKINPKKWEFANDNFVRGQRHLVEIIISNDKKKNDQLRKQDAREKKMAEAGELFKLQIEEMSDMRKKMKKAKEVKEQEVRLCKL

SEQ ID NO: 191 - DNA, 1749 bp, Arabidopsis thaliana
  G261
attttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagagatggatgagaataatcatggagtttcatcaagctcacttccacctttcctcaccaaaacatatgagatggttgatgattcttcatccgattctatcgtctcttggagtcagagcaataagagtttcatcgtttggaatccgccggagttttctagagatcttcttccgagattcttcaagcacaataacttctctagctttatccgccagcttaacacatatgtaagtgttttcatgctttgtttaaaagtattgactaaatcaatcatcttcttagtggaatttgtttttgtgtgtagggttttagaaaagctgatcctgagcaatgggaatttgcggaatgatgattttgtgagaggtcaacctcatcttatgaagaacattcatagacgcaaaccagttcatagccactctttaccgaatcttcaagctcagttaaacccgttgacggattcagaacgagtgagaatgaataatcagattgagagattgacaaaagagaaagaaggattgcttgaagagttacataaacaagacgaggaacgagaagtgtttgagatgcaagtgaaagaacttaaagaacgattacaacacatggagaagcgtcagaaaacaatggtttcgtttgtttctcaagtattggaaaagccagggcttgctttgaacctatcgccgtgtgttcccgaaacaaacgagaggaaaagaaggttccctaggatcgagttctttcccgatgaaccgatgttggaagagaacaaaacttgtgttgttgtgagagaggaaggttctacaagcccttcttcacacacaagagagcatcaagtggaacagttagagtcatcgatagcgatttgggagaatcttgtatcggattcttgtgagagtatgttacaatcaagaagtatgatgacacttgatgtggatgaatcatctacttttccagagagccctcctctttcttgcatacagttaagtgtcgattcacgtctcaaatctcctccttctccaaggatcatcgatatgaactgtgagcccgatggttcgaaagaacagaacactgttgctgctcctcctcctcctccagtagcaggagcgaatgatggcttctggcagcagtttttctcagagaatcctggctcaaccgagcaacgggaagttcaattagagaggaaagacgataaagataaagccggagtacgtactgagaaatgttggtggaattcgagaaatgttaatgcaattacagaacagcttggacatctgacttcttcagagagaagttgatatgtcaaagattaaatttctagtctgttttagttacttgtaaaatagggtttctcagttttattgttttcgattacagtacttaggtatggttcagctgtttatttatcacttgtatgatctttcacagttcattgtagcagacttcaatggtaatgataagctagagcttatggatagtattcataaaatgagattgaccttcaacaaaaaaa

SEQ ID NO: 192 - protein, 427 aa, Arabidopsis thaliana
  G261
MDENNHGVSSSSLPPFLTKTYEMVDDSSSDSIVSWSQSNKSFIVWNPPEFSRDLLPRFFKHNNFSSFIRQLNTYVSVFMLCLKVLTKSIIFLVEFVFVCRVLEKLILSNGNLRNDDFVRGQPHLMKNIHRRKPVHSHSLPNLQAQLNPLTDSERVRMNNQIERLTKEKEGLLEELHKQDEEREVFEMQVKELKERLQHMEKRQKTMVSFVSQVLEKPGLALNLSPCVPETNERKRRFPRIEFFPDEPMLEENKTCVVVREEGSTSPSSHTREHQVEQLESSIAIWENLVSDSCESMLQSRSMMTLDVDESSTFPESPPLSCIQLSVDSRLKSPPSPRIIDMNCEPDGSKEQNTVAAPPPPPVAGANDGFWQQFFSENPGSTEQREVQLERKDDKDKAGVRTEKCWWNSRNVNAITEQLGHLTSSERS

SEQ ID NO: 193 - DNA, 1104 bp, Arabidopsis thaliana
  G263
tttttagttttatttttctgtggtaaaataaaaaaagttcgccggagatgacggctgtgacggcggcgcaaagatcagttccggcgccgtttttaagcaaaacgtatcagctagttgatgatcatagcacagacgacgtcgtttcatggaacgaagaaggaacagcttttgtcgtgtggaaaacagcagagtttgctaaagatcttcttcctcaatacttcaagcataataatttctcaagcttcattcgtcagctcaacacttacggatttcgtaaaactgtaccggataaatgggaatttgcaaacgattatttccggagaggcggggaggatctgttgacggacatacgacggcgtaaatcggtgattgcttcaacggcggggaaatgtgttgttgttggttcgccttctgagtctaattctggtggtggtgatgatcacggttcaagctccacgtcatcacccggttcgtcgaagaatcctggttcggtggagaacatggttgctgatttatcaggagagaacgagaagcttaaacgtgaaaacaataacttgagctcggagctcgcggcggcgaagaagcagcgcgatgagctagtgacgttcttgacgggtcatctgaaagtaagaccggaacaaatcgataaaatgatcaaaggagggaaatttaaaccggtggagtctgacgaagagagtgagtgcgaaggttgcgacggcggcggaggagcagaggagggggtaggtgaaggattgaaattgtttggggtgtggttgaaaggagagagaaaaaagagggaccgggatgaaaagaattatgtggtgagtgggtcccgtatgacggaaataaagaacgtggactttcacgcgccgttgtggaaaagcagcaaagtctgcaactaaaaaaagagtagaagactgttcaaaccagcgtgtgacacgtcatcgacgacgacgaaaaaaatgatttaaaaaactatttttttccgtaaggaagaaaagttatttttatgttttaaaaaggtgaagaaggtccagaaggatcaacgcaaatatataaatggattttcatgtattatataatttaattagtgtattaagaaaa

SEQ ID NO: 194 - protein, 284 aa, Arabidopsis thaliana
  G263
MTAVTAAQRSVPAPFLSKTYQLVDDHSTDDVVSWNEEGTAFVVWKTAEFAKDLLPQYFKHNNFSSFIRQLNTYGFRKTVPDKWEFANDYFRRGGEDLLTDIRRRKSVIASTAGKCVVVGSPSESNSGGGDDHGSSSTSSPGSSKNPGSVENMVADLSGENEKLKRENNNLSSELAAAKKQRDELVTFLTGHLKVRPEQIDKMIKGGKFKPVESDEESECEGCDGGGGAEEGVGEGLKLFGVWLKGERKKRDRDEKNYVVSGSRMTEIKNVDFHAPLWKSSKVCN

SEQ ID NO: 195 - DNA, 1038 bp, Arabidopsis thaliana
  G266
atggaagaactgaaagtggaaatggaggaagaaacggtgacgtttactggttctgtagcggcttcttcatctgtaggatcctcttcctctcctagaccaatggaagggcttaacgaaacagggccaccaccgtttctgactaagacttacgaaatggtggaagatccggcgacggacacggtggtttcttggagtaatggtcgtaacagctttgtggtgtgggattctcataagttctcaacaactctccttccacgttacttcaagcatagcaatttctcaagttttattcgtcagctcaatacttatggattcagaaagattgatccagatagatgggaatttgcaaatgaagggtttttagcaggacaaaagcatctcttgaagaacatcaaaagaaggaggaacatgggtttgcagaatgtgaatcagcaaggatctgggatgtcatgtgttgaggttgggcaatacggtttcgacggggaggttgagaggttgaagagggatcatggtgtgcttgtagctgaggtagttaggttgaggcaacagcaacacagctccaagagtcaagttgcagctatggagcaacggttgcttgttactgagaagagacagcagcagatgatgacgttccttgccaaggcgttgaacaatccgaactttgttcagcagtttgcggttatgagtaaagagaagaagagtttgtttggtttggatgtggggaggaaacggaggcttacttctactccaagcttggggactatggaggagaatttgttacatgatcaagagtttgatagaatgaaggatgatatggaaatgttgttcgctgcagcaatcgatgatgaggcgaataattcgatgcctactaaggaggaacaatgtttggaggctatgaatgtgatgatgagagatggtaatttggaagcagcgttggatgtgaaagtggaagatttggttggttcgcctttggattgggacagccaagatctacatgacatggttgatcaaatgggttttcttggttcggaaccttaa

SEQ ID NO: 196 - protein, 345 aa, Arabidopsis thaliana
  G266
MEELKVEMEEETVTFTGSVAASSSVGSSSSPRPMEGLNETGPPPFLTKTYEMVEDPATDTVVSWSNGRNSFVVWDSHKFSTTLLPRYFKHSNFSSFIRQLNTYGFRKIDPDRWEFANEGFLAGQKHLLKNIKRRRNMGLQNVNQQGSGMSCVEVGQYGFDGEVERLKRDHGVLVAEVVRLRQQQHSSKSQVAAMEQRLLVTEKRQQQMMTFLAKALNNPNFVQQFAVMSKEKKSLFGLDVGRKRRLTSTPSLGTMEENLLHDQEFDRMKDDMEMLFAAAIDDEANNSMPTKEEQCLEAMNVMMRDGNLEAALDVKVEDLVGSPLDWDSQDLHDMVDQMGFLGSEP

SEQ ID NO: 197 - DNA, 1537 bp, Arabidopsis thaliana
  G270
gataatgcagtcactgtccacgccacacaccatctctcttcttctccccagaacctctccgtctcgtctttctccctctcttcactcccttgctttccccactcgattacggtctctttcctattcttctcaaacgtcgatcctccccgatgccggcgatgatttcattgtcggtgactgtctcgtctacgaggacggcgtcttcgaagacccttaccttgataaggaggtcactcaggttgcgaagcaggagcgcaagaagaatcggcgtggcggggctaagagattagatgaatccgagattgagcccgagaacctcgtgccagaggaatggagggatattcaggcggaggtgaatctgacgaagaaggacaagcgcaaaatagcgcaggagatggagttcggggttcgggtggagaagaagaggcaagggctaattccgctgaggaaagttgacttgaatgactttctcacgtacaaggaagccaagttggctcaattgaggcctgtcattctcgataaaccgggaaatttctccgacgacagtggagcgtcaagcgatggagagaccgctgtatcatctcccagcgagcgagtggctcctaagaaccctagatgggcagtttacggaaagggattcgaccacgttgccaagttcttcaatagcgacaagtacgatcccagcgacaagaaatccgacggccctcgaaagctgctttcaaaagaagagaagtttatgctcaatagccggaatcctgacctagccgttgccacatcaaaaaaatggcttcctcttcacacactggcagcatgtggagagttttatctggttgattccttgctaaagcacaatcttgatatcaatgcaaccgatgtgggcggcttgacagtacttcaccgagcaatcattggtaagaagcaggctattactaactacctgctgagggaatcggcaaatccatttgttcttgatgacgaaggtgcgaccttgatgcactatgctgtgcaaacagcatcagctcccacaataaaacttctcctactgtataacgctgatataaacgctcaggacagggacgggtggactccactgcacgttgcagtacaggccagaagaagcgacattgtaaagcttcttttgataaaaggggcggacatagaagtgaagaacaaggatgggttaactccgcttgggctttgcctctaccttggaagagagataaggacgtatgaggtgatgaagctgttgaaagagtttccacttagcagacacaagaagagattggtaacaacagatgaagatattgaatagtcctttcaatttcagcttgaagtacactcacttatgagaacctgagaaaaggagatggaggtaaaggtgatgattagggcattggaacctcggagtcggagtgggtccactgtctcacttccttaaatttggtttgctgttagtcttatccatcgattttggatatttatcacaacttgatccattcttaaagaaaatatctgaaaataaaaaaaaaaaaaaaaa

SEQ ID NO: 198 - protein, 435 aa, Arabidopsis thaliana
  G270
MQSLSTPHTISLLLPRTSPSRLSPSLHSLAFPTRLRSLSYSSQTSILPDAGDDFIVGDCLVYEDGVFEDPYLDKEVTQVAKQERKKNRRGGAKRLDESEIEPENLVPEEWRDIQAEVNLTKKDKRKIAQEMEFGVRVEKKRQGLIPLRKVDLNDFLTYKEAKLAQLRPVILDKPGNFSDDSGASSDGETAVSSPSERVAPKNPRWAVYGKGFDHVAKFFNSDKYDPSDKKSDGPRKLLSKEEKFMLNSRNPDLAVATSKKWLPLHTLAACGEFYLVDSLLKHNLDINATDVGGLTVLHRAIIGKKQAITNYLLRESANPFVLDDEGATLMHYAVQTASAPTIKLLLLYNADINAQDRDGWTPLHVAVQARRSDIVKLLLIKGADIEVKNKDGLTPLGLCLYLGREIRTYEVMKLLKEFPLSRHKKRLVTTDEDIE

SEQ ID NO: 199 - DNA, 2330 bp, Arabidopsis thaliana
  G274
agctttatactttctggctactgcaagctcatcagtgaaaagagcttaaaccagagagatctgataagagaaattttagagtctctctgcttcaacaagatctacatcgaccaggagattagaaagaatcatgggttctaagcataacccaccagggaataacagatcgagaagtacactatctctactcgttgtggttggtttatgttgtttcttctatcttcttggagcatggcaaaagagtgggtttggtaaaggagatagcatagctatggagattacaaagcaagcgcagtgtactgacattgtcactgatcttgattttgaacctcatcacaacacagtgaagatcccacataaagctgatcccaaacctgtttctttcaaaccgtgtgatgtgaagctcaaggattacacgccttgtcaagagcaagaccgagctatgaagttcccgagagagaacatgatttacagagagagacattgtcctcctgataatgagaagctgcgttgtcttgttccagctcctaaagggtatatgactcctttcccttggcctaaaagcagagattatgttcactatgctaatgctcctttcaagagcttgactgtcgaaaaagctggacagaattgggttcagtttcaagggaatgtgtttaaattccctggtggaggaactatgtttcctcaaggtgctgatgcgtatattgaagagctagcttctgttatccctatcaaagatggctctgttagaaccgcattggacactggatgtggggttgctagttggggtgcttatatgcttaagaggaatgttttgactatgtcgtttgcgccaagggataaccacgaagcacaagtccagtttgcgcttgagagaggtgttccagcgattatcgctgttcttggatcaatccttcttccttaccctgcaagagcctttgacatggctcaatgctctcgatgcttgataccatggaccgcaaacgagggaacatacttaatggaagtagatagagtcttgagacctggaggttactgggtcttatcgggtcctccaatcaactggaagacatggcacaagacgtggaaccgaactaaagcagagctaaatgccgagcaaaagagaatagagggaatcgcagagtccttatgctgggagaagaagtatgagaagggagacattgcaattttcagaaagaaaataaacgatagatcatgcgatagatcaacaccggttgacacctgcaaaagaaaggacactgacgatgtctggtacaaggagatagaaacgtgtgtaacaccattccctaaagtatcaaacgaagaagaagttgctggaggaaagctaaagaagttccccgagaggctattcgcagtgcctccaagtatctctaaaggtttgattaatggcgtcgacgaggaatcataccaagaagacatcaatctatggaagaagcgagtgaccggatacaagagaattaacagactgataggttccaccagataccgtaatgtgatggatatgaacgccggtcttggtggattcgctgctgcgcttgaatcgcctaaatcgtgggttatgaatgtgattccaaccattaacaagaacacattgagtgttgtttatgagagaggtctcattggtatctatcatgactggtgtgaaggcttttcaacttatccaagaacatacgatttcattcacgctagtggtgtcttcagcttgtatcagcacagctgcaaacttgaggatattcttcttgaaactgatcggattttacgaccggaagggattgtgattttccgggatgaggttgatgttttgaatgatgtgaggaagatcgttgatggaatgagatgggatactaagttaatggatcatgaagacggtcctctcgtgccggagaagattcttgtcgccacgaagcagtattgggtagccggcgacgatggaaacaattctccgtcgtcttctaatagtgaagaagaataaaacaaaaacaaaaaactcctcaggttactaagcttgaagtgtagatctattttacaacatctggaaaattcttatcaaaaaaggaaggaatcagaatttccattaaagaaaggtgtcaaaaaaaagttgtaaaactatatagtagtgatcaagacgaatatgtgcatttatgttttatttttgttccctagtttttaattttatttttttgaaggaagaaaaaattagttccatgtgtttttgcaagatagttgaaaccttggacgcttgttatgtatgatgcgatcttgacattttttaataacagttattttaaataaatttatgatataaa

SEQ ID NO: 200 - protein, 621 aa, Arabidopsis thaliana
  G274
MGSKHNPPGNNRSRSTLSLLVVVGLCCFFYLLGAWQKSGFGKGDSIAMEITKQAQCTDIVTDLDFEPHHNTVKIPHKADPKPVSFKPCDVKLKDYTPCQEQDRAMKFPRENMIYRERHCPPDNEKLRCLVPAPKGYMTPFPWPKSRDYVHYANAPFKSLTVEKAGQNWVQFQGNVFKFPGGGTMFPQGADAYIEELASVIPIKDGSVRTALDTGCGVASWGAYMLKRNVLTMSFAPRDNHEAQVQFALERGVPAIIAVLGSILLPYPARAFDMAQCSRCLIPWTANEGTYLMEVDRVLRPGGYWVLSGPPINWKTWHKTWNRTKAELNAEQKRIEGIAESLCWEKKYEKGDIAIFRKKINDRSCDRSTPVDTCKRKDTDDVWYKEIETCVTPFPKVSNEEEVAGGKLKKFPERLFAVPPSISKGLINGVDEESYQEDINLWKKRVTGYKRINRLIGSTRYRNVMDMNAGLGGFAAALESPKSWVMNVIPTINKNTLSVVYERGLIGIYHDWCEGFSTYPRTYDFIHASGVFSLYQHSCKLEDILLETDRILRPEGIVIFRDEVDVLNDVRKIVDGMRWDTKLMDHEDGPLVPEKILVATKQYWVAGDDGNNSPSSSNSEEE

SEQ ID NO: 201 - DNA, 781 bp, Arabidopsis thaliana
  G279
cacaaacacgtagttattctctctttactctctctatttctctctcttcaaaccctacgaagatcttcttcttcttcttcaagaatcgatcatgaaaggagctaaatctaaggctgaaaccaggagcacaaagctctctgtgactaagaagcctgctaagggagccaaaggtgctgctaaagatccaaacaaacctaagaggccttccagtgccttcttcgttttcatggaagatttccgtgtgacgtacaaggaggagcaccctaagaacaagtctgttgctgctgttggcaaagctggtggtgaaaagtggaaatccttgtctgactctgagaaggctccttatgtggctaaggctgacaagcgcaaggttgagtatgagaagaacatgaaagcctacaacaagaaattggaggaaggccctaaggaagatgaggaatctgacaagtcagtttcagaggttaacgatgaggatgatgctgaggatggcagtgaagaggaggaagacgatgattaagaagttgaagttgtggtagcgtaatatagaaggctgcaaggaatctctcggatgtttttatctcctctcttaaaatgttaattcgggtggttaaagtggtttttttttttttctttttctttttcttactgatgtttcgttttagtaaactattacctatctcccactgattctacgggtaatggaaaaagtgaatgtagaatgtttagatggtgaaatgagagatttgtagctctaaaaaaaaaaaaaaaaaaaaaaaaaaaa

SEQ ID NO: 202 - protein, 141 aa, Arabidopsis thaliana
  G279
MKGAKSKAETRSTKLSVTKKPAKGAKGAAKDPNKPKRPSSAFFVFMEDFRVTYKEEHPKNKSVAAVGKAGGEKWKSLSDSEKAPYVAKADKRKVEYEKNMKAYNKKLEEGPKEDEESDKSVSEVNDEDDAEDGSEEEEDDD

SEQ ID NO: 203 - DNA, 983 bp, Arabidopsis thaliana
  G280
aagttaatatgagaataatgagaaaaccactttcccaaattgctttttaaaatccctcctcacacagattccttccttcatcacctcacacactctctacgcttgacatggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctgaattaatcggtacttatgcaatttcggaatctttagttactgaaaaatggaatctcttagagagtaagagagtgctttaatttagcttaattagatttatttggatttctttcagtatttggattgtaaactttagaatttgtgtgtgtgttgttgcttagtcctgagataagatataacattagcgactgtgtattattattattactgcattgtgttatgtgaaactttgttctcttgttgaaaaaaaaaaaaaaaaaaa

SEQ ID NO: 204 - protein, 204 aa, Arabidopsis thaliana
  G280
MAFDLHHGSASDTHSSELPSFSLPPYPQMIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTDPPRSRGRPPKPKDPSEPPQEKVITGSGRPRGRPPKRPRTDSETVAAPEPAAQATGERRGRGRPPKVKPTVVAPVGC

SEQ ID NO: 205 - DNA, 1766 bp, Arabidopsis thaliana
  G285
tagagatccaaaacctcacaaatttcgaccgagttttgttgaattccgattagatctttcttccacgaaacccccccaagtacccattccatcttctccggtgagtctcccatgttggcattacgctagggttcttcttctctgtggtttcgcataacccaataatccaattttctacttgggcatcaatgggtcgctctcgagggaacttccaaaatttcgaagaccctactcagagaacgaggaaaaagaaaaatgcggctaatgtggagaactttgagtctacttctttggtaccaggtgctgagggaggagggaagtataactgcgattattgccagaaagacattactggaaaaattaggataaagtgtgctgtctgtccagattttgatctctgtatagaatgtatgtctgttggagcagagatcactcctcacaaatgtgatcacccataccgagttatgggaaatctaactttcccgcttatttgtcctgactggagtgcggatgatgaaatgcttctcctggagggacttgaaatttatggcttgggaaactgggcagaggttgcggagcacgtgggaacgaagagtaaagaacagtgtcttgagcactacagaaacatctatttgaactcaccatttttcccacttccggatatgtcacatgtagcagggaagaacagaaaagaacttcaagccatggctaaaggacgcattgatgacaagaaagagcagaacatgaaagaagagcacccgttctctcctcctaaagtcaaagttgaagacacacaaaaagagtcttttgtagacagaagttttggagggaagaaacctgtttccacctcggtaaacaactctttggttgagctgagtaattacaaccagaaaagagaagagtttgaccctgaatatgacaatgatgctgagcaactcttggcggagatggagttcaaagagaacgatactcctgaagaacatgaactgaagctgcgtgtgttgcgtatctattcaaaaaggcttgatgagaggaaacgtagaaaagaattcataatagaaagaaacctgttgtacccaaatccctttgagaaggacctgtctcaggaggagaaagtacaatgccgacgtttggacgtttttatgcgttttcattcaaaagaggagcacgacgagctactccgtaatgttgtaagcgagtaccgcatggtgaaacggctcaaagatctcaaggaagctcaagtggcagggtgtcgttcaacggctgaagcagagaggtatctgggaaggaagaggaagagagaaaacgaagaagggatgaacagagggaaagagagcggtcaatttggtcaaattgcaggggagatgggctctagaccacctgtgcaagcttcttcaagctatgtgaatgatttggacttgattgggttcacggagtcgcaactgctgtctgaatccgaaagcgtctctgcagcgaggtcaagttggttccaccggtttatctacagatgcaacaagtgatgtcacatgagatattcaaagggaatgtaccgaagaagtcggatgcatatagccttttcaagattgatccaaccaaagtggatcgagtttatgatatgcttgtgaagaagggtattgctcaactttaaggcttgtgtagtgttgtatcatatatataaatgtgtgagctctaatgagttatttgttgacattcccttgtttattacaccttgtcaaaattagtttgtaatagaaaaacgattacgg

SEQ ID NO: 206 - protein, 443 aa, Arabidopsis thaliana
  G285
MGRSRGNFQNFEDPTQRTRKKKNAANVENFESTSLVPGAEGGGKYNCDYCQKDITGKIRIKCAVCPDFDLCIECMSVGAEITPHKCDHPYRVMGNLTFPLICPDWSADDEMLLLEGLEIYGLGNWAEVAEHVGTKSKEQCLEHYRNIYLNSPFFPLPDMSHVAGKNRKELQAMAKGRIDDKKEQNMKEEHPFSPPKVKVEDTQKESFVDRSFGGKKPVSTSVNNSLVELSNYNQKREEFDPEYDNDAEQLLAEMEFKENDTPEEHELKLRVLRIYSKRLDERKRRKEFIIERNLLYPNPFEKDLSQEEKVQCRRLDVFMRFHSKEEHDELLRNVVSEYRMVKRLKDLKEAQVAGCRSTAEAERYLGRKRKRENEEGMNRGKESGQFGQIAGEMGSRPPVQASSSYVNDLDLIGFTESQLLSESESVSAARSSWFHRFIYRCNK

SEQ ID NO: 207 - DNA, 3684 bp, Arabidopsis thaliana
  G290
atgagtaagaaggattcagtatttcagtcgcaagcggatgatttctctggtggctttgaatttggagccgacgacgaggattttatgattgacatagaggcgatttatcggattctggatgaaagccctgtttctatggaggttagtcaagaaataatgtctccggttggttcatctgtggtagagtctggcgagtttaggaacacactgatgcaaagtggatctcaggccactggttggtttccttaccgggatttgtatggtcttggagcctcacaaagtgaaatagcagagccaagttcattttctgaccctgagaatggacgattgggactaagtgcgacttgttattctgactacggtggcaatgtggtctcctttcctgtaaattgtgaagatggcactgtatccatcctggatgacatgagaattgaatccaaatttacaccttgcagtcccactacgatgactacctatctcaataacatgcctggaaatgactcaggaattggagccacgcaaaattcttccctgatgtctcatttctcccctaattccagttctattgtggactgtgcctcctctgaaccatatggccaccatacaatggatgcacccttatcagaagtttctcccaatttggttcctggttacgcatttcagttctttcccaagaaagaagaactgctaaatgacttgaagaatgagtttatccactgtcagtcggatggtgcaagccgaatggtttttgatagacatgtaggattcgataacggaacttcagagaggaattctgggcctgatgtaagcagtgaaagagaactcagcctcaaatgtgaaatcattccttcagtttcccctgtctgtgtcaaaccatacaacagttctgatggtcatcaagttgaaaaggagcttgagcagcctgataattgttcaagcagttttcaggagaatagagcagtccatatgaaggttaaaccagagcttgcgttggagaacacggtttacagttcaattcctgggaactatagtagatgtagtgatgttcatacagttggaggaacgacactgccatggtctggtgtctctaattgcgcaatctcctatcagacagatgtcgggaaagaatacccttttatcccacctcagactgctttccctggtcaagatattgacggcaggagcttctatagttgttttgattcagatgactgttttcaaaacgtaacagatcctgacccagaaacatcacgcactgagtctttggattatctggtaggagacgaggaccatgaatatattaagaggacatgctttaatctttctagtttcagctctggaacagttgaaagtctttcatcaaaacgaatacccgaacgagaagatgattctgaaatccataaaatagaatcctatggtgaatttgttaatccacaccaatatctacctgtgcagagaccagtgttttcttcagaacattctacaggtagtcaaactcttaataattgtggaggcttgaagtttgagtcaaacaagggaaacatgaattttcatgcagacttgcaggatctttctcagcatagttctgaagcaagtcctcctgacggtgtcttggcagtgtcgcttcttagacatcagcgtattgcattgtcgtggatgtcccaaaaggagacaagcgggaacccctgttttgggggcattcttgctgatgatcagggacttggaaaaacagtttccacaatagcgcttatactgacagaacggtctacaccttatctaccatgtgaagaagattcaaagaatggaggatgcaatcaatctgatcactctcaagtggttttcaatgaaaacaaagttgtcgaagatagtttatgcaagatgaggggaaggccagctgccggaactcttattgtctgtcccactagtttgatgagacaatgggctgatgaattacgcaagaaggttactcttgaagcacatctctctgtgctggtataccacggttgcagcagaacaaaggatcctcacgagctagctaaatatgatgtcgtcattaccacatattcccttgtgagcaagaggaaacatatggattgtgaacctgttgagtttctgtctggccctctcgcgcaagtttcatggtttagagttgttctagatgaagctcagagcattaagaattacaaaacccaagcttcaatagcatgttcaggccttcatgctaagcgtaggtggtgtttgtctggcactcctatccagaattcaattgctgacctctacagctacttcagatttcttaagtatgatccttattctagctaccaaacgttttgtgaaacgattaagaaccccatcagtagctacccgggggaaggatataaaacgttgcaggctatcctgaaaaaagtaatgcttagacgaactaaagatacacttctcgatggaaaacccgtgatctctttacctccgaagtccatcgagttgaggagagtggactttaccaaggaagaacgtgatttctactcaaaactagagtgcgactctcgtgaccaattcaaggaatatgcagaagctggaacggtgaagcaaaattatgtaaatattttgttgatgctgctgcgtcttcgtcaagcttgtggccaccctcttctagtatccagtttgtcatggtcatcctcagctgaaatggttaagaagcttccatatgagaagctaacctttcttctgcatcgcttagaagcttcactggcaatttgtggtatctgcaatgtaagactctctactcatgctgttgtttcactctgtggtcacgttttctgtaatcagtgcatttgcgaatgtcttactcgcgataataatcaatgcccactgtcatactgcaaagtcggacttgaaatttcatcattattttccagagaaacactggaaaatgctatgcttgacttgcataaacttgatgccccatgtgatcgtaccacttcagatcctgttgggagtggtgagccttgtgaaaatttaccatgtggttcatccaaaatcaaggctgctctagatatcttgcaatcactgagcagaccacagagtcccgcgacagtaatgaatgatgtgaatcagagctccgaaaatggagagaataatcagcagcttgacaagtcattcagtttacctgcaactccagcgaagagtagtgtgggtggtgtggttaatgtagctggagaaaaagccattgtgtttacccaatggacaaagatgctggacctccttgaagctggtcttaagagttcaggtattcagtatagaaggtttgatggaaaaatgacagtaccagctcgagatgcagcagtacaagattttaatactctccctgatgtttctgtaatgataatgtctctcaaagctgctagtcttgggctaaatatggtggcagcttgtcatgttatcatgctggacttatggtggaacccgactacagaagatcaggcaattgacagagcacaccgtattggacagacacgaccagtaaaggtggtgcgcttcacagtaaaagatacagttgaagatcgcatattggccctccagcaaaagaagagaaagatggtggcttctgcattcggagaacatgaaaacggtagtcgagaatcgcatctctctgtggaggatttgaattatctgttcatggcatga

SEQ ID NO: 208 - protein, 1227 aa, Arabidopsis thaliana
  G290
MSKKDSVFQSQADDFSGGFEFGADDEDFMIDIEAIYRILDESPVSMEVSQEIMSPVGSSVVESGEFRNTLMQSGSQATGWFPYRDLYGLGASQSEIAEPSSFSDPENGRLGLSATCYSDYGGNVVSFPVNCEDGTVSILDDMRIESKFTPCSPTTMTTYLNNMPGNDSGIGATQNSSLMSHFSPNSSSIVDCASSEPYGHHTMDAPLSEVSPNLVPGYAFQFFPKKEELLNDLKNEFIHCQSDGASRMVFDRHVGFDNGTSERNSGPDVSSERELSLKCEIIPSVSPVCVKPYNSSDGHQVEKELEQPDNCSSSFQENRAVHMKVKPELALENTVYSSIPGNYSRCSDVHTVGGTTLPWSGVSNCAISYQTDVGKEYPFIPPQTAFPGQDIDGRSFYSCFDSDDCFQNVTDPDPETSRTESLDYLVGDEDHEYIKRTCFNLSSFSSGTVESLSSKRIPEREDDSEIHKIESYGEFVNPHQYLPVQRPVFSSEHSTGSQTLNNCGGLKFESNKGNMNFHADLQDLSQHSSEASPPDGVLAVSLLRHQRIALSWMSQKETSGNPCFGGILADDQGLGKTVSTIALILTERSTPYLPCEEDSKNGGCNQSDHSQVVFNENKVVEDSLCKMRGRPAAGTLIVCPTSLMRQWADELRKKVTLEAHLSVLVYHGCSRTKDPHELAKYDVVITTYSLVSKRKHMDCEPVEFLSGPLAQVSWFRVVLDEAQSIKNYKTQASIACSGLHAKRRWCLSGTPIQNSIADLYSYFRFLKYDPYSSYQTFCETIKNPISSYPGEGYKTLQAILKKVMLRRTKDTLLDGKPVISLPPKSIELRRVDFTKEERDFYSKLECDSRDQFKEYAEAGTVKQNYVNILLMLLRLRQACGHPLLVSSLSWSSSAEMVKKLPYEKLTFLLHRLEASLAICGICNVRLSTHAVVSLCGHVFCNQCICECLTRDNNQCPLSYCKVGLEISSLFSRETLENAMLDLHKLDAPCDRTTSDPVGSGEPCENLPCGSSKIKAALDILQSLSRPQSPATVMNDVNQSSENGENNQQLDKSFSLPATPAKSSVGGVVNVAGEKAIVFTQWTKMLDLLEAGLKSSGIQYRRFDGKMTVPARDAAVQDFNTLPDVSVMIMSLKAASLGLNMVAACHVIMLDLWWNPTTEDQAIDRAHRIGQTRPVKVVRFTVKDTVEDRILALQQKKRKMVASAFGEHENGSRESHLSVEDLNYLFMA

SEQ ID NO: 209 - DNA, 1350 bp, Arabidopsis thaliana
  G291
caagaacccaaagatctctctctatttgtttgccttcttctttctttctgactcaaaccctcaaatcaattctcgcgattaagcaaaaccctagatttattctactcttcgaagtcgatttcaatggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggttatcaaagacatcttgttcaattccgctcgtcagtccaagaagtctgctgacgactcatcagatccagagcccatgattacatcgtgaagttggtctattcttttgttttttggctgcggaaattgactatcggtttgacccggtttatgaggcaatgcccattgttccctatatctctagtgtagtatctgcttcagacaaagatctttgggttattaaatgacattaacataaaaaaaa

SEQ ID NO: 210 - protein, 357 aa, Arabidopsis thaliana
  G291
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 211 - DNA, 1333 bp, Arabidopsis thaliana
  G295
ctgttttctaaggccactaatcactcggatttgtgtcaggtgaaatggatagttactggagacttaaaaacttggtgaatgatttgccagttagtacttctttaagccgacaaggatcaatatactcatggacagtagatcagtttcagaccagcttagggttagattgtggatcaatgaacatggatgagttggttaagcatatatcaagtgctgaagaaacacaagaggggtcgcagaggcaaggctcaactactctgcctccaacacttagcaaacaaaatgttggtgaagtttggaaatctatcacagaggaaaaacacaccaataacaatggaggagtaacaaacattactcatcttcagggacaacaaaccttaggggaaatcactcttgaagagtttttcatccgtgctggagcaagaggaggtaataccaatggtggctccattcatgactcatcgtcatcgatttccggtaatccacacactagtttgggtgttcagattcagccaaaagccatggtttctgattttatgaacaatatggttccaaggagtcatgattcttatttgcatcaaaatgtgaatggatctatgtcaacatatcaaccacaacaatctatcatgtctatgccaaatggttattcttatggaaaacaaatccgattctcaaatggttccttgggatctggtaaccaaagtctccaagatacgaagagaagcttggtcccaagtgttgcgacaattccaagtgaagccataacatgttcaccggttaccccatttccaacattaaatgggaaacaaaagattaacggtgagtcttcattactctcaccatctccatacattagtaatggtagtactagtacaagaggtgggaagattaatagtgaaattaccgcggaaaaacaattcgttgacaaaaagcttaggagaaagattaagaaccgagaatccgcagcgagatcacgggctcgaaagcaagctcaaactatggaggttgaagttgaacttgaaaacttaaagaaagattatgaagagctactaaaacaacatgtagagttgcggaaaagacaaatggaaccaggaatgattagccttcatgaacgaccggagagaaagctgaggagaacgaaatcggacatcaagtgaatcaatgaaacccgagttggaggatgatgatgagtttattttgttcatcatgttttgttttcgtatatttttgaccaaataagctatttattagacatcttattcttaaacccatttgataatgtcctaaagatcgaattctcatggtctaggggaaaatccaaaacttattttta

SEQ ID NO: 212 - protein, 370 aa, Arabidopsis thaliana
  G295
MDSYWRLKNLVNDLPVSTSLSRQGSIYSWTVDQFQTSLGLDCGSMNMDELVKHISSAEETQEGSQRQGSTTLPPTLSKQNVGEVWKSITEEKHTNNNGGVTNITHLQGQQTLGEITLEEFFIRAGARGGNTNGGSIHDSSSSISGNPHTSLGVQIQPKAMVSDFMNNMVPRSHDSYLHQNVNGSMSTYQPQQSIMSMPNGYSYGKQIRFSNGSLGSGNQSLQDTKRSLVPSVATIPSEAITCSPVTPFPTLNGKQKINGESSLLSPSPYISNGSTSTRGGKINSEITAEKQFVDKKLRRKIKNRESAARSRARKQAQTMEVEVELENLKKDYEELLKQHVELRKRQMEPGMISLHERPERKLRRTKSDIK

SEQ ID NO: 213 - DNA, 2443 bp, Arabidopsis thaliana
  G301
ctatgaagctaagaacttcatacatatcggaggttttactccggcgagggcaagcaccgccgcaggtaaagtccaaagcccttcgccacagattagccctgaagccaccgccggaaccataaactctgctttcttccgattcatcttctcccaaacaaacacaatcaaagtcccaacacacatgtcgattgcgaaataagctccgacaagaaacggaacagccatcgccgtcggaagtggcatgaatcttccaatcttcgccggagtaagatctctgacgacgttgaccaaaacagcaaacccgaaaaacccgtaacacatttggagacagtgaagaggcagagcagagaagccttgcaccccaagaatcgccatatttctgtaaatcaaagcgtaaggagccttgaattctccgttagggtttccaatgtcgaacgctttgtagaacaaaaagaaacttaacggcgtcacgatgcatccaacgaccgttccaatcatttggctagcaaacatagccttaggtgacgtcatcgtgtaatgagccgtcttgaaatcttgcatcaaaatacaagaaaccgaaacaacggatttgatcagtccacaaccggcgagtccggctacaactccgttctctcttcccgtcacagccgcgatgacaaaaagaccaattttgccgtagttataagccatgttaatgtctgtaagtccagctccataagcgttacagaaggccagagaaggcgcgaaaatgtaagctacaataacgtaataccatttgagctgaggaaatatcagaggaaccacgacggttgagaccgcagcgaatgtaagatatccggaaactgcgaaccacattgggattttatctctgaggaaattctcatcttccttgagatctttccgttgtttcttgtgacctacgtcatctagatcattaggtttgttcttcaatcttgcgttgacattggcaatggtcacaaagaggatcttaacgaaagtgtaaagaccgtcgccgaggattagagctacggataagaagactttgtagccgtaaatgctcttcatgttgtgttcgtcgagattatcagggaaccaagagcccttaagtttatcaagaagaggccacattaagccataagagaggatagctcctaaaagcaaagaaaggttaaccaaatgtgaacaaatcattcctgctcccacaaatgtcatgctgaaatcaaagaagaacctaccaaaaaaaagtttttagttattatatgattcaagaactcgtttcactgaaatatttttgttttgtttttgtataattaatgcttacgtttgtttccaagctttcaaaccaaaggttgggaattgagcaaagccacaatcttcaataccagagaaaaaccactggaagaaaccccacaagaaactaaatgagaagtatttcatgaaaccacgcacttgtttcctgcaaatcgattccaattaaagattaggaaacttatgtaacaatatcactttttgtaaaataggttaatgaacttacttggcctgtgcatctccttgtgtgtggaagccattgatgagaaccgcagtagctaaaccactcggatatgttaatttaaggtcaacaatcataacctttcggagagggattaggacaaaaagaccgatgaaacagacaacaaagagataagcagtcatccaaccaaggccaggttctttcacactctttggagagttaccttccaagttcacaccagacaacacatatgtcttatggtttaaccccagaagatatgaagcaaacccacctgaaaaagaaaaacaaatactcaaatattttaaatcaaaattttacaacttagattttatatcatacccaaaagcaaaagcaatatcaacccttttttgtgactcaactaacccaaaagtttttcaaaaagttaatatattttagtatgtttggaactgtttcacagatcctttcactgaatctttgcttgtttcgcaagaaaataaactattaagaaataaataaaagcaaatttatgttcttaaattaacctccgacagcgatgccgtaacaagcaacagcagatgtctgaatcattgtgttctcttgtcttgtgaatggtttcgcaacaaatcctgatttcttgagaatcttagtccaagtctggacaaagacaaaagcaagtaaagctgcagagctgttgagatttggaacaattcctgtcgtgagatttagcttctgagcaatcacactgaacacaactccgatcactatgctcacgaacactcctctcaccgttatctgcttcgtccacggttcgattgtcctcccagacatctcttcctctgtatctggttcttcttcttgcagtgaaagttgattgttgtcttcttcttcttctccttctctcttcatgatccttctttgctctatttccat

SEQ ID NO: 214 - protein, 620 aa, Arabidopsis thaliana
  G301
MKREGEEEEDNNQLSLQEEEPDTEEEMSGRTIEPWTKQITVRGVFVSIVIGVVFSVIAQKLNLTTGIVPNLNSSAALLAFVFVQTWTKILKKSGFVAKPFTRQENTMIQTSAVACYGIAVGGGFASYLLGLNHKTYVLSGVNLEGNSPKSVKEPGLGWMTAYLFVVCFIGLFVLIPLRKVMIVDLKLTYPSGLATAVLINGFHTQGDAQAKFFFDFSMTFVGAGMICSHLVNLSLLLGAILSYGLMWPLLDKLKGSWFPDNLDEHNMKSIYGYKVFLSVALILGDGLYTFVKILFVTIANVNARLKNKPNDLDDVGHKKQRKDLKEDENFLRDKIPMWFAVSGYLTFAAVSTVVVPLIFPQLKWYYVIVAYIFAPSLAFCNAYGAGLTDINMAYNYGKIGLFVIAAVTGRENGVVAGLAGCGLIKSVVSVSCILMQDFKTAHYTMTSPKAMFASQMIGTVVGCIVTPLSFFLFYKAFDIGNPNGEFKAPYALIYRNMAILGVQGFSALPLHCLQMCYGFFGFAVLVNVVRDLTPAKIGRFMPLPTAMAVPFLVGAYFAIDMCVGTLIVFVWEKMNRKKAEFMVPAVASGLICGEGLWTLPAAVLALAGVKPPICMKFLAS

SEQ ID NO: 215 - DNA, 1764 bp, Arabidopsis thaliana
  G307
atgaagagagatcatcaccaattccaaggtcgattgtccaaccacgggacttcttcttcttcatcatcaatctctaaagataagatgatgatggtgaaaaaagaagaagacggtggaggtaacatggacgacgagcttctcgctgttttaggttacaaagttaggtcatcggagatggcggaggttgctttgaaactcgaacaattagagacgatgatgagtaatgttcaagaagatggtttatctcatctcgcgacggatactgttcattataatccgtcggagctttattcttggcttgataatatgctctctgagcttaatcctcctcctcttccggcgagttctaacggtttagatccggttcttccttcgccggagatttgtggttttccggcttcggattatgaccttaaagtcattcccggaaacgcgatttatcagtttccggcgattgattcttcgtcttcgtcgaataatcagaacaagcgtttgaaatcatgctcgagtcctgattctatggttacatcgacttcgacgggtacgcagattggtggagtcataggaacgacggtgacgacaaccaccacgacaacgacggcggcggctgagtcaactcgttctgttatcctggttgactcgcaagagaacggtgttcgtttagtccacgcgcttatggcttgtgcagaagcaatccagcagaacaatttgactctagcggaagctcttgtgaagcaaatcggatgcttagctgtgtctcaagccggagctatgagaaaagtggctacttacttcgccgaagctttagctcggcggatctaccgtctctctccgccgcagaatcagatcgatcattgtctctccgatactcttcagatgcacttttacgagacttgtccttatcttaaattcgctcacttcacggcgaaccaagcgattctcgaagcttttgaaggtaagaagagagtacacgtcattgatttctcgatgaaccaaggtcttcaatggcctgcgcttatgcaagctcttgcgcttcgagaaggaggtcctccaactttccggttaaccggaattggtccaccggcgccggataattctgatcatcttcatgaagttggttgtaaattagctcagcttgcggaggcgattcacgtagaattcgaataccgtggattcgttgctaacagcttagccgatctcgatgcttcgatgcttgagcttagaccgagcgatacggaagctgttgcggtgaactctgtttttgagctacataagctcttaggtcgtcccggtgggatagagaaagttctcggcgttgtgaaacagattaaaccggtgattttcacggtggttgagcaagaatcgaaccataacggaccggttttcttagaccggtttactgaatcgttacattattattcgactctgtttgattcgttggaaggagttccgaatagtcaagacaaagtcatgtctgaagtttacttagggaaacagatttgtaatctggtggcttgtgaaggtcctgacagagtcgagagacacgaaacgttgagtcaatggggaaaccggtttggttcgtccggtttagcgccggcacatcttgggtctaacgcgtttaagcaagcgagtatgcttttgtctgtgtttaatagtggccaaggttatcgtgtggaggagagtaatggatgtttgatgttgggttggcacactcgcccactcattaccacctccgcttggaaactctcgacggcggcgcactga

SEQ ID NO: 216 - protein, 587 aa, Arabidopsis thaliana
  G307
MKRDHHQFQGRLSNHGTSSSSSSISKDKMMMVKKEEDGGGNMDDELLAVLGYKVRSSEMAEVALKLEQLETMMSNVQEDGLSHLATDTVHYNPSELYSWLDNMLSELNPPPLPASSNGLDPVLPSPEICGFPASDYDLKVIPGNAIYQFPAIDSSSSSNNQNKRLKSCSSPDSMVTSTSTGTQIGGVIGTTVTTTTTTTTAAAESTRSVILVDSQENGVRLVHALMACAEAIQQNNLTLAEALVKQIGCLAVSQAGAMRKVATYFAEALARRIYRLSPPQNQIDHCLSDTLQMHFYETCPYLKFAHFTANQAILEAFEGKKRVHVIDFSMNQGLQWPALMQALALREGGPPTFRLTGIGPPAPDNSDHLHEVGCKLAQLAEAIHVEFEYRGFVANSLADLDASMLELRPSDTEAVAVNSVFELHKLLGRPGGIEKVLGVVKQIKPVIFTVVEQESNHNGPVFLDRFTESLHYYSTLFDSLEGVPNSQDKVMSEVYLGKQICNLVACEGPDRVERHETLSQWGNRFGSSGLAPAHLGSNAFKQASMLLSVFNSGQGYRVEESNGCLMLGWHTRPLITTSAWKLSTAAH

SEQ ID NO: 217 - DNA, 1951 bp, Arabidopsis thaliana
  G308
agtaatttagttttttttttttttttttacaatttattttgttattagaagtggtagtggagtgaaaaaacaaatcctaagcagtcctaaccgatccccgaagctaaagattcttcaccttcccaaataaagcaaaacctagatccgacattgaaggaaaaaccttttagatccatctctgaaaaaaacccaaccatgaagagagatcatcatcatcatcatcaagataagaagactatgatgatgaatgaagaagacgacggtaacggcatggatgagcttctagctgttcttggttacaaggttaggtcatcggaaatggctgatgttgctcagaaactcgagcagcttgaagttatgatgtctaatgttcaagaagacgatctttctcaactcgctactgagactgttcactataatccggcggagctttacacgtggcttgattctatgctcaccgaccttaatcctccgtcgtctaacgccgagtacgatcttaaagctattcccggtgacgcgattctcaatcagttcgctatcgattcggcttcttcgtctaaccaaggcggcggaggagatacgtatactacaaacaagcggttgaaatgctcaaacggcgtcgtggaaaccaccacagcgacggctgagtcaactcggcatgttgtcctggttgactcgcaggagaacggtgtgcgtctcgttcacgcgcttttggcttgcgctgaagctgttcagaaggagaatctgactgtggcggaagctctggtgaagcaaatcggattcttagctgtttctcaaatcggagctatgagacaagtcgctacttacttcgccgaagctctcgcgcggcggatttaccgtctctctccgtcgcagagtccaatcgaccactctctctccgatactcttcagatgcacttctacgagacttgtccttatctcaagttcgctcacttcacggcgaatcaagcgattctcgaagcttttcaagggaagaaaagagttcatgtcattgatttctctatgagtcaaggtcttcaatggccggcgcttatgcaggctcttgcgcttcgacctggtggtcctcctgttttccggttaaccggaattggtccaccggcaccggataatttcgattatcttcatgaagttgggtgtaagctggctcatttagctgaggcgattcacgttgagtttgagtacagaggatttgtggctaacactttagctgatcttgatgcttcgatgcttgagcttagaccaagtgagattgaatctgttgcggttaactctgttttcgagcttcacaagctcttgggacgacctggtgcgatcgataaggttcttggtgtggtgaatcagattaaaccggagattttcactgtggttgagcaggaatcgaaccataatagtccgattttcttagatcggtttactgagtcgttgcattattactcgacgttgtttgactcgttggaaggtgtaccgagtggtcaagacaaggtcatgtcggaggtttacttgggtaaacagatctgcaacgttgtggcttgtgatggacctgaccgagttgagcgtcatgaaacgttgagtcagtggaggaaccggttcgggtctgctgggtttgcggctgcacatattggttcgaatgcgtttaagcaagcgagtatgcttttggctctgttcaacggcggtgagggttatcgggtggaggagagtgacggctgtctcatgttgggttggcacacacgaccgctcatagccacctcggcttggaaactctccaccaattagatggtggctcaatgaattgatctgttgaaccggttatgatgatagatttccgaccgaagccaaactaaatcctactgtttttccctttgtcacttgttaagatcttatctttcattatattaggtaattgaaaaattttaatctcgcctaaattact

SEQ ID NO: 218 - protein, 532 aa, Arabidopsis thaliana
  G308
MKRDHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRQVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 219 - DNA, 864 bp, Arabidopsis thaliana
  G313
atggtgtcagtctcaggcagtccgatccaacggctaggcacttacatggcagaagggcttagagcgaggcttgaggggtctgggagcaatatatacaaatccttgaaatgcaatgaaccaacgggaagggaactgatgtcttacatgagtgttctctatgaaatctgcccctactggaaattcgcgtacacaactgcgaatgttgagatcttggaagcaatagctggggaaaccagagtccacattatcgattttcagattgcacagggatcacaatacatgtttttgattcaggagcttgcgaaacaccctggtgggccgccgttgctgcgtgtgacgggtgtggatgattcacagtccacctatgctcgtgggggaggactcagcttggtaggtgagaggcttgcaactttggcgcagtcatgtggtgtcccgtttgagtttcacgatgccatcatgtctgggtgcaaggtgcagcgggaacatctcgggttggaacctggctttgctgttgttgtgaacttcccatatgtattacaccacatgccagacgagagcgtaagtgttgaaaatcacagagacaggctgctgcatctgatcaagagcctctccccaaaactggttactctagtagagcaagaatccaacacaaacacctcgccattcctgtcacggtttgtggaaacactggattactacacagcgatgtttgagtcgatagatgcagcacggccacgggatgataagcagagaatcagcgcagaacaacactgtgtagcaagagacatagtgaacatgatagcatgtgaggagtcagagagagtagagagacacgaggtactgggaaatggagggtcagaatga

SEQ ID NO: 220 - protein, 287 aa, Arabidopsis thaliana
  G313
MVSVSGSPIQRLGTYMAEGLRARLEGSGSNIYKSLKCNEPTGRELMSYMSVLYEICPYWKFAYTTANVEILEAIAGETRVHIIDFQIAQGSQYMFLIQELAKHPGGPPLLRVTGVDDSQSTYARGGGLSLVGERLATLAQSCGVPFEFHDAIMSGCKVQREHLGLEPGFAVVVNFPYVLHHMPDESVSVENHRDRLLHLIKSLSPKLVTLVEQESNTNTSPFLSRFVETLDYYTAMFESIDAARPRDDKQRISAEQHCVARDIVNMIACEESERVERHEVLGNGGSE

SEQ ID NO: 221 - DNA, 1380 bp, Arabidopsis thaliana
  G315
atggacgaacatgtcatgcgttcaatggattgggattccatcatgaaagaattggagcttgatgacgattctgctcctaactcacttaaaaccggtttcaccacaaccacaacagattctactattttgcctctttacgccgtcgattcaaatctccctggctttcccgatcagattcaaccgtcggatttcgaatcgtcttccgatgtttatcctggtcagaaccaaacaactgggtacggttttaattctcttgatagtgtcgacaatggaggatttgatttcattgaagatctcatccgagtcgtggattgtgttgaatcggacgagttacaactcgctcaggtggttttatcacggcttaatcaacgcttgagatctccggcgggtagaccgttacagagagctgcgttttactttaaggaagctctcggttcgtttttaaccggatcaaaccggaatccaatccggttatcttcttggtccgagattgttcagaggatccgagcgattaaggaatattccgggatttctccgatccctctcttctctcatttcacggcgaatcaagcgatactcgattcgttgagctcgcagtcgtcttctccgtttgttcacgtggtggattttgagattggattcggtggccaatacgcatcgcttatgagagaaatcactgagaaatctgtaagcggtggatttttaagagttacggcagtggtggcggaggagtgcgccgtagagacgcgactagtgaaagaaaacctaactcaattcgcggcggagatgaaaattcgtttccagattgagtttgtgctgatgaagacttttgagatgttatctttcaaagcgattaggtttgttgagggggagaggaccgtcgttttgatttccccggcgatatttcgtcgtctaagtggaatcactgattttgttaacaatttacggagagtatcacctaaggtcgttgtattcgtggatagtgaaggatggacggagatcgccggatctggatcattccggcgagagtttgttagcgctcttgagttctacacgatggtgctggagtcgctcgacgctgcagctcctcccggagatttggtgaagaagatagtggaagcgttcgttctacgaccgaagatctccgctgcggtagaaacggcggctgacaggagacacaccggcgaaatgacttggcgggaagcgttttgcgccgccgggatgaggccgatacagcaaagccagttcgccgactttcaagctgagtgtttattggagaaagcgcaagttagaggattccacgtggcgaaacgacaaggagaattggtgctgtgctggcatggaagagcacttgttgccacatcagcttggcggttttag

SEQ ID NO: 222 - protein, 459 aa, Arabidopsis thaliana
  G315
MDEHVMRSMDWDSIMKELELDDDSAPNSLKTGFTTTTTDSTILPLYAVDSNLPGFPDQIQPSDFESSSDVYPGQNQTTGYGFNSLDSVDNGGFDFIEDLIRVVDCVESDELQLAQVVLSRLNQRLRSPAGRPLQRAAFYFKEALGSFLTGSNRNPIRLSSWSEIVQRIRAIKEYSGISPIPLFSHFTANQAILDSLSSQSSSPFVHVVDFEIGFGGQYASLMREITEKSVSGGFLRVTAVVAEECAVETRLVKENLTQFAAEMKIRFQIEFVLMKTFEMLSFKAIRFVEGERTVVLISPAIFRRLSGITDFVNNLRRVSPKVVVFVDSEGWTEIAGSGSFRREFVSALEFYTMVLESLDAAAPPGDLVKKIVEAFVLRPKISAAVETAADRRHTGEMTWREAFCAAGMRPIQQSQFADFQAECLLEKAQVRGFHVAKRQGELVLCWHGRALVATSAWRF

SEQ ID NO: 223 - DNA, 876 bp, Arabidopsis thaliana
  G325
atggaggctcgatgtgacttttgtggaaccgaaaaagcattaatctactgcaaatctgattcggctaaactttgtttaaactgtgacgttaatgtacactcagcgaatcctctgtctcaaagacacacgcgatctctactctgcgagaaatgttccttacaacccacggcagtacactgtatgaacgaaaatgtttctctttgccaaggatgtcagtggaccgctagtaactgcactggtttaggacacagacttcagagtctgaacccttactctgattgtccttctccatcagatttcggcaagatctggtcttcaactttagaaccttctgtcacaagtttggtctctccattttctgataccctgctccaggaattagacgattggaatggttcatcaacttccgtggttacacaaactcagaaccttaaagactattcttctttctttcctatggaatctaatcttccaaaagtgatagaagaggaatgttctggtttggatctatgcgaagggataaacttagatgatgcgccgttgaatttcaacgcaagcaatgatataatcggatgttcatcacttgacaataccaaatgttacgagtacgaggattcttttaaggaagagaataacattggccttccttcattactgcttcctactttatccgggaacgttgtaccgaacatgtcactttcgatgtctaacctcacaggagaaagcaatgcgactgattaccaagattgcggaatttcaccagggtttctcataggagattcgccatgggaatcgaatgttgaagttagttttaatccaaaattaagggatgaggctaaaaagagatacaaacaaaagaaatcaaagcgcatgtaa

SEQ ID NO: 224 - protein, 291 aa, Arabidopsis thaliana
  G325
MEARCDFCGTEKALIYCKSDSAKLCLNCDVNVHSANPLSQRHTRSLLCEKCSLQPTAVHCMNENVSLCQGCQWTASNCTGLGHRLQSLNPYSDCPSPSDFGKIWSSTLEPSVTSLVSPFSDTLLQELDDWNGSSTSVVTQTQNLKDYSSFFPMESNLPKVIEEECSGLDLCEGINLDDAPLNFNASNDIIGCSSLDNTKCYEYEDSFKEENNIGLPSLLLPTLSGNVVPNMSLSMSNLTGESNATDYQDCGISPGFLIGDSPWESNVEVSFNPKLRDEAKKRYKQKKSKRM

SEQ ID NO: 225 - DNA, 1558 bp, Arabidopsis thaliana
  G326
caattaatgacatcttcttcttctcctttcactgcaaaaccgaaagcttgagactttgagattatgtctatgtcatcttcttcttcttccatcgatcacttcatcacctttcgtcatcttgatcttattctccactgtataaaatcagcgagattttaagggattgtgaaggtaccatcttaaacacaaaatgggtacttctactacagagagtgtggtggcgtgtgaattttgcggcgagagaacggcggttctgttttgtagagccgatacggcgaagctttgtttgccttgtgaccagcacgtgcactcggcgaaccttctctcgaggaagcatgttcgttctcagatctgtgataactgtagcaaagagccggtgtccgtacgttgcttcacagataatctcgtattgtgtcaggagtgtgattgggatgttcacggaagctgttcctcctccgcgacgcatgaacgctccgccgtggaagggttttcaggttgtccttcggttttggagcttgctgctgtgtggggaatcgatttaaagggtaagaagaaagaagatgacgaagacgaattgactaagaattttgggatggggttggattcgtggggttctggatctaacatcgttcaagaactgattgttccttatgatgtgtcttgcaaaaagcaaagctttagctttgggaggtctaagcaggtagtgtttgaacagcttgagttactgaagagaggcttcgttgaaggcgaaggagagattatggttccggagggaatcaatggcggaggaagcatttctcagccatctccgacgacgtcgtttacttctttgcttatgtctcaaagtctttgtggtaatggtatgcaatggaatgctactaatcatagcactggccagaacactcagatatgggattttaacttgggacagtcgaggaaccctgatgaacctagtccagtcgaaactaaaggctctactttcacattcaacaacgttactcatctcaagaacgatacccgaaccaccaatatgaatgctttcaaagagagttaccaggaggattccgtccactcaacttctaccaagggacaggaaacatctaagagcaacaatattcctgctgccattcactcgcataaaagttctaacgactcctgtggcttgcattgcacggaacatattgctattactagtaatagagccacaagattggtggcggtaacgaatgctgatctagagcagatggcacagaacagagataatgctatgcagcggtacaaggaaaagaagaaaacgcggagatatgataagaccataagatatgaaacgaggaaggcgagagccgagaccaggttgcgtgttaagggcagatttgtgaaagctacagatccttagatgtctctccacgttaggttttacatttgagatcctaagttaggaactttttttgttttttctactttcaactaccttgtaaatgtaaatgatcgatcttcagctgcataatgtgtggccagatttttgtaatttttacgtttaaccttctaaaaaaaaaaa

SEQ ID NO: 226 - protein, 401 aa, Arabidopsis thaliana
  G326
MGTSTTESVVACEFCGERTAVLFCRADTAKLCLPCDQHVHSANLLSRKHVRSQICDNCSKEPVSVRCFTDNLVLCQECDWDVHGSCSSSATHERSAVEGFSGCPSVLELAAVWGIDLKGKKKEDDEDELTKNFGMGLDSWGSGSNIVQELIVPYDVSCKKQSFSFGRSKQVVFEQLELLKRGFVEGEGEIMVPEGINGGGSISQPSPTTSFTSLLMSQSLCGNGMQWNATNHSTGQNTQIWDFNLGQSRNPDEPSPVETKGSTFTFNNVTHLKNDTRTTNMNAFKESYQEDSVHSTSTKGQETSKSNNIPAAIHSHKSSNDSCGLHCTEHIAITSNRATRLVAVTNADLEQMAQNRDNAMQRYKEKKKTRRYDKTIRYETRKARAETRLRVKGRFVKATDP

SEQ ID NO: 227 - DNA, 1169 bp, Arabidopsis thaliana
  G335
ttagctcaatatgtcggatgagttgtggaatgagatacaaaacctagaattaggtcaagaagatccagccctttttatccctcatgaggcttatgtgatggtggaagctaccaatagacttagtatgatagctagacctctgaacccaagggtccagaacctcaattctgttgtggtagcattaccaagaacatggggtttaacaaatcaagttcatggcagaatacttgatgctacttatgttcagtttctttttcaaaatgaaattgatctaatgatggttcaacgcaaggagccttggctttttaacaattggtttgttgcagctactcgatgggaggtggcaccggctcataacttcgttactacaattgatctgtgggtgcagattcgtggaatccctctgccatatgtttctgaggagacggttatggagattgctcaagatctgggggaagttcttatgctagactaccatgatacaacatctattcagattgcttacatacgggtgagagtgcgctttggtattacggacaggctaaggttctttcagcgaattgtctttgactccggggaaactgcaacaataagatttcagtatgaacgtctccggagaatctgcagtagctgcttcagattcactcacaacagagcttattgtccataccgaccaagacctctcagcattgcaagggaaagagctctgtttagggatagtgtgcatcgttcctccatgaactctcagtctcagatgactgatagttcatttccaattccccagactccaccaccaagaatatcccacccaccactgaatcatgatgagtttgtagctgcttatcctcacttggactcaggtaggaatgaccacatcagatgtgagggagaatcaagcaatttcagacaagacttgtcttcagcttcaaactccataactccaagaagggaaccacaatacctaactgatagaagacactttgaacctggtcaatcctcaagaagacatgatgttcgggatttaagaagagggtcagagaggattgggaatctcaatcaacagaactatgtgcaaagatcaggagggatactgaaacctccgaagaaacgctaaacactctaccaacttctgttttttttggattgaagtctgcaggttaacaaggaag

SEQ ID NO: 228 - protein, 367 aa, Arabidopsis thaliana
  G335
MSDELWNEIQNLELGQEDPALFIPHEAYVMVEATNRLSMIARPLNPRVQNLNSVVVALPRTWGLTNQVHGRILDATYVQFLFQNEIDLMMVQRKEPWLFNNWFVAATRWEVAPAHNFVTTIDLWVQIRGIPLPYVSEETVMEIAQDLGEVLMLDYHDTTSIQIAYIRVRVRFGITDRLRFFQRIVFDSGETATIRFQYERLRRICSSCFRFTHNRAYCPYRPRPLSIARERALFRDSVHRSSMNSQSQMTDSSFPIPQTPPPRISHPPLNHDEFVAAYPHLDSGRNDHIRCEGESSNFRQDLSSASNSITPRREPQYLTDRRHFEPGQSSRRHDVRDLRRGSERIGNLNQQNYVQRSGGILKPPKKR

SEQ ID NO: 229 - DNA, 2183 bp, Arabidopsis thaliana
  G341
gaatccgattccacaggtggaactatgtgctgtggatcagaccgattaaaccagatcgtgtcatcaagatcttcgttgccaatttctttcgaggaagataacaatcttgttaccaacacagacatgaatcacttaacagtcgaaacagaggatacgtttgcgagcttgcttgagcttgcagctaacaacgatgttgaaggtgtaaggctatctatcgagagagacccttcttgtgtagacgaagctggtctctggtacggtcgtcaaaaaggttctaaagctatggtcaacgattacaggactccgttgatggttgctgctacttacggaagcattgatgtgatcaagcttattgtttctttgactgatgctgacgtgaaccgtgcttgcgggaatgatcagaccactgcgttacactgcgctgcttctggaggagctgtgaatgctatccaagttgttaagctgcttcttgcagctggagctgatttgaatctgttggatgctgaaggtcaacgagctggtgatgttattgttgttcctcctaagcttgaaggcgtgaagctgatgcttcaggagcttctttctgctgatggatcatctactgcggagcggaatctacgggttgtgacaaatgttccgaatagaagctcatctccgtgtcattctcctactggagagaatggtggatcagggtctggttcaccgctcggctctccttttaagctgaaatctactgaattcaagaaagagtatccggttgatccgtctttgccagatatcaagaacagtatctacgcgactgatgagtttagaatgtattccttcaaggtccggccttgctctcgtgcttattcacatgattggactgagtgtccttttgttcacccgggtgaaaacgcgaggaggagagacccgaggaagttccattacagctgcgttccttgcccggattttaggaaaggagcttgtaggagaggagatatgtgtgagtatgcgcacggtgtgtttgaatgctggcttcatccggctcagtacaggacccgtctttgcaaagatggaacaggctgtgctcggcgggtttgtttctttgcgcatacacccgaggagcttcgacctttgtacgcatcaactggttcagcggttccttcgcctagatcgaatgctgattatgcagctgctttgagtctccttcctggttctccatcaggagtctctgtcatgtccccgctttccccatcagcagcggggaacggaatgtctcattcgaatatggcttggccacaaccaaatgtccctgcgttgcacttaccaggaagcaatctacagtcaagcaggctaaggtcttctctcaatgcaagggatatcccgacggatgagttcaatatgttagcggattacgagcagcagcaactcctcaacgagtattccaatgctctgagccgttctggtcggatgaaatcaatgcctccttcgaatcttgaagatcttttctcagcagaaggctcttcatctccccggttcactgattccgctttagcttccgcggtgttctcgcctacacacaagtcagctgtcttcaaccagttccaacaacagcaacagcagcagcagagcatgttgtctccaatcaacacaagcttttcttcaccaaagagcgttgaccactcattgttttcaggtggaggaagaatgtctcctcggaatgttgttgaaccaatatcacccatgagtgctcgggtttccatgttggctcagtgcgtgaagcaacaacaacagcaacagcagcagcagcagcagcaacatcagttccgtagccttagctccagagagctcagaacaaactctagcccaatcgttggttcaccggtaaacaacaacacatggtcatcaaaatggggatcttcaaatggtcaaccggattggggaatgagctcagaagcacttggtaagttgagatcttcgtcatcgtttgatggtgatgagcctgatgtgtcatgggtccagtcactggtgaaggagactccagcagaagccaaagagaaagcagcaacatcttcctcaggggaacacgtgatgaagcagccaaatccggttgaaccggtaatggatcatgctgggctagaagcttggattgagcaaatgcagctcgatcagcttgtggctcagcagaattgagagaccta

SEQ ID NO: 230 - protein, 716 aa, Arabidopsis thaliana
  G341
MCCGSDRLNQIVSSRSSLPISFEEDNNLVTNTDMNHLTVETEDTFASLLELAANNDVEGVRLSIERDPSCVDEAGLWYGRQKGSKAMVNDYRTPLMVAATYGSIDVIKLIVSLTDADVNRACGNDQTTALHCAASGGAVNAIQVVKLLLAAGADLNLLDAEGQRAGDVIVVPPKLEGVKLMLQELLSADGSSTAERNLRVVTNVPNRSSSPCHSPTGENGGSGSGSPLGSPFKLKSTEFKKEYPVDPSLPDIKNSIYATDEFRMYSFKVRPCSRAYSHDWTECPFVHPGENARRRDPRKFHYSCVPCPDFRKGACRRGDMCEYAHGVFECWLHPAQYRTRLCKDGTGCARRVCFFAHTPEELRPLYASTGSAVPSPRSNADYAAALSLLPGSPSGVSVMSPLSPSAAGNGMSHSNMAWPQPNVPALHLPGSNLQSSRLRSSLNARDIPTDEFNMLADYEQQQLLNEYSNALSRSGRMKSMPPSNLEDLFSAEGSSSPRFTDSALASAVFSPTHKSAVFNQFQQQQQQQQSMLSPINTSFSSPKSVDHSLFSGGGRMSPRNVVEPISPMSARVSMLAQCVKQQQQQQQQQQQQHQFRSLSSRELRTNSSPIVGSPVNNNTWSSKWGSSNGQPDWGMSSEALGKLRSSSSFDGDEPDVSWVQSLVKETPAEAKEKAATSSSGEHVMKQPNPVEPVMDHAGLEAWIEQMQLDQLVAQQN

SEQ ID NO: 231 - DNA, 825 bp, Arabidopsis thaliana
  G346
atggaaatggaatcattcatggacgaccttttgaacttctctgtaccggaagaggaagaagacgacgacgaacatacgcaaccaccgaggaatattactcgccggaaaactggattacggccaacagactccttcggtctctttaataccgacgaccttggagtggttgaagaagaggatttggaatggatttcaaacaaaaatgcttttccggtgattgaaacattcgtcggtgtattaccgtcggagcattttcctataacgtctcttctggaaagagaagcgactgaggtaaaacagctgagtccggtttcagtacttgagacgagtagccatagctccacaacgactacctcaaacagtagcggcggaagtaacggaagcacggccgtggctacgaccaccaccactccaacaataatgagctgttgcgttggttttaaagcgccggctaaagcgagaagcaagcgtcgtcgtacaggacgccgtgatttacgagttttgtggacaggaaacgagcaaggaggaatacagaagaagaagacgatgactgtggcggcggctgcgttgattatgggaaggaagtgtcaacactgtggagcggagaagactccgcaatggagggcaggaccagcggggcctaagactctgtgtaacgcttgtggcgtgaggtataagtccgggaggctagttccggagtatcgtccagcgaacagtccaactttcacggcggagttacattcgaattctcaccggaagattgtagagatgaggaagcagtatcagtccggtgacggtgacggtgatcggaaagattgtggataa

SEQ ID NO: 232 - protein, 274 aa, Arabidopsis thaliana
  G346
MEMESFMDDLLNFSVPEEEEDDDEHTQPPRNITRRKTGLRPTDSFGLFNTDDLGVVEEEDLEWISNKNAFPVIETFVGVLPSEHFPITSLLEREATEVKQLSPVSVLETSSHSSTTTTSNSSGGSNGSTAVATTTTTPTIMSCCVGFKAPAKARSKRRRTGRRDLRVLWTGNEQGGIQKKKTMTVAAAALIMGRKCQHCGAEKTPQWRAGPAGPKTLCNACGVRYKSGRLVPEYRPANSPTFTAELHSNSHRKIVEMRKQYQSGDGDGDRKDCG

SEQ ID NO: 233 - DNA, 363 bp, Arabidopsis thaliana
  G348
atggatccaaggaagctactatcttgttcatcctcttacgtgtcagtgagaatgaaagaagagaaggggacaattaggtgttgcagtgagtgtaagaccaccaagacaccaatgtggagaggtggaccaactggtcctaagtcactttgcaatgcatgtggaattagacacagaaaacagagacgatcagagttattgggtattcatattattcgcagccacaaaagcttagcctccaagaagataaacctattatcatcatcacacggtggcgtggcggtgaagaaacgaaggagtctaaaggaggaagaacaagctgctttgtgtctattgttattgtcttgtagctctgttttggcctaa

SEQ ID NO: 234 - protein, 120 aa, Arabidopsis thaliana
  G348
MDPRKLLSCSSSYVSVRMKEEKGTIRCCSECKTTKTPMWRGGPTGPKSLCNACGIRHRKQRRSELLGIHIIRSHKSLASKKINLLSSSHGGVAVKKRRSLKEEEQAALCLLLLSCSSVLA

SEQ ID NO: 235 - DNA, 889 bp, Arabidopsis thaliana
  G351
ttttgactgatagtgacctgttcgttgcaacaaattgataagcaatgcttttttataatgccaactttgtacaaaaaagcaggctttaaaggaaccaattcagtcgacctcacgcaacttcctctcttctcaagattcttctccatacttcaccttcttctatatatctctctgctctcaaattaggttttaaattttctatagcaatggcgcttgaagctcttaattcaccaagattggtcgaggatcccttaagattcaatggcgttgagcagtggaccaaatgtaagaaacgatccaaacgttcgagatctgatcttcatcataaccaccgtctcactgaggaagagtatctagctttctgtctcatgcttcttgctcgggatggcggcgatcttgactctgtgacggttgcggagaagccgagttataagtgtggcgtttgttacaagacgttttcgtcttaccaagctctcggcggtcataaagcgagccaccggagcttatacggtggtggagagaatgataaatcgacaccatccaccgccgtgaaatctcacgtttgttcggtttgcgggaaatctttcgccaccggtcaagctctcggcggccacaagcggtgccactacgatggtggcgtttcgaactcggaaggtgtggggtctactagccacgtcagcagtagtagccaccgtggatttgaccttaatattataccggtgcagggattttcgccggacgacgaagtgatgagtccgatggcgactaagaagcctcgcctgaagtaagtctttgttgaagacctggaagtttatcaaatgtaaatatcaaatttcaatttcaaggaacagttttgttgattctattaccaatacacaatacggcggcc

SEQ ID NO: 236 - protein, 193 aa, Arabidopsis thaliana
  G351
MALEALNSPRLVEDPLRFNGVEQWTKCKKRSKRSRSDLHHNHRLTEEEYLAFCLMLLARDGGDLDSVTVAEKPSYKCGVCYKTFSSYQALGGHKASHRSLYGGGENDKSTPSTAVKSHVCSVCGKSFATGQALGGHKRCHYDGGVSNSEGVGSTSHVSSSSHRGFDLNIIPVQGFSPDDEVMSPMATKKPRLK

SEQ ID NO: 237 - DNA, 922 bp, Arabidopsis thaliana
  G361
tctgtctctctctctctctttgtaaatatacatatatagataagctcacatatatggcgactgaaacatcttctttgaagctcttcggtataaacctacttgaaacgacgtcggttcaaaaccagtcatcggaaccaagacccggatccggatcaggatccgagtcacgtaagtacgagtgtcaatactgttgtagagagtttgctaactctcaagctcttggtggtcaccaaaacgctcacaagaaagagcgtcagcttcttaaacgtgcacagatgttagctactcgtggtttgccacgtcatcataattttcaccctcataccaatccgcttctctccgccttcgcgccgctgcctcacctcctctctcagccgcatcctccgccgcatatgatgctctctccttcttcttcgagttctaagtggctttacggtgaacacatgtcgtcacaaaacgccgttgggtactttcatggtggaaggggactttacggaggtggcatggagtctatggccggagaagtaaagactcatggtggttctttgccggagatgaggaggttcgccggagatagtgatcggagtagcggaattaagttagagaatggtattgggctggacctccatttaagccttgggccatgaatgattataattttggcccagtaaagatctgtaaaatactactaggatttcatttttatagagtatgtttttttccttaatttcggttgaaattggtgaatatttttatctcttacttaccaaatctcatatttctatgtatgcgtttgctttcactttttttttttatataattcttcttgtaaaaaatgcaatgtgagttttcttccctatcattctgtcaagctttggttcaattatttagtaatcgaataatataggaatagtgttgaaag

SEQ ID NO: 238 - protein, 197 aa, Arabidopsis thaliana
  G361
MATETSSLKLFGINLLETTSVQNQSSEPRPGSGSGSESRKYECQYCCREFANSQALGGHQNAHKKERQLLKRAQMLATRGLPRHHNFHPHTNPLLSAFAPLPHLLSQPHPPPHMMLSPSSSSSKWLYGEHMSSQNAVGYFHGGRGLYGGGMESMAGEVKTHGGSLPEMRRFAGDSDRSSGIKLENGIGLDLHLSLGP

SEQ ID NO: 239 - DNA, 1805 bp, Arabidopsis thaliana
  G374
attccctctcttcgatttttaattccttgctcctctgctcgtttctctaccggcgacgtaacctctctgtctctgttctgttccttgcctgctcgaggtgtgcatcttcttggaatcagctgactttgcggtcaatcggatttcttgggattgtttggagaaactttggaggtgatggacaacaaaaatgatcaggatattgatgttagatcagtggttgaagctgtttccgccgatctttcctttggtgctcccctctatgtggttgagagcatgtgcatgcgctgccaagaaaatggaacaaccagatttctattgaccttaattcctcacttcagaaaggtcttaatatctgcatttgaatgtccgcattgcggggaaaggaataatgaagttcagttcgcaggcgagattcaaccccgtggatgctgttacaatctagaggttctagctggtgatgtgaagatatttgaccggcaagttgtgaaatctgaatcagccactattaagattcctgaactggattttgagattccaccagaggcccaacgtggaagtttgtctactgtggaagggatattagcacgggctgctgatgaactgagtgcccttcaagaagaacgcaagaaagttgatcctaaaactgctgaagcaatagaccaattcttgtccaaactgagagcttgtgctaaagcagagacatccttcaccttcattttggatgatcctgctggaaacagtttcattgagaacccacatgctccatcaccagatccctctctaaccatcaaattctatgagcgaacaccagagcaacaagcaacacttggatatgttgctaacccatctcaggctggacaatcagaaggaagccttggcgcaccttctactaaaacagcttatgtacctaatggaacaatcggagcaactgctggtcatcgcgcgattgctcagagtaatagcactgatatttccgacaacttgttcagatactctgcgcctgaagaggtgatgactttcccttcaacttgcggagcatgtacggagccgtgtgagacacggatgttcgtgactaaaatcccgtactttcaggaagttattgtcatggcatctacatgtgacagttgtggctatcgtaattctgagttgaagcctggtggtgcaattcctgaaaagggaaagaagattactctctctgtgaggaacattacagaccttagccgagatgttatcaagtcggacactgcaggagtgataatcccagaacttgatctggagctagctggtggtacacttggtggaatggtaacaacagttgaagggttggttacacagatcagagaaagcctagcgagagttcacggattcacttttggtgatagtatggaagagagtaagttgaacaaatggagagaatttggagccaggctcactaagctcctaagctttgaacagccgtggacattgattcttgatgatgaattagcaaattcctttattgcaccagtaacagatgatatcaaagatgaccatcagctcacatttgaagagtacgagaggtcatgggatcaaaacgaggagttgggtctcaacgacatagatacttcttcagctgatgctgcttatgaatccacagagacgactaaattaccttaagattagttggtcttacatgatttaattttagatggtgatgatcagactgatggatccatatgttgttgtattgtaacaattaaagaatcaaagaacaaattcctctttttaatctattaaaaaaaaaacttttgagccaaaaaaaaaac

SEQ ID NO: 240 - protein, 493 aa, Arabidopsis thaliana
  G374
MDNKNDQDIDVRSVVEAVSADLSFGAPLYVVESMCMRCQENGTTRFLLTLIPHFRKVLISAFECPHCGERNNEVQFAGEIQPRGCCYNLEVLAGDVKIFDRQVVKSESATIKIPELDFEIPPEAQRGSLSTVEGILARAADELSALQEERKKVDPKTAEAIDQFLSKLRACAKAETSFTFILDDPAGNSFIENPHAPSPDPSLTIKFYERTPEQQATLGYVANPSQAGQSEGSLGAPSTKTAYVPNGTIGATAGHRAIAQSNSTDISDNLFRYSAPEEVMTFPSTCGACTEPCETRMFVTKIPYFQEVIVMASTCDSCGYRNSELKPGGAIPEKGKKITLSVRNITDLSRDVIKSDTAGVIIPELDLELAGGTLGGMVTTVEGLVTQIRESLARVHGFTFGDSMEESKLNKWREFGARLTKLLSFEQPWTLILDDELANSFIAPVTDDIKDDHQLTFEEYERSWDQNEELGLNDIDTSSADAAYESTETTKLP

SEQ ID NO: 241 - DNA, 726 bp, Arabidopsis thaliana
  G378
atggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttgattgatgtcattgttagtcttctaagcgggagacttgtacgagagcgcattggtcctgcaatgctaagtgcagtgcaaagtcaaatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggatttccagctcggtgaaacagttagaagcttgcctcattgtcatcacatgtttcacttaccttgcatagacaattggctccttagacacggttcttgcccgatgtgtagacgtgatatttaa

SEQ ID NO: 242 - protein, 241 aa, Arabidopsis thaliana
  G378
MASSSSSSYRFQSGSYPLSSSPSLGNFVERIKDACHFLVSAVLGTIISAILTFFFALVGTLLGALTGALIGQETESGFIRGAAIGAISGAVFSIEVFESSLDLWKSDESGFGCFLYLIDVIVSLLSGRLVRERIGPAMLSAVQSQMGAVDTAFDDHTSLFDTGGSKGLTGDLVEKIPKMTITGNNNTDASENTDSCSVCLQDFQLGETVRSLPHCHHMFHLPCIDNWLLRHGSCPMCRRDI

SEQ ID NO: 243 - DNA, 2940 bp, Arabidopsis thaliana
  G384
gttttttcttctgaagagtgatatatattctacctttctctggttaaagaaactccctgaatccaccggttatgtcttgaccggctttaagcctataaactgatgccctaagacacctttttaggtttctcaataattctccgcatctatcttttcttctccacaagtaagggaaccagaaaaccagggaagaatccgagcaagctagggtttcattgtgtgcacaaaatgggatatacaggcagaagaaaatcgagataaatcaactaaatgatttggataatcatcttgaagatttgaaggatttcgagactaagtccggcgcagaagtcaccatggagaatcctttagaagaagagcttcaagatcctaatcagcgtcccaacaaaaagaagcgttaccaccgtcacacacaacgccagattcaagagctagagtcgttcttcaaggaatgtcctcatccagacgataagcaaagaaaggagctgagtcgcgagctaagcttagaacctcttcaagtcaagttctggttccaaaacaaacgcactcaaatgaaggcacaacatgagaggcacgagaaccagatactgaagtcagaaaatgacaagctccgagcagagaacaataggtacaaggatgctctaagcaacgcaacatgcccaaactgtggtggtccggcagctataggagaaatgtccttcgacgaacagcatttaaggatcgaaaatgctcgtttacgcgaagagattgacagaatctctgccatagctgctaaatacgtagggaagcctttaatggctaattcctcttctttccctcagctctcttcttcacaccacattccctcgcgctcgcttgatcttgaagttgggaactttgggaacaataacaatagccacactggtttcgttggggaaatgtttggaagcagcgacattttgaggtcggtttcgataccttctgaggctgataagcctatgattgttgagttagctgttgcagcaatggaagagcttgtgagaatggctcaaactggtgatcccttatgggtttcaagcgataattctgttgagattctcaatgaagaagagtattttaggacgtttcctagaggaattggaccgaaacctatcggtttgagatcagaagcttcaagagagtctactgttgttatcatgaatcatatcaatctcattgagattctaatggatgtgaatcaatggtctagtgtgttctgcgggattgtatcaagagcattgactctagaagttctctcaactggcgtacgagggaactacaatggggcattgcaagtgatgacagcagagttccaagtcccatcgccgcttgtccctactcgtgagaactactttgtaaggtactgtaaacagcacagtgacggtatttgggcggttgtggatgtctctttggacagcctaagaccaagtccgatcactagaagcagaagaagaccctctggttgtctgattcaagaattgcagaatggttactccaaggtgacatgggtagagcatattgaggtggatgatagatcggttcacaacatgtataaaccgttggttaataccggtttagctttcggtgcaaaacgttgggtggctacacttgaccgccaatgtgagcggctcgccagttccatggccagcaacattccggcttgtgatctttccgtgataacgagtcctgaggggagaaagagcatgctgaaactagcggagagaatggtgatgagcttctgtaccggagtcggcgcgtcaaccgccgatgcctggactacattgtcgaccacaggatccgacgacgttcgggtcatgacccgaaagagcatggatgatccgggaagacctccaggcatcgttctcagcgccgctacttctttctggatccctgtagctccaaaacgagtgttcgattttctcagagatgaaaactcaagaagcgagtgggatatactttccaatggaggcttggttcaagaaatggctcatatcgcaaatggtcgtgatcctgggaatagtgtctccttgcttcgagtcaatagtgggaactcagggcagagcaacatgttgatcttacaagaaagttgtacggacgcatcagggtcctatgtgatatacgcaccagttgatataatagctatgaacgttgtcctgagtggtggtgatccggattatgtcgctttgttaccatccggattcgctattttgccggatggctctgctagaggaggaggaggtagtgctaatgccagtgctggagccggagttgaaggaggaggagaggggaataatcttgaagtggttactactactgggagttgtggcggttcactactcacagttgcgtttcagatacttgttgactctgttcctaccgctaaactctctctcggttcagttgctacagtcaatagtctgatcaaatgcactgtcgagcggattaaagccgctctggcctgcgacggagcctaatcgatgttttcggaaggtaagagtgaaaggggaggtttagggagtttatgataatgtttgtgttcttttggtttttaaagtcttttgagattctccaaaggaagtcaagaacgctcctttttgcgtttaatctcatttccgcgtttgttagcggacgggccaaagaaagaggcttgagaaagaaaaggtaaagaggttcgggtattgacttctgctggaaccaaaaaaaaaggaatcgggtttgttgtgtttcggcggtttagcattttgcgttttctttgttattatttatcattgactagtgaacagtttagcgttctgcttttcgcgtctactgtgaaactccttgttattaagccactctagtggtactgtcattatatattatgaatctatgaaactgtgtttattagtttgtttctttaatccaaacttgagattctcttct

SEQ ID NO: 244 - protein, 718 aa, Arabidopsis thaliana
  G384
MENPLEEELQDPNQRPNKKKRYHRHTQRQIQELESFFKECPHPDDKQRKELSRELSLEPLQVKFWFQNKRTQMKAQHERHENQILKSENDKLRAENNRYKDALSNATCPNCGGPAAIGEMSFDEQHLRIENARLREEIDRISAIAAKYVGKPLMANSSSFPQLSSSHHIPSRSLDLEVGNFGNNNNSHTGFVGEMFGSSDILRSVSIPSEADKPMIVELAVAAMEELVRMAQTGDPLWVSSDNSVEILNEEEYFRTFPRGIGPKPIGLRSEASRESTVVIMNHINLIEILMDVNQWSSVFCGIVSRALTLEVLSTGVRGNYNGALQVMTAEFQVPSPLVPTRENYFVRYCKQHSDGIWAVVDVSLDSLRPSPITRSRRRPSGCLIQELQNGYSKVTWVEHIEVDDRSVHNMYKPLVNTGLAFGAKRWVATLDRQCERLASSMASNIPACDLSVITSPEGRKSMLKLAERMVMSFCTGVGASTADAWTTLSTTGSDDVRVMTRKSMDDPGRPPGIVLSAATSFWIPVAPKRVFDFLRDENSRSEWDILSNGGLVQEMAHIANGRDPGNSVSLLRVNSGNSGQSNMLILQESCTDASGSYVIYAPVDIIAMNVVLSGGDPDYVALLPSGFAILPDGSARGGGGSANASAGAGVEGGGEGNNLEVVTTTGSCGGSLLTVAFQILVDSVPTAKLSLGSVATVNSLIKCTVERIKAALACDGA

SEQ ID NO: 245 - DNA, 2217 bp, Arabidopsis thaliana
  G385
tagggtttgctttcagtttccggagtataagaaaagatgttcgagccaaatatgctgcttgcggctatgaacaacgcagacagcaataaccacaactacaaccacgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgttcttcaaagagtgtcctcacccagatgacaagcaaaggaaacagctaagccgtgaattgaatttggaacctcttcaggtcaaattctggttccaaaacaaacgtacccaaatgaagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggctttagacgaagaagaatatgcaaggacctttcctagagggatcggacctagaccggctggatatagatcagaagcttcgcgagaaagcgcggttgtgatcatgaatcatgttaacatcgttgagattctcatggatgtgaatcaatggtcgacgattttcgcggggatggtttctagagcaatgacattagcggttttatcgacaggagttgcaggaaactataatggagctcttcaagtgatgagcgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtgacttgggtggagcatgtggaagttgatgacagaggagttcataacttatacaaacacatggttagtactggtcatgccttcggtgctaaacgctgggtagccattcttgaccgccaatgcgagcggttagctagtgtcatggctacaaacatttcctctggagaagttggcgtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggtctcctggtattgttcttagtgcagccacttctttttggatccctgttcctccaaagcgagtctttgacttcctcagagacgagaattcaagaaatgagtgggatattctgtctaatggaggagttgtgcaagaaatggcacatattgctaacgggagggataccggaaactgtgtttctcttcttcgggtaaatagtgcaaactctagccagagcaatatgctgatcctacaagagagctgcattgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaataatctaatagcttgcactgttgagagaatcaaagcttcaatgtcttgtgagactgcttgaaaaccatccattagc

SEQ ID NO: 246 - protein, 721 aa, Arabidopsis thaliana
  G385
MFEPNMLLAAMNNADSNNHNYNHEDNNNEGFLRDDEFDSPNTKSGSENQEGGSGNDQDPLHPNKKKRYHRHTQLQIQEMEAFFKECPHPDDKQRKQLSRELNLEPLQVKFWFQNKRTQMKNHHERHENSHLRAENEKLRNDNLRYREALANASCPNCGGPTAIGEMSFDEHQLRLENARLREEIDRISAIAAKYVGKPVSNYPLMSPPPLPPRPLELAMGNIGGEAYGNNPNDLLKSITAPTESDKPVIIDLSVAAMEELMRMVQVDEPLWKSLALDEEEYARTFPRGIGPRPAGYRSEASRESAVVIMNHVNIVEILMDVNQWSTIFAGMVSRAMTLAVLSTGVAGNYNGALQVMSAEFQVPSPLVPTRETYFARYCKQQGDGSWAVVDISLDSLQPNPPARCRRRASGCLIQELPNGYSKVTWVEHVEVDDRGVHNLYKHMVSTGHAFGAKRWVAILDRQCERLASVMATNISSGEVGVITNQEGRRSMLKLAERMVISFCAGVSASTAHTWTTLSGTGAEDVRVMTRKSVDDPGRSPGIVLSAATSFWIPVPPKRVFDFLRDENSRNEWDILSNGGVVQEMAHIANGRDTGNCVSLLRVNSANSSQSNMLILQESCIDPTASFVIYAPVDIVAMNIVLNGGDPDYVALLPSGFAILPDGNANSGAPGGDGGSLLTVAFQILVDSVPTAKLSLGSVATVNNLIACTVERIKASMSCETA

SEQ ID NO: 247 - DNA, 1986 bp, Arabidopsis thaliana
  G389
atggaaacgaaagacaagaaagaaaaaggacatatggttttaaattccgacaacgttttcggttcggtgtcttcgtctccgacaacaacaatccaaaaccctaattactttacctccttcgagaaccctaatttcccttacatttttccgaaagaagagtatgaggtgatgagcaagatcgaaagcgggtcgggtaagtcaaccgggtcgggtcatgacccagtggagaatactgcaatcgaacaagagcctcctgcggcgaagaagaaacgttaccatagacatactgctagtcagattcaacaaatggaagcattgtttaaggaaaatgctcatccggataccaaaacaagattgagattaagtaaaaaacttggtctctcgccgatacaagtcaagttttggtttcaaaacaaacgtacccaaatcaaggcacaacaaagtagaagcgataatgcaaagctaaaagcagagaatgagactctaaagacagagagtcaaaatattcagtccaattttcaatgccttttttgctctacttgtggccacaatctccgcctcgaaaacgctcgcctccgccaagagcttgatcgtttacgcagcattgtttccatgaggaatccttctccttcacaagagattaccccggagactaataagaacaacaacgataatatgttgattgcggaagaagaaaaggcgattgatatggaacttgcagtttcttgtgctcgagaattagcaaagatgtgtgacataaatgagcccttgtggaataagaagagactagacaatgagagtgtgtgtctgaatgaggaagagtataagaagatgttcttatggcctctaatgaatgatgatgatcgttttcgcagagaagcttcaagagctaatgcagtcatcatgttgaactgcataaccctcgtcaaagcattccttgatgctgataaatggtcggaaatgttcttccccatagtctcaagcgccaaaacggctcagatcatttcttctggagcttctggaccaagtggtactcttcttctgcaaaatgctgaagaaggaaaatggatggttgtagatttcccgatcgataggatcaaaccagcatcagctactactactgatcaataccggagaaaaccttctggttgcatcattcaagcaatgcgtaacggatactctcaggtcacatgggtagagcacgtagaagtagaagagaagcacgtgcaggacgaggttgttagagagtttgtggagagcggtgtggcctttggcgctgaacggtggctatctgtgttgaagagacaatgtgaaaggatggctagtctcatggctacaaacatcactgaccttggaggtatatatataacttgtttcacaatgataccttctgtagaagcgaggaagaacttgatgaagctgtcacagagaatggtgaaaactttctgtctgaacataatcaattcacacggacaagcaccaacaaaggacacagttaaaatcgtaagcaggaaagtttgcggtggtcttgttccttgtgccgtgtcagtcacgcttctcccttattctcatcaacaagtctttgatcttctccgcgacaatcaacgtctctctcaggtggagagcaattcatcgcataatgtagagttgatgcttcaagaaacatgcaccgataactccgggagtctcctggtgtactctaccgtcgaccccgtcgctgttcagctcgccatgaacggcgaagatccttctgaaataccacttttgcccgttggattctctgttgttccagtgaatccatccgatggtgtcgagggcagttccgtcagttcgccttcgtgcttgctcactgttgcaatacaggtcttggggagcaacgtcaccaccgaaagactcgatctttccaccgtctccgtcatcaatcaccgtatttgcgccactgtcaaccgtatcacttccgcgctcgtcaacgacgtcggtaattaa

SEQ ID NO: 248 - protein, 661 aa, Arabidopsis thaliana
  G389
METKDKKEKGHMVLNSDNVFGSVSSSPTTTIQNPNYFTSFENPNFPYIFPKEEYEVMSKIESGSGKSTGSGHDPVENTAIEQEPPAAKKKRYHRHTASQIQQMEALFKENAHPDTKTRLRLSKKLGLSPIQVKFWFQNKRTQIKAQQSRSDNAKLKAENETLKTESQNIQSNFQCLFCSTCGHNLRLENARLRQELDRLRSIVSMRNPSPSQEITPETNKNNNDNMLIAEEEKAIDMELAVSCARELAKMCDINEPLWNKKRLDNESVCLNEEEYKKMFLWPLMNDDDRFRREASRANAVIMLNCITLVKAFLDADKWSEMFFPIVSSAKTAQIISSGASGPSGTLLLQNAEEGKWMVVDFPIDRIKPASATTTDQYRRKPSGCIIQAMRNGYSQVTWVEHVEVEEKHVQDEVVREFVESGVAFGAERWLSVLKRQCERMASLMATNITDLGGIYITCFTMIPSVEARKNLMKLSQRMVKTFCLNIINSHGQAPTKDTVKIVSRKVCGGLVPCAVSVTLLPYSHQQVFDLLRDNQRLSQVESNSSHNVELMLQETCTDNSGSLLVYSTVDPVAVQLAMNGEDPSEIPLLPVGFSVVPVNPSDGVEGSSVSSPSCLLTVAIQVLGSNVTTERLDLSTVSVINHRICATVNRITSALVNDVGN

SEQ ID NO: 249 - DNA, 2526 bp, Arabidopsis thaliana
  G390
atgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgcttctgggacgaccacagacaacagctgtgagtctgtggtcgtgagtggtcagcaacgtcagcagcaaaacccaacacatcagcatcctcagcgtgatgttaacaacccagctaatcttctctcgattgcggaggagaccttggcggagttcctttgcaaggctacaggaactgctgtcgactgggtccagatgattgggatgaagcctggtccggattctattggtatcgtagctgtttcacgcaactgcagtggaatagcagcacgtgcctgtggcctcgtgagtttagaacccatgaaggtcgctgaaatcctcaaagatcgtccatcttggttccgtgactgtcgatgtgtcgagactctgaatgttatacccactggaaatggtggtactatcgagcttgtcaacactcagatttatgctcctacaacattagcagcagctcgtgacttttggacgctgagatatagtacaagtctagaagatggaagctatgtggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtctcaagtgttcctgaagtcctcaggcctctttatgagtcttccaaaatccttgctcaaaaaatgactgtcgctgctctgagacatgtgcgccaaattgctcaagagactagtggagaagtccagtatagtggtggacgccagcctgcagttttaaggactttcagccagagactctgccggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagagtttctcgaagtggttagacttggaggtcatgcttactcacctgaagacatgggcttatcccgggatatgtatttactgcagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccgaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacagtattcatacaggtgcagatctgtttggagctgattctcagtcctgtggaggagacacattgcttaagcaactctgggaccatagtgatgccatattgtgctgctccctgaaaactaatgcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttga

SEQ ID NO: 250 - protein, 841 aa, Arabidopsis thaliana
  G390
MMAHHSMDDRDSPDKGFDSGKYVRYTPEQVEALERVYAECPKPSSLRRQQLIRECPILCNIEPRQIKVWFQNRRCREKQRKESARLQTVNRKLSAMNKLLMEENDRLQKQVSNLVYENGFMKHRIHTASGTTTDNSCESVVVSGQQRQQQNPTHQHPQRDVNNPANLLSIAEETLAEFLCKATGTAVDWVQMIGMKPGPDSIGIVAVSRNCSGIAARACGLVSLEPMKVAEILKDRPSWFRDCRCVETLNVIPTGNGGTIELVNTQIYAPTTLAAARDFWTLRYSTSLEDGSYVVCERSLTSATGGPNGPLSSSFVRAKMLSSGFLIRPCDGGGSIIHIVDHVDLDVSSVPEVLRPLYESSKILAQKMTVAALRHVRQIAQETSGEVQYSGGRQPAVLRTFSQRLCRGFNDAVNGFVDDGWSPMSSDGGEDITIMINSSSAKFAGSQYGSSFLPSFGSGVLCAKASMLLQNVPPLVLIRFLREHRAEWADYGVDAYSAASLRATPYAVPCVRTGGFPSNQVILPLAQTLEHEEFLEVVRLGGHAYSPEDMGLSRDMYLLQLCSGVDENVVGGCAQLVFAPIDESFADDAPLLPSGFRVIPLDQKTNPNDHQSASRTRDLASSLDGSTKTDSETNSRLVLTIAFQFTFDNHSRDNVATMARQYVRNVVGSIQRVALAITPRPGSMQLPTSPEALTLVRWITRSYSIHTGADLFGADSQSCGGDTLLKQLWDHSDAILCCSLKTNASPVFTFANQAGLDMLETTLVALQDIMLDKTLDDSGRRALCSEFAKIMQQGYANLPAGICVSSMGRPVSYEQATVWKVVDDNESNHCLAFTLVSWSFV

SEQ ID NO: 251 - DNA, 1249 bp, Arabidopsis thaliana
  G394
gaaattcttaacaaacaattttcttcataatattaattctcaagatcttaaagattatattaatacgaagagaaaattcaaatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaagggtaaagagagaaagagaaatctccggcggcgatggagaagaagaggcggaggagacgacggagagagtggtgtgttcgagagtgagtgatgatcatgacgatgaagaaggtgttagtgctcgtaaaaagcttagactcactaaacaacaatctgctcttctcgaagataacttcaaacttcatagcacccttaatcccaagcaaaaacaagctcttgcgagacagctgaatctaaggcctagacaagttgaagtgtggttccaaaacaggagagctagaacaaaactaaagcaaacagaagtggattgtgagtttttgaagaaatgttgcgagactttaacggatgagaatagaaggcttcaaaaagagcttcaagaccttaaggctttaaaattgtctcaaccgttttacatgcacatgccggcggcgactttgactatgtgcccttcttgtgagagactcggcggtggtggtgtcggaggagatacgacggcggttgatgaagaaacggcgaaaggagctttctccatcgtcacaaagcctcgtttctataaccctttcactaatccttctgcagcatgttagttacttattagttatttaattctttttgttggttttttttttgtttcttaaatcaaattaggaattagttagaagataaatcccagggaaaaaatattacgttgaaattggggggaaatggggtatagtctttatagataagactcttcaacgattccactttatttttcggtgggattgttggttgatgaagaaaaaaaaatagtttgtaattacaggtttaaatatgtagagaaaaaatgacgaatatgtattatcttgtttttttttccttcgaatatgtattacggtaatataaatttgcttgtaaaaataataaatatattatttg

SEQ ID NO: 252 - protein, 278 aa, Arabidopsis thaliana
  G394
MGLDDSCNTGLVLGLGLSPTPNNYNHAIKKSSSTVDHRFIRLDPSLTLSLSGESYKIKTGAGAGDQICRQTSSHSGISSFSSGRVKREREISGGDGEEEAEETTERVVCSRVSDDHDDEEGVSARKKLRLTKQQSALLEDNFKLHSTLNPKQKQALARQLNLRPRQVEVWFQNRRARTKLKQTEVDCEFLKKCCETLTDENRRLQKELQDLKALKLSQPFYMHMPAATLTMCPSCERLGGGGVGGDTTAVDEETAKGAFSIVTKPRFYNPFTNPSAAC

SEQ ID NO: 253 - DNA, 937 bp, Arabidopsis thaliana
  G395
gcacaatcccactatccttcgcaagacccttcctctatataaggaagttcatttcatttggagaggacacgctgacaagctgactctagcagatctggtaccgtcgacaaggaggaagaatgcccttaggagcagctacggttgtggaggaggaagaggaggaggaggaagcggtgcctagtatgtcagtatcgccgccggatagtgtaacgtcgtcgtttcaattggactttgggattaaaagttatggttatgagagaagaagcaataagagagatattgatgatgaagtggagagatcagcctcaagagccagcaacgaagacaacgatgacgagaatggatccactaggaagaaacttagactctccaaagaccaatctgcttttcttgaagacagcttcaaagaacacagtacccttaatcctaaacagaagattgcattggcgaagcagttgaatcttcgtcctcgtcaggttgaagtctggtttcaaaacagacgagccaggacaaagctgaagcaaacggaagtggactgtgaatacctaaagagatgctgtgagtcactaaccgaagaaaaccggaggcttcaaaaagaggttaaagaattgagaaccttgaagacttccacacccttttacatgcaacttccggccactactctcactatgtgcccttcttgtgaacgtgttgccacttcagcagcacagccctccacgtcagctgcccacaacctctgtttgtccacgtcatcattgattccggttaagcctcggccggccaaacaagtttcatgaaagcacctgcgaaatacagtttgagcaaacgggcggccgctctagacaggcctcgtaccggatcctctagctagagctttcgttcgtatcatcggtttcgacaacgttcgtcaagttcaatgacatcagtttgattgcgc

SEQ ID NO: 254 - protein, 225 aa, Arabidopsis thaliana
  G395
MPLGAATVVEEEEEEEEAVPSMSVSPPDSVTSSFQLDFGIKSYGYERRSNKRDIDDEVERSASRASNEDNDDENGSTRKKLRLSKDQSAFLEDSFKEHSTLNPKQKIALAKQLNLRPRQVEVWFQNRRARTKLKQTEVDCEYLKRCCESLTEENRRLQKEVKELRTLKTSTPFYMQLPATTLTMCPSCERVATSAAQPSTSAAHNLCLSTSSLIPVKPRPAKQVS

SEQ ID NO: 255 - DNA, 1201 bp, Arabidopsis thaliana
  G398
agaaggtttctcttgtcctccatacacttagcacaactgataaatcttttgaggtaaaatcagctttagatcaaggtttttctagtcatctctactcataaagatcaaagcttttgctattctcattttctaccaagagacaatatcatgatgatgggtaaagaggatttgggtttaagtcttagcttgggatttgcacaaaaccatcctctccagctaaatcttaaacccacttcttcaccaatgtccaatctccagatgtttccatggaaccaaacccttgtttcttcctcagatcaacaaaagcaacagtttcttaggaaaatcgacgtgaacagcttgccaacaacggtggatttggaagaggagacaggagtttcgtctccaaacagtacgatctcgagcacagtgagtggaaagaggaggagtactgaaagagaaggtacctccggtggtggttgcggagatgaccttgacatcactctagatagatcttcctcacgtggaacctccgatgaagaggaagattacggaggtgagacttgtaggaagaagcttagactatccaaagatcaatccgcagttctcgaagacactttcaaagagcacaatactctcaatcccaaacagaagctggctttggctaagaagctaggtttaacagcaagacaagtggaagtgtggttccaaaacagaagagcaaggacaaagttaaagcagaccgaagtggattgcgagtatttgaaaagatgtgttgagaaattaacggaagagaatcggcggctcgagaaagaggcagcggaactaagagcattaaagctttcaccgcggttgtatggtcagatgagtccaccgaccacacttttgatgtgtccatcgtgtgaacgtgtggccggaccatcctcatctaaccacaaccagcgatctgtctcattgagtccatggctccaaatggcccatgggtcaacctttgatgtgatgcgtcctaggtcttaactttaatgctgcttctatgggttgtgtgtgggtcattgtactttttagattattgactctcagctaatgtatccttaaaagcctttttctacttttaaatttactttaatctaattaaattagttgtccatgtcttcttgataacaaaaaaatttataattataaaaaaaaaaaacaggataaaaaaaaaaaaaaaaaaaaaaaa

SEQ ID NO: 256 - protein, 282 aa, Arabidopsis thaliana
  G398
MMMGKEDLGLSLSLGFAQNHPLQLNLKPTSSPMSNLQMFPWNQTLVSSSDQQKQQFLRKIDVNSLPTTVDLEEETGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 257 - DNA, 977 bp, Arabidopsis thaliana
  G399
aggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtgggtggcccatcatcatcgaaccatcaccacaatcacaggcccgtttctatcaatccgtgggttgcttgtgctggtcaggtggctcatgggctgaattttgaagccttgcgtccacgatcgtgattttttattttagtggtgggaaaagggtgttttggtatttttcgttatcgttatatagtctatctgtgtggggtcattgttattttggatgattggccttctcatgaacta

SEQ ID NO: 258 - protein, 283 aa, Arabidopsis thaliana
  G399
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVGGPSSSNHHHNHRPVSINPWVACAGQVAHGLNFEALRPRS

SEQ ID NO: 259 - DNA, 1553 bp, Arabidopsis thaliana
  G404
ccgggattccgggaaaataataatacgacttttgaaatctctcactaatatttcccaagaaaacctgatgaattaaaagttcatattttcttggtgttgattggtattagatgactatttcttagtattagtcaattctctgtttccatcttatatggatagtctagacacagagcaaagatccttctttggagaaaaagaagatgagagacgagagaggatcgtttcttcacgtattggtcgtagatagatcttaatcgataaccatctaggccttgatctaaccattcaatataaactttatttccttcttcttttcgatctcaattgttccgaccaaacaagatgaagagatcacgtggaagctccgattctttatccggtttcttaccaattcgccattctacaacagacaaacaaataagcccaagaccaacaactaccggctttctctattccggcgccggagactactcccagatgtttgacgcattagaagacgacggaagtctagaggacctcggcggcgttggacacgcgtcttctacggcggcggagaaaaaacggcggttgggtgtagagcaagtgaaagcgttagagaagaatttcgagattgataacaagttagagccagagaggaaagtgaagctggctcaagagcttgggttgcagccacgccaagtcgcgatctggtttcaaaaccgccgtgctcggtggaagacaaagcagcttgaacgtgattacggcgttcttaagtcaaactttgatgcactcaaacgcaaccgcgactcgcttcaacgcgataacgattcactccttggacagattaaagagctgaaagcaaaacttaacgtggaaggggttaaaggtatagaagagaacggcgctttaaaagcagtggaagcaaatcaatcggtgatggctaataatgaagtcttagagctaagccaccgttctccatcgccaccaccgcatattcctacggacgctccgacatcggagctcgcattcgaaatgtttagcatttttccacgcacggaaaacttcagagacgatcctgccgatagcagcgactcaagcgcggttttgaacgaagagtatagtcccaatacggttgaagcagctggcgcagtggcggccacgactgtagaaatgtcgacgatgggttgttttagccaattcgtgaaaatggaagagcatgaagatctgtttagtggagaggaagcttgcaagttgtttgcggacaatgagcaatggtattgctccgatcagtggaattcgtaaaatgtgggggcagaattaaaagcatagaaaagctgaagggggtatgtggaaatattactgaagtcatattgggtcggaaaatgcattactcaaaatattggggtttttcttgagaaaatggaatatgacgcgagagggtagtaaaaacgagcgtgtggcgttccatgcacgtgtggccgtaatcttttcaaggttgaatgagagaggacaaaaaagtctgaaatcatcgggaataaaaaaaatatgtgacgaagaaaaaaaaaaaaaaa

SEQ ID NO: 260 - protein, 312 aa, Arabidopsis thaliana
  G404
MKRSRGSSDSLSGFLPIRHSTTDKQISPRPTTTGFLYSGAGDYSQMFDALEDDGSLEDLGGVGHASSTAAEKKRRLGVEQVKALEKNFEIDNKLEPERKVKLAQELGLQPRQVAIWFQNRRARWKTKQLERDYGVLKSNFDALKRNRDSLQRDNDSLLGQIKELKAKLNVEGVKGIEENGALKAVEANQSVMANNEVLELSHRSPSPPPHIPTDAPTSELAFEMFSIFPRTENFRDDPADSSDSSAVLNEEYSPNTVEAAGAVAATTVEMSTMGCFSQFVKMEEHEDLFSGEEACKLFADNEQWYCSDQWNS

SEQ ID NO: 261 - DNA, 1302 bp, Arabidopsis thaliana
  G409
tgtctctctctctggctctctttctcttaacgtgatcataacgtgattcgaaaattggatatagataggtttcttgttggatcttgatccctctggaaaaggaggggagaatagcagttcatgatgggattttgtatctgcccgttggagtcacctgcgagattactatggagtacaagcttcttccgccataagatcatgatcttctaatccttcctacttcttcccatctttttaatcatcttctcgctatctctgcttcctctttctctctgtttcctctttctcagaactcagaagtagttgttgttttatttctgttgatcaaaaatggaatccaattcgtttttcttcgatccatctgcttcacacggcaacagcatgttcttccttgggaatctcaatcccgtcgtccaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtgcatctgctggagaaaagcttcgagacagagaacaagctagagcctgaacgcaagactcagcttgccaagaagcttggtctacagccaaggcaagtggctgtctggtttcagaatcgccgagctcgttggaaaacaaaacagcttgagagagactacgatcttctcaagtccacttacgaccaacttctttctaactacgactccatcgtcatggacaacgataagctcagatccgaggttacttccctgaccgaaaagcttcagggcaaacaagagacagctaatgaaccacctggtcaagtgcccgaaccaaaccaacttgatccggtttacattaatgcggcagcaatcaaaaccgaggaccggttaagttcagggagcgttgggagcgcggtactagacgacgacgcacctcaactactagacagctgtgactcttacttcccaagcatcgtacccatccaagacaacagcaacgccagtgatcatgacaatgaccggagctgtttcgccgacgtctttgtgcccaccacttcaccgtcgcacgatcatcacggtgaatcattggctttctggggatggccttagaaaaccactctgataataaatgtgtgtttatttaagttcaagagtcatcttcttgttgtttccatgttgacgataattgttgactcgtggaataattccgctgttcaacggtatttttatcagttgcattatatgcttttatgaaaaaaaaaa

SEQ ID NO: 262 - protein, 272 aa, Arabidopsis thaliana
  G409
MESNSFFFDPSASHGNSMFFLGNLNPVVQGGGARSMMNMEETSKRRPFFSSPEDLYDDDFYDDQLPEKKRRLTTEQVHLLEKSFETENKLEPERKTQLAKKLGLQPRQVAVWFQNRRARWKTKQLERDYDLLKSTYDQLLSNYDSIVMDNDKLRSEVTSLTEKLQGKQETANEPPGQVPEPNQLDPVYINAAAIKTEDRLSSGSVGSAVLDDDAPQLLDSCDSYFPSIVPIQDNSNASDHDNDRSCFADVFVPTTSPSHDHHGESLAFWGWP

SEQ ID NO: 263 - DNA, 1169 bp, Arabidopsis thaliana
  G413
gagaagttcatggaggttctgattccggtcgatgagatgacagaaggtggagaatattctccggcgatgatgtcagcagagccattcttgaccatgaagaagatgaagaagagcaaccacaacaagaacaatcagagaaggtttagcgacgagcagatcaagtcactggagatgatgtttgagtctgagacaaggcttgagccaaggaagaaggttcaattagctagagagctagggttgcagccgaggcaagtggctatatggtttcagaacaagagggctcgttggaaatccaagcagctcgagactgagtacaacattctcagacaaaactacgacaacttggcttctcagttcgagtccttaaagaaagaaaaacaagctttagtctctgagttgcagaggctaaaagaggcgacgcaaaagaagacacaggaggaggaaaggcagtgtagtggagatcaagcggtggttgctctaagcagcacacatcatgaatcagaaaacgaagagaaccggaggcgtaaaccggaagaggttagaccggagatggagatgaaagatgataagggtcatcatggggttatgtgtgatcatcatgattatgaagatgatgataatggttatagtaacaacatcaagagagagtattttggtgggtttgaggaagaaccagatcacttaatgaacattgttgaaccagctgatagttgtttgacatcatctgatgattggagaggtttcaaatcagatactactactctcttggaccaatccagcaacaattacccttggcgggatttttggtcatgaaaacaataaactctaaacaagaagatgaaacagattgagactaaagattggatatatacatattcaaatcgaaatttaccggtctacatcgcatgaaccgagccacggatatagagatattcggtccagcaaatgactcgtttctcagcgagaattttgcaggattttgagctgaaattgtatggttttgtctgtataaatgatgtgtttagaaagacgtatattctcagttcgtgtttgtaattctgtttttaagtagtaagtactcgtcatgctttgtagctaagtagtaagtttaagactaaatttggatgaataaaaatcaaaagcaggagaaatcataaaaaaaaaaaaaa

SEQ ID NO: 264 - protein, 267 aa, Arabidopsis thaliana
  G413
MEVLIPVDEMTEGGEYSPAMMSAEPFLTMKKMKKSNHNKNNQRRFSDEQIKSLEMMFESETRLEPRKKVQLARELGLQPRQVAIWFQNKRARWKSKQLETEYNILRQNYDNLASQFESLKKEKQALVSELQRLKEATQKKTQEEERQCSGDQAVVALSSTHHESENEENRRRKPEEVRPEMEMKDDKGHHGVMCDHHDYEDDDNGYSNNIKREYFGGFEEEPDHLMNIVEPADSCLTSSDDWRGFKSDTTTLLDQSSNNYPWRDFWS

SEQ ID NO: 265 - DNA, 1530 bp, Arabidopsis thaliana
  G414
atggaaaactcagacactgattcagaagttttcttttggtttcagaaccaaaaccaaaaccatagccataagtttccttcttcttgttttcctccgagctctcactctgctttttatggatctagctcaatgatcaacacagagactgcaactatggacgaagaagacgtatgtgagagctacatgatgcgtgagataaccaagaaacggaagctaacaccgatccaattgcgtttactagaggagagtttcgaagaagagaaaagactcgaaccagacaggaaactctggctagccgagaagctagggctgcagccaagccaagtcgctgtctggttccaaaacagaagagctagatacaagaccaaacagctcgaacacgactgtgactctcttaaagctagctatgctaagctcaagactgactgggacattctctttgtacaaaaccaaaccctcaagagcaaggtacagtttcttaatagattaacaagccactattttcaagagtctgttcaaaattttgatgacacattcaaacaggtcgatcttctcaaagagaagctgaaaatgcaagagaatcttgaaactcagtctattgagaggaaaagacttggggaagaaggtagttcggtgaaaagcgataacacgcagtacagtgaagaagaaggtttggagaatcaatacagtttcccggagcttgcagttctcggattttattatgatccaaccttaactgcttcaaatctaagacaagaacctttgaaagtcacgtgtgcggatcagatgactcagatccaaatatctgacgtcacagaacctgcgagctccgcacatgtaaactcctgccggagttcatctaacgacacgcggcaatataaaaaaattgaagtgacacagcgaagttcgagtatgagccgcaagagagataaaccctacacaaaccgtcacacaccggcgcgaatttcgaaacgccggcgaccatgggcgccttcgtcatcggagcacgatgagattatcgacaaaccgatcaccaaacctccgccgccaccggcgttggtagttatgggacttcccgccaactgttcagttctggagctaaaatctcgattcgagatctacggttcaatctcccgaatccgaatccataaagacggaattggctccgtttcgtatcgaaccgccgagtcagcagaagccgccattgctggtagtcacgagccttctttcggtatctccatcgattccaaaaagttggaggtggtttgggcgacggatccattggtgaagtggaaggaaggtgtgacggcgggagaaggaaaggagagaacgtcgtcgttttcgtcgaagcttttacgacctgtgatgcctttgagaaaacatgggagaagcagtaggttagcgtcagctattgttaatccgagaagtgataatactaaaggaattagtggagatggagggatatcatctccggcgacgacaagtgaagttaaacagagaaatatagtaacctacgacgatatcgtttaa

SEQ ID NO: 266 - protein, 509 aa, Arabidopsis thaliana
  G414
MENSDTDSEVFFWFQNQNQNHSHKFPSSCFPPSSHSAFYGSSSMINTETATMDEEDVCESYMMREITKKRKLTPIQLRLLEESFEEEKRLEPDRKLWLAEKLGLQPSQVAVWFQNRRARYKTKQLEHDCDSLKASYAKLKTDWDILFVQNQTLKSKVQFLNRLTSHYFQESVQNFDDTFKQVDLLKEKLKMQENLETQSIERKRLGEEGSSVKSDNTQYSEEEGLENQYSFPELAVLGFYYDPTLTASNLRQEPLKVTCADQMTQIQISDVTEPASSAHVNSCRSSSNDTRQYKKIEVTQRSSSMSRKRDKPYTNRHTPARISKRRRPWAPSSSEHDEIIDKPITKPPPPPALVVMGLPANCSVLELKSRFEIYGSISRIRIHKDGIGSVSYRTAESAEAAIAGSHEPSFGISIDSKKLEVVWATDPLVKWKEGVTAGEGKERTSSFSSKLLRPVMPLRKHGRSSRLASAIVNPRSDNTKGISGDGGISSPATTSEVKQRNIVTYDDIV

SEQ ID NO: 267 - DNA, 2545 bp, Arabidopsis thaliana
  G418
acatatgttttaaattctttgtctgaatcttacaggatccgagagagagagctctggaacgatattaacatatatcatgaagaaaaagattgaagtattgatatgggaataactaaaacttctcctaatactacaattctcttgaagacttttcacaataattctatgtcccaagattatcatcatcatcatcatcataatcaacaccaaggaggtatcttcaacttctctaatggattcgaccgatcagattctcccaatttaacaactcagcagaagcaagagcatcaaagggtagagatggacgaggaatcttcagtcgccggaggtaggattccggtctacgaatcagccggtatgttatccgaaatgtttaatttccccggaagcagcggtggaggaagagatctcgacctcggccaatctttccggtcaaataggcagttgcttgaggagcaacatcagaatattccggctatgaatgctacggattcagccaccgccaccgcagccgccatgcagttattcttgatgaatccaccgccaccgcaacaaccaccgtctccgtcatccacaacttccccaaggagccaccacaattcttcaactcttcacatgttacttccaagtccatccaccaacacaactcaccatcagaactacactaatcatatgtctatgcatcagcttccacatcagcatcaccaacagatatcgacgtggcagtcttctcccgatcatcatcatcatcatcacaacagccaaacggagattgggaccgtccacgtggaaaacagcggaggacacggaggacaaggcttgtccttatctctctcatcgtctttagaggctgcagcaaaagcggaagagtatagaaacatttactacggagccaattcttctaacgcatcacctcatcatcaatacaatcaattcaagactcttcttgctaattcttctcaacatcaccatcaagtattaaaccaattccgatcatctccggctgcttcttcctcttccatggcagcggtcaatatcttaagaaactcgaggtacacaacggccgcgcaagagttgttggaagagttttgtagtgttggaagaggatttttgaagaagaacaaacttgggaacagctcaaaccctaatacttgcggtggtgatggtggtggcagctctccttcgtcggccggagcaaacaaggagcatcctcctttatcggcgtctgatcggattgagcatcaaagaaggaaagtgaaactactcaccatgcttgaagaggtggaccgacggtacaaccattactgcgagcaaatgcagatggttgtgaactctttcgacatagtaatgggccacggtgcggcattaccgtacaccgcattggctcaaaaagctatgtcaagacattttagatgccttaaagatgcagttgcggctcagcttaagcagagttgcgaacttcttggggacaaagatgcagcgggaatctcttcttccgggttaacaaaaggtgaaactccgcgtttgcgtttgctagagcaaagtttgcgtcagcaacgtgcgtttcatcaaatgggtatgatggaacaagaagcttggcggccacaacgcggtttgcctgaacgctccgtcaatatacttagagcttggctcttcgaacatttccttcacccgtatccaagtgatgcagataaacacctattggctcgacagactggtttatccagaaatcaggtatcaaattggttcataaatgctagggttcgtttatggaaaccaatggtggaagaaatgtaccaacaagaatcaaaagaaagagaaagagaagaggaattagaagagaacgaagaagatcaagaaacaaaaaacagcaacgacgacaagagcacaaaatccaacaacaatgaaagcaacttcactgccgttcggaccacttcacaaactccaacgacaaccgcaccagacgcatcagacgcagacgcagcagtagcgacaggccaccgtctaagatccaacattaatgcttacgaaaacgacgcttcatcacttctactcccttcctcttattccaacgccgccgctcctgccgctgtttctgacgacttgaattctcgttacggtggctcagacgcgttttccgccgttgccacgtgtcaacaaagtgtaggtgggttcgatgatgctgacatggatggtgttaacgttataaggtttgggacaaaccctactggtgacgtgtctctcacgcttggtttacgccacgctggaaacatgcctgacaaagacgcttctttctgcgttagagagtttgggggtttttagtttgcttttgtcactccatttaattaattaattatagttttccattcttacttattttaattgaaaatctatttttgtctcttaaaagtccaaacaatacattagtctagccctcctctgcttttttttttctatctcgtgaagagaagaaaacgatacgtaaatcccttcgaaaactaatgtacgttgtacgacttattgttttcataaaaaaaaaaaaaaa

SEQ ID NO: 268 - protein, 739 aa, Arabidopsis thaliana
  G418
MGITKTSPNTTILLKTFHNNSMSQDYHHHHHHNQHQGGIFNFSNGFDRSDSPNLTTQQKQEHQRVEMDEESSVAGGRIPVYESAGMLSEMFNFPGSSGGGRDLDLGQSFRSNRQLLEEQHQNIPAMNATDSATATAAAMQLFLMNPPPPQQPPSPSSTTSPRSHHNSSTLHMLLPSPSTNTTHHQNYTNHMSMHQLPHQHHQQISTWQSSPDHHHHHHNSQTEIGTVHVENSGGHGGQGLSLSLSSSLEAAAKAEEYRNIYYGANSSNASPHHQYNQFKTLLANSSQHHHQVLNQFRSSPAASSSSMAAVNILRNSRYTTAAQELLEEFCSVGRGFLKKNKLGNSSNPNTCGGDGGGSSPSSAGANKEHPPLSASDRIEHQRRKVKLLTMLEEVDRRYNHYCEQMQMVVNSFDIVMGHGAALPYTALAQKAMSRHFRCLKDAVAAQLKQSCELLGDKDAAGISSSGLTKGETPRLRLLEQSLRQQRAFHQMGMMEQEAWRPQRGLPERSVNILRAWLFEHFLHPYPSDADKHLLARQTGLSRNQVSNWFINARVRLWKPMVEEMYQQESKEREREEELEENEEDQETKNSNDDKSTKSNNNESNFTAVRTTSQTPTTTAPDASDADAAVATGHRLRSNINAYENDASSLLLPSSYSNAAAPAAVSDDLNSRYGGSDAFSAVATCQQSVGGFDDADMDGVNVIRFGTNPTGDVSLTLGLRHAGNMPDKDASFCVREFGGF

SEQ ID NO: 269 - DNA, 2405 bp, Arabidopsis thaliana
  G419
aagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagacatggcaagagatcagttctatggtcacaataaccatcatcatcaagagcaacaacatcaaatgattaatcagatccaagggtttgatgagacaaaccaaaacccaaccgatcatcatcattacaatcatcagatctttggctcaaactccaacatgggtatgatgatagacttctctaagcaacaacagattaggatgacaagtggttcggatcatcatcatcatcatcatcagacaagtggtggtactgatcagaatcagcttctggaagattcttcatctgccatgagactatgcaatgttaataatgatttcccaagtgaagtaaatgatgagagaccaccacaaagaccaagccaaggtctttccctttctctctcctcttcaaatcctacaagcatcagtctccaatctttcgaactcagaccccaacaacaacaacaagggtattccggtaataaatcaacacaacatcagaatctccaacacacgcagatgatgatgatgatgatgaatagtcaccaccaaaacaacaacaataacaatcatcagcatcataatcatcatcagtttcagattgggagttccaagtatttgagtccagctcaagagctactgagtgagttttgcagtcttggagtaaaggaaagcgatgaagaagtgatgatgatgaagcataagaagaagcaaaagggtaaacaacaagaagagtgggacacaagtcaccacagcaacaatgatcaacatgaccaatctgcgactacttcttcaaagaaacatgttccaccacttcactctcttgagttcatggaacttcagaaaagaaaagccaagttgctctccatgctcgaagagcttaaaagaagatatggacattaccgagagcaaatgagagttgcggcggcagcctttgaagcggcggttggactaggaggggcagagatatacactgcgttagcgtcaagggcaatgtcaagacactttcggtgtttaaaagacggacttgtgggacagattcaagcaacaagtcaagctttgggagagagagaagaggataatcgtgcggtttctattgcagcacgtggagaaactccacggttgagattgctcgatcaagctttgcggcaacagaaatcgtatcgccaaatgactcttgttgacgctcatccttggcgtccacaacgcggcttgcctgaacgcgcagtcacaacgttgagagcttggctctttgaacactttcttcacccatatccgagcgatgttgataagcatatattggcccgacaaactggtttatcaagaagtcaggtatcaaattggtttattaatgcaagagttaggctatggaaaccaatgattgaagaaatgtactgtgaagaaacaagaagtgaacaaatggagattacaaacccgatgatgatcgatactaaaccggacccggaccagttgatccgtgtcgaaccggaatctttatcctcaatagtgacaaaccctacatccaaatccggtcacaactcaacccatggaacgatgtcgttagggtcaacgtttgacttttccttgtacggtaaccaagctgtgacatacgctggtgaaggagggccacgtggtgacgtttccttgacgcttgggttacaacgtaacgatggtaacggtggtgtgagtttagcgttgtctccagtgacggctcaaggtggccaacttttctacggtagagaccacattgaagaaggaccggttcaatattcagcgtcgatgttagatgatgatcaagttcagaatttgccttataggaatttgatgggagctcaattacttcatgatattgtttgagattaaaagattaggaccaaagttatcgatacatattttccaaaaccgattcggttatgtaacggtttagttagataaaaaccaaattagatatttatatataccgttgtctgattggattggaggattggtggacaaggagatattattaatgtatgagttagttggttcgtcaaaaaaaaaaaaaaaaaa

SEQ ID NO: 270 - protein, 610 aa, Arabidopsis thaliana
  G419
MARDQFYGHNNHHHQEQQHQMINQIQGFDETNQNPTDHHHYNHQIFGSNSNMGMMIDFSKQQQIRMTSGSDHHHHHHQTSGGTDQNQLLEDSSSAMRLCNVNNDFPSEVNDERPPQRPSQGLSLSLSSSNPTSISLQSFELRPQQQQQGYSGNKSTQHQNLQHTQMMMMMMNSHHQNNNNNNHQHHNHHQFQIGSSKYLSPAQELLSEFCSLGVKESDEEVMMMKHKKKQKGKQQEEWDTSHHSNNDQHDQSATTSSKKHVPPLHSLEFMELQKRKAKLLSMLEELKRRYGHYREQMRVAAAAFEAAVGLGGAEIYTALASRAMSRHFRCLKDGLVGQIQATSQALGEREEDNRAVSIAARGETPRLRLLDQALRQQKSYRQMTLVDAHPWRPQRGLPERAVTTLRAWLFEHFLHPYPSDVDKHILARQTGLSRSQVSNWFINARVRLWKPMIEEMYCEETRSEQMEITNPMMIDTKPDPDQLIRVEPESLSSIVTNPTSKSGHNSTHGTMSLGSTFDFSLYGNQAVTYAGEGGPRGDVSLTLGLQRNDGNGGVSLALSPVTAQGGQLFYGRDHIEEGPVQYSASMLDDDQVQNLPYRNLMGAQLLHDIV

SEQ ID NO: 271 - DNA, 1379 bp, Arabidopsis thaliana
  G428
ttacttttgtgtttcttcatattcttcagaagcaagcacaaggctagggatcgaagaagcggcgatcactgatcgtatctcactacgatcacattaatggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgggagcgcctatggaaatagcgtgtatattggaagagattcagcgagagaaccatgtgtacaagagagatgttgctccattatcttgctttggagctgatcctgagcttgatgaattcatggaaacctactgtgatatattggttaaatacaaaaccgatcttgcgaggccgttcgacgaggctacaactttcataaacaagattgaaatgcagcttcagaacttgtgcactggtccagcgtctgctacagctctttcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgaaggcgacaaaatagctctggctgaagaaacaggtttggatcaaaaacaaatcaacaattggtttataaaccaaaggaaacgccattggaagccttcggagaacatgccgtttgatatgatggacgattctaatgaaacattctttaccgaggaatgaaaagagagacatgggattgtgcattgtataatttttacactgttttcccaagaaaagaaaacagtaaaaagcttttggtaaatgggacatcatcgcgaatgaatggaaccagttagccaaaacggtcaagggcgtggcgtaacgagacattgtattggaaatagtggcaatattatgtcactaatcttccaatggtccaaaatgatagatttcttatttgtattgaaccttacttagatagctgatgtgtcaactaaataatttattttcatccttatactacttgtatcaatgtctctaattgatcaattgttgcttgctattcaaaaaaaaaaaaaaaaaaaaaa

SEQ ID NO: 272 - protein, 311 aa, Arabidopsis thaliana
  G428
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKIALAEETGLDQKQINNWFINQRKRHWKPSENMPFDMMDDSNETFFTEE

SEQ ID NO: 273 - DNA, 1149 bp, Arabidopsis thaliana
  G431
atggagagtggttccaacagcacttcttgtccaatggcttttgccggggataatagtgatggtccgatgtgtcctatgatgatgatgatgccgcccatcatgacatcacatcaacatcatggtcatgatcatcaacatcaacaacaagaacatgatggttatgcatatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctctttctcttcttcagcctctgtcaaggccaagatcatggctcatcctcactaccaccgcctcttggccgcttatgtcaattgtcagaaggttggagcaccaccggaggttgtggcgaggctggaggaggcatgctcgtctgccgcagccgcagccgcatctatggggccaacagggtgtcttggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttggacaatcctttcccaatggatcacatctcctccaccatgctttga

SEQ ID NO: 274 - protein, 382 aa, Arabidopsis thaliana
  G431
MESGSNSTSCPMAFAGDNSDGPMCPMMMMMPPIMTSHQHHGHDHQHQQQEHDGYAYQSHHQQSSSLFLQSLAPPQGTKNKVASSSSPSSCAPAYSLMEIHHNEIVAGGINPCSSFSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLDNPFPMDHISSTML

SEQ ID NO: 275 - DNA, 2061 bp, Arabidopsis thaliana
  G434
atgaatggacaaggtgatttggatgcggttggaaacattccaaaaccaggtgaagctgaaggcgatgagattgatatgattaatgatatgtctggtgttaatgatcaagatggtggaaggatgagaagaacccataggcgcactgcttatcaaactcaagaacttgaaaatttctacatggaaaatcctcatcccactgaagaacagaggtacgagcttggacaaaggcttaatatgggtgtcaatcaagtcaagaattggttccagaataaaagaaatctcgagaagatcaataatgaccaccttgagaatgtaactcttagagaagagcatgacagattgctagcaactcaggatcagcttagaagcgcaatgctacgtagtttatgcaacatttgtggtaaggcaactaattgtggagacactgaatatgaggtgcaaaaacttatggctgagaatgctaacttggagcgggagatagaccagttcaattccagatacctttctcatcccaaacaaaggatggtcagtacatccgaacaggcgccttcttcttcctctaatccaggaataaatgcaacaccagtacttgattttagtggtggaactaggacgtctgagaaggagacatcaatttttctgaatcttgccattacggctttgagagagttgattacattgggagaagtggactgtccattttggatgatagatccaatcgttagatccaaaggagtatcaaagatctatgagaagtatagaagttctttcaacaatgtcacaaaacctcccgggcaaattgtggaggcttcaagagctaaaggtttagttcccatgacttgcgtgactctggtcaagactcttatggacacaggcaaatgggtcaacgtgtttgcacctatagtccctgtggcatcaacccataaagtgatatctaccggttctggtggcaccaaaagtggctcactccaacagattcaagcagaatttcaagtaatttctccgctggtaccaaagagaaaagtaacgtttattagatactgcaaagagatcagacagggcttatgggtggtcgtcgacgttactcctactcaaaatccgactttgctgccctatggttgttctaagaggctaccctcaggccttatcatagacgacctgtccaatgggtactcccaggttacatggattgaacaagcggaatataatgagagtcacatccaccaactctaccagcctttgattggctatgggatcgggctaggtgcaaagagatggctcgcgacgctgcagagacactgcgaaagcctctcgaccctttcatctaccaacttgactgaaattagtccaggattgtctgcaaaaggtgcaactgaaatagtgaagctagcacagcgaatgactctcaactactacagaggtattacgagtccttcggtggacaagtggcagaaaattcaggtggagaatgtggcacaaaacatgagtttcatgatccgaaagaacgtgaatgagcctggtgagctaactgggattgtgctgagtgcatccacttctgtttggctcccagtgaaccagcatacactctttgctttcattagccacctgagtttcagacacgagtgggatatcttgaccaatgatactaccatggaagaaacaatccggattcaaaaagcaaaacgccatggaaacatcatctctcttctgaaaatcgttaataatggtatgctggttctgcaagagatttggaatgatgcatcaggtgcaatggtggtgtatgcaccagtggaaaccaattctattgagctggtcaagagaggtgaaaattcagattctgtgaagtttcttccttcgggattttcgatagtgccagatggagtaaatgggtcatatcatagaggcaatactggtggaggatgtctactgacatttggacttcagatcttggtgggcatcaatccaactgctgcactcattcaaggtactgtcaaaagtgtcgagacactcatggctcatactattgtcaagatcaaatccgcgttagatttacagacgtaa

SEQ ID NO: 276 - protein, 686 aa, Arabidopsis thaliana
  G434
MNGQGDLDAVGNIPKPGEAEGDEIDMINDMSGVNDQDGGRMRRTHRRTAYQTQELENFYMENPHPTEEQRYELGQRLNMGVNQVKNWFQNKRNLEKINNDHLENVTLREEHDRLLATQDQLRSAMLRSLCNICGKATNCGDTEYEVQKLMAENANLEREIDQFNSRYLSHPKQRMVSTSEQAPSSSSNPGINATPVLDFSGGTRTSEKETSIFLNLAITALRELITLGEVDCPFWMIDPIVRSKGVSKIYEKYRSSFNNVTKPPGQIVEASRAKGLVPMTCVTLVKTLMDTGKWVNVFAPIVPVASTHKVISTGSGGTKSGSLQQIQAEFQVISPLVPKRKVTFIRYCKEIRQGLWVVVDVTPTQNPTLLPYGCSKRLPSGLIIDDLSNGYSQVTWIEQAEYNESHIHQLYQPLIGYGIGLGAKRWLATLQRHCESLSTLSSTNLTEISPGLSAKGATEIVKLAQRMTLNYYRGITSPSVDKWQKIQVENVAQNMSFMIRKNVNEPGELTGIVLSASTSVWLPVNQHTLFAFISHLSFRHEWDILTNDTTMEETIRIQKAKRHGNIISLLKIVNNGMLVLQEIWNDASGAMVVYAPVETNSIELVKRGENSDSVKFLPSGFSIVPDGVNGSYHRGNTGGGCLLTFGLQILVGINPTAALIQGTVKSVETLMAHTIVKIKSALDLQT

SEQ ID NO: 277 - DNA, 627 bp, Arabidopsis thaliana
  G435
aacaaaagaaaaaacaaaaaagaagagaaaaatggagaattctcagagtcagggtaaaaacaagaagaagaggctaacacaagatcaagttagacaactggagaagtgcttcactatgaacaagaagcttgagccagatctgaaacttcaactgtcgaaccagcttggtctacctcaaagacaagtcgctgtctggttccaaaacaagcgagccaggttcaagactcagtctcttgaggtccaacactgcactcttcagtccaagcacgaagcagctctctccgacaaggcaaagttagagcatcaagtgcagtttctccaagatgagctgaagagagcaaggaatcagcttgctctgttcacaaatcaagattctcctgttgataattctaatcttggttcttgtgatgaagatcatgatgatcaagtggtggtattcgacgagctttacgcttgctttgttagcaatggacatggatcttcatcaacctcatgggtctgattctgtttcgacgcagacaagattccaatatatatagtcttgtctctgttttgtttcgtttgatctgtttctctttgtctgaatagatttaaaatttgtaattaaagtcattcagacattcacta

SEQ ID NO: 278 - protein, 156 aa, Arabidopsis thaliana
  G435
MENSQSQGKNKKKRLTQDQVRQLEKCFTMNKKLEPDLKLQLSNQLGLPQRQVAVWFQNKRARFKTQSLEVQHCTLQSKHEAALSDKAKLEHQVQFLQDELKRARNQLALFTNQDSPVDNSNLGSCDEDHDDQVVVFDELYACFVSNGHGSSSTSWV

SEQ ID NO: 279 - DNA, 2157 bp, Arabidopsis thaliana
  G436
atggattttactcgcgatgacaactcaagtgatgaacgggaaaatgatgtagacgccaacaccaacaaccgtcacgagaagaagggttaccatcgccacactaatgaacaaattcataggcttgaaacgtatttcaaggaatgtcctcatccagacgaatttcagcgacgtctgttgggtgaagaactgaatctgaaaccaaaacaaatcaaattttggtttcaaaacaaaagaactcaagctaagagtcacaatgaaaaagcagacaatgcagcgcttagggcagaaaatattaagattagacgtgagaacgaatcaatggaagatgcactgaataatgtggtttgccctccatgtggtggtcgtggtcctgggagagaagaccaacttcgacatctccaaaaactccgtgcacaaaacgcttatctcaaagatgagtatgaaagagtctcaaactacctaaaacagtacggaggtcactcaatgcataacgtcgaggccacaccctatctccatggtccatcaaaccatgcatcaacgtccaagaaccgtccagcattgtacggaacctcttctaaccgtctccccgagccttcaagcatatttagaggaccatacactcgtggaaacatgaacaccaccgcaccgcctcagccgcgaaagccgctggaaatgcagaatttccaaccactatctcaactggagaaaattgcaatgttggaagcagcggaaaaagcggtgtcagaggttttgagcctcattcaaatggatgatacaatgtggaaaaagtcgtctattgatgataggctcgtcattgatccagggctctatgagaaatattttactaagactaacacaaatggtcgtcctgagtcttctaaagatgtcgtggtggttcaaatggatgctggaaacttgatcgacatcttcttaactgcggagaaatgggcgaggctttttccaacaattgtgaacgaagctaaaacgattcacgtcttggattccgttgaccatcgaggaaaaactttctcaagagtgatttatgagcaactgcacatactgtcaccattggtgccaccgagggaatttatgatcctaaggacttgccaacaaattgaagacaatgtctggatgattgctgatgtgtcgtgtcatctcccaaacattgagtttgatctttcgtttcccatttgcaccaaacgtccctcaggtgtgctcattcaagccttgccccacggcttctctaaggtgacgtggatagagcatgtggtagtgaatgataatagagtgcggccacataagctttacagagacctcttatacggcggctttggctacggagctcgacgttggaccgttactcttgagaggacgtgtgagaggctgattttctccacctccgtccctgccttgcccaacaatgacaatcccggagttgtgcaaacaatacgaggcagaaatagcgtaatgcatttgggagaaagaatgttgaggaactttgcatggatgatgaaaatggttaacaaactcgacttctcgccacagtctgaaactaacaacagcggaattaggattggggtgcggataaacaatgaggcgggtcaaccgcccggtctcattgtctgtgctggttcatctttatccctccctctccctcctgtccaagtgtacgatttccttaagaatctggaggttcgtcaccagtgggacgttctgtgccatgggaatccagcgactgaggctgctcgtttcgtcaccggatcaaacccaaggaacactgtgtcttttctcgagccttcaattagggatattaatactaagctaatgatactccaagatagcttcaaagatgcattgggaggaatggtggcctacgctccaatggatctaaacaccgcctgcgctgccatttcaggcgatatcgatcctaccaccattccaatcctcccttccggttttatgatctcccgtgacggccgtccttccgagggcgaagccgagggtggcagctatacactcctcaccgtggctttccagatccttgtctccggtccgagttactctcctgataccaacctggaagtttctgccaccacagtcaataccttgattagctccaccgttcaaaggatcaaagccatgctcaagtgcgaatga

SEQ ID NO: 280 - protein, 718 aa, Arabidopsis thaliana
  G436
MDFTRDDNSSDERENDVDANTNNRHEKKGYHRHTNEQIHRLETYFKECPHPDEFQRRLLGEELNLKPKQIKFWFQNKRTQAKSHNEKADNAALRAENIKIRRENESMEDALNNVVCPPCGGRGPGREDQLRHLQKLRAQNAYLKDEYERVSNYLKQYGGHSMHNVEATPYLHGPSNHASTSKNRPALYGTSSNRLPEPSSIFRGPYTRGNMNTTAPPQPRKPLEMQNFQPLSQLEKIAMLEAAEKAVSEVLSLIQMDDTMWKKSSIDDRLVIDPGLYEKYFTKTNTNGRPESSKDVVVVQMDAGNLIDIFLTAEKWARLFPTIVNEAKTIHVLDSVDHRGKTFSRVIYEQLHILSPLVPPREFMILRTCQQIEDNVWMIADVSCHLPNIEFDLSFPICTKRPSGVLIQALPHGFSKVTWIEHVVVNDNRVRPHKLYRDLLYGGFGYGARRWTVTLERTCERLIFSTSVPALPNNDNPGVVQTIRGRNSVMHLGERMLRNFAWMMKMVNKLDFSPQSETNNSGIRIGVRINNEAGQPPGLIVCAGSSLSLPLPPVQVYDFLKNLEVRHQWDVLCHGNPATEAARFVTGSNPRNTVSFLEPSIRDINTKLMILQDSFKDALGGMVAYAPMDLNTACAAISGDIDPTTIPILPSGFMISRDGRPSEGEAEGGSYTLLTVAFQILVSGPSYSPDTNLEVSATTVNTLISSTVQRIKAMLKCE

SEQ ID NO: 281 - DNA, 534 bp, Arabidopsis thaliana
  G437
atggaaggtgggtctgaaaaaacaacacctgaaggttgtggtggtgagagtaagtctaaacggaaaatgaaaactgctgctcaacttgaagttcttgaaaacacttattcagctgagccttatccttcggaagctataagagcggatctctcagtgaaactgaatctttccgatagacagttacagatgtggttttgtcaccggcggcttaaagaacggaaatctactacgccgagcaaacgtcagcgtaaggagttagtaactccaacggctatggaatcctgggaaccacccgtcaatgccggtgatttagtggcgggaaatgagcttgattctagaagagctgctcgaggcagtggcggtagtggtgtgacggttgtgaggcggtttaatgaaccgtcttctgctgaggttagagctattggttatgttgaagctcaattgggagagcggttgagagataacggaccggttcttggaatggagtttgatcctttacctcctggtgcatttggcatgcctattggtatataa

SEQ ID NO: 282 - protein, 177 aa, Arabidopsis thaliana
  G437
MEGGSEKTTPEGCGGESKSKRKMKTAAQLEVLENTYSAEPYPSEAIRADLSVKLNLSDRQLQMWFCHRRLKERKSTTPSKRQRKELVTPTAMESWEPPVNAGDLVAGNELDSRRAARGSGGSGVTVVRRFNEPSSAEVRAIGYVEAQLGERLRDNGPVLGMEFDPLPPGAFGMPIGI

SEQ ID NO: 283 - DNA, 2821 bp, Arabidopsis thaliana
  G438
cggggtacccaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaaatggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtgattcgattgacagaaaaagactaatttaaatttacgttagagaactcaaatttttggttgttgtttaggtgtctctgttttgttttttaaaattattttgatcaaa

SEQ ID NO: 284 - protein, 842 aa, Arabidopsis thaliana
  G438
MEMAVANHRERSSDSMNRHLDSSGKYVRYTAEQVEALERVYAECPKPSSLRRQQLIRECSILANIEPKQIKVWFQNRRCRDKQRKEASRLQSVNRKLSAMNKLLMEENDRLQKQVSQLVCENGYMKQQLTTVVNDPSCESVVTTPQHSLRDANSPAGLLSIAEETLAEFLSKATGTAVDWVQMPGMKPGPDSVGIFAISQRCNGVAARACGLVSLEPMKIAEILKDRPSWFRDCRSLEVFTMFPAGNGGTIELVYMQTYAPTTLAPARDFWTLRYTTSLDNGSFVVCERSLSGSGAGPNAASASQFVRAEMLSSGYLIRPCDGGGSIIHIVDHLNLEAWSVPDVLRPLYESSKVVAQKMTISALRYIRQLAQESNGEVVYGLGRQPAVLRTFSQRLSRGFNDAVNGFGDDGWSTMHCDGAEDIIVAINSTKHLNNISNSLSFLGGVLCAKASMLLQNVPPAVLIRFLREHRSEWADFNVDAYSAATLKAGSFAYPGMRPTRFTGSQIIMPLGHTIEHEEMLEVVRLEGHSLAQEDAFMSRDVHLLQICTGIDENAVGACSELIFAPINEMFPDDAPLVPSGFRVIPVDAKTGDVQDLLTANHRTLDLTSSLEVGPSPENASGNSFSSSSSRCILTIAFQFPFENNLQENVAGMACQYVRSVISSVQRVAMAISPSGISPSLGSKLSPGSPEAVTLAQWISQSYSHHLGSELLTIDSLGSDDSVLKLLWDHQDAILCCSLKPQPVFMFANQAGLDMLETTLVALQDITLEKIFDESGRKAICSDFAKLMQQGFACLPSGICVSTMGRHVSYEQAVAWKVFAASEENNNNLHCLAFSFVNWSFV

SEQ ID NO: 285 - DNA, 3829 bp, Arabidopsis thaliana
  G447
ctttttaagagcttaaaaatttgctttgaagcttcaaatattcttatgaactaaaaagaagaaaaaagcttttgtttctttttccttagcagcagaatgatttttgtttccaaaattattactatttagtttctctcgtgctcttctcttgagcaaatacagattcgttaattttgctgaagaagaagaactctgtttcttccctgcaccaaaccaattttttcgttctttctataaaccatgaaagctccatcaaatggatttcttccaagttccaacgaaggagagaagaagccaatcaattctcaactatggcacgcttgtgcagggcctttagtttcattacctcctgtgggaagtcttgtggtttacttccctcaaggacacagcgagcaagttgcagcatcgatgcagaagcaaacagattttataccaaattacccaaatcttccttctaagctgatttgcttgcttcacagtgttacattacatgctgataccgaaacagatgaagtctatgcacaaatgactcttcaacctgtgaataagtatgatagagaagcattgctagcttctgatatgggcttgaagctaaacagacaacctactgagtttttttgcaagactcttactgcaagtgacacaagcactcatggtggattctctgtaccgcgtcgtgcagctgagaaaatattccctcctcttgatttctcgatgcaaccgcctgcgcaagagattgtagctaaagatttacatgatactacatggactttcagacatatctatcgaggccaaccaaaaagacacttgcttaccacaggttggagcgtttttgttagcacaaagagactatttgcgggtgattcagttttgtttgtaagagatgagaaatcacagctgatgttgggtataagacgtgcaaatagacaaactccgactctttcctcatcggtcatatccagcgacagtatgcacattgggatacttgcagctgcagctcatgctaatgccaatagtagcccttttaccatcttcttcaatccaagggcaagtccttcagagtttgtagttcctttagccaaatacaacaaagccttatacgctcaagtatctctaggaatgagattccggatgatgtttgagactgaggattgtggggttcgtagatatatgggtacagtcacaggtattagtgatcttgaccctgtaagatggaaaggctcacaatggcgtaatcttcaggtaggatgggatgaatcaacagctggagataggccaagccgagtatccatatgggaaatcgaacccgtcataactcctttttacatatgtcctcctccatttttcagacctaagtacccgaggcaacccgggatgccagatgatgagttagacatggaaaatgctttcaaaagagcaatgccttggatgggagaagactttgggatgaaggacgcacagagttcgatgttccctggtttaagtctagttcaatggatgagtatgcagcaaaacaatccattgtcaggttctgctactcctcagctcccgtccgcgctctcatcttttaacctaccaaacaattttgcttccaacgacccttccaagctgttgaacttccaatccccaaacctctcttccgcaaattcccaattcaacaaaccgaacacggttaaccatatcagccaacagatgcaagcacaaccagccatggtgaaatctcaacaacaacaacaacaacaacaacaacaacaccaacaccaacaacaacaactgcaacaacaacaacaactacagatgtcacagcaacaggtgcagcaacaagggatttataacaatggtacgattgctgttgctaaccaagtctcttgtcaaagtccaaaccaacctactggattctctcagtctcagcttcagcagcagtcaatgctccctactggtgctaaaatgacacaccagaacataaattctatggggaataaaggcttgtctcaaatgacatcgtttgcgcaagaaatgcagtttcagcagcaactggaaatgcataacagtagccagttattaagaaaccagcaagaacagtcctctctccattcattacaacaaaatctgtcccaaaatcctcagcaactccaaatgcaacaacaatcatcaaaaccaagtccttcacaacagcttcagttgcagctactgcagaagctacagcagcagcaacagcagcagtcgattcctccagtaagctcatccttacagccacaattatcagcgttgcagcagacacaaagccatcaattgcaacaacttctgtcgtctcaaaatcaacagcccttggcacatggtaataacagcttcccagcttcaactttcatgcagcctccacagattcaggtgagtcctcagcagcaaggacagatgagtaacaaaaatcttgtagccgctggaagatcacattctggccacacagatggagaagctccttcttgttcaacctcaccttccgccaataacacgggacatgataatgtttcaccgacaaatttcctgagcagaaatcaacagcaaggacaagctgcatctgtatctgcatctgattcagtctttgagcgcgcaagcaatccggtccaagagctttatacaaaaactgagagccggatcagtcaaggcatgatgaatatgaagagtgctggtgaacatttcagatttaaaagcgcggtaacagatcaaatcgatgtatccacagcgggaacgacgtactgtcctgatgttgttggccctgtacagcagcaacaaactttcccactaccatcatttggttttgatggagactgccaatctcatcatccaagaaacaacttagctttccctggtaatctcgaagccgtaacttctgatccactctattctcaaaaggactttcaaaacttggttcccaactatggcaacacaccaagagacattgagacggagctgtccagtgctgcaatcagttctcagtcatttggtattcccagcattccctttaagcccggatgttcaaatgaggttggcggcatcaatgattcaggaatcatgaatggtggaggactgtggcccaatcagactcaacgaatgcgaacatatacaaaggttcaaaaacgagggtcagtaggtagatcaatagatgttacccgttatagcggctatgatgaacttaggcatgacttagcgagaatgtttggcatcgaaggacagctcgaagatccgctaacctctgattggaaactcgtctacaccgatcacgaaaacgatattttactagttggtgatgatccttgggaagagtttgtgaactgcgtgcagaacataaagatactatcatcagtagaagttcagcaaatgagcttagacggagatcttgcagctatcccaaccacaaaccaagcctgcagcgaaacagacagcggaaatgcttggaaagtacactatgaagacacttctgctgcagcttctttcaacagatagaaataaaaagatgcaaatataccaagtcaacttacattatcattcgaggccatcgcaaagtacatgtttttttttgtgtgtatgtactgcaaacaacaaactgagaagaagaagatactgcacggtatataaacatttttataggacagtgatttgatttttcattctaacttgatgttgttgtactttcttgtttccatatttgtataacaagtataatgcttgacaagtctatgaggagcatatcttatacagagatactaagatgtaatgttaatgtaactaaacaattaccttcattaatcatgaatcctttggtcgtttaaaa

SEQ ID NO: 286 - protein, 1086 aa, Arabidopsis thaliana
  G447
MKAPSNGFLPSSNEGEKKPINSQLWHACAGPLVSLPPVGSLVVYFPQGHSEQVAASMQKQTDFIPNYPNLPSKLICLLHSVTLHADTETDEVYAQMTLQPVNKYDREALLASDMGLKLNRQPTEFFCKTLTASDTSTHGGFSVPRRAAEKIFPPLDFSMQPPAQEIVAKDLHDTTWTFRHIYRGQPKRHLLTTGWSVFVSTKRLFAGDSVLFVRDEKSQLMLGIRRANRQTPTLSSSVISSDSMHIGILAAAAHANANSSPFTIFFNPRASPSEFVVPLAKYNKALYAQVSLGMRFRMMFETEDCGVRRYMGTVTGISDLDPVRWKGSQWRNLQVGWDESTAGDRPSRVSIWEIEPVITPFYICPPPFFRPKYPRQPGMPDDELDMENAFKRAMPWMGEDFGMKDAQSSMFPGLSLVQWMSMQQNNPLSGSATPQLPSALSSFNLPNNFASNDPSKLLNFQSPNLSSANSQFNKPNTVNHISQQMQAQPAMVKSQQQQQQQQQQHQHQQQQLQQQQQLQMSQQQVQQQGIYNNGTIAVANQVSCQSPNQPTGFSQSQLQQQSMLPTGAKMTHQNINSMGNKGLSQMTSFAQEMQFQQQLEMHNSSQLLRNQQEQSSLHSLQQNLSQNPQQLQMQQQSSKPSPSQQLQLQLLQKLQQQQQQQSIPPVSSSLQPQLSALQQTQSHQLQQLLSSQNQQPLAHGNNSFPASTFMQPPQIQVSPQQQGQMSNKNLVAAGRSHSGHTDGEAPSCSTSPSANNTGHDNVSPTNFLSRNQQQGQAASVSASDSVFERASNPVQELYTKTESRISQGMMNMKSAGEHFRFKSAVTDQIDVSTAGTTYCPDVVGPVQQQQTFPLPSFGFDGDCQSHHPRNNLAFPGNLEAVTSDPLYSQKDFQNLVPNYGNTPRDIETELSSAAISSQSFGIPSIPFKPGCSNEVGGINDSGIMNGGGLWPNQTQRMRTYTKVQKRGSVGRSIDVTRYSGYDELRHDLARMFGIEGQLEDPLTSDWKLVYTDHENDILLVGDDPWEEFVNCVQNIKILSSVEVQQMSLDGDLAAIPTTNQACSETDSGNAWKVHYEDTSAAASFNR

SEQ ID NO: 287 - DNA, 1169 bp, Arabidopsis thaliana
  G456
cacacatctcacatccccctatctctctctctcttcaaacgttttagttccccaaaaaaatatcaaaagaactaaaagaaaaaccctagaagccgaagaatctcctactcgttgtcgatcggatcacctaactaattactcgttgataatcattatatcgagaaatatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcagaagcaatcggacttgctccaagggcattagaaaagtgcaagaacagaagttgagttctcgacgacatttcgtgttcttacctaaaaaaggaagaaagcctgtttcgatcggttggatatctcgaaccgagaaagctaaaccggctcgaaactattgttccgagcaaggagtttgcttataatattaattaataataatattaatattgtggtgtattacattttaaaaaattaaatcgtttttgttatatgtattatatacatatattaatatgtatatttaattaggttgcatctatttccgttaaaaccaacttttgtttttacgcaaaaaaaaagagttcac

SEQ ID NO: 288 - protein, 236 aa, Arabidopsis thaliana
  G456
MINFEATELRLGLPGGNHGGEMAGKNNGKRGFSETVDLKLNLSSTAMDSVSKVDLENMKEKVVKPPAKAQVVGWPPVRSFRKNVMSGQKPTTGDATEGNDKTSGSSGATSSASACATVAYVKVSMDGAPYLRKIDLKLYKTYQDLSNALSKMFSSFTIGNYGPQGMKDFMNESKLIDLLNGSDYVPTYEDKDGDWMLVGDVPWEMFVDSCKRIRIMKGSEAIGLAPRALEKCKNRS

SEQ ID NO: 289 - DNA, 779 bp, Arabidopsis thaliana
  G462
ggaaaaaaagaagttcaagaaatggagaaggaaggactcgggcttgagataacggagctgagattggggcttccggggagagatgtggcagagaagatgatgaagaagagagctttcacggagatgaatatgacgtcgtcgggtagtaatagtgatcaatgtgaaagcggcgtcgtttcatctggtggtgacgctgagaaggttaatgattcgccggcggcgaaaagccaggtggtggggtggccaccggtttgttcttaccggaagaaaaacagctgtaaggaagcttcgaccacgaaagtggggttagggtatgtgaaagtgagcatggatggtgtgccttatttgaggaagatggatcttggttcgagccaaggctatgatgatctagcctttgctcttgataagctcttcggtttccgtggcatcggtgtggccttgaaagatggtgacaactgcgaatacgttaccatatacgaagacaaagatggagactggatgctcgccggtgatgtaccttgggggatgtttctagagtcatgcaagaggttgagaataatgaaaagatcggatgctaccgggtttgggctgcagcctagaggagtagacgagtgatgatgacttgaacaagaagcaaggagctggttcattaatttaatcttaaacttgatcatcaagatcctttagaacatttttcctattcatgttatataaatatatatgttatagtatattattttgcaacaaaatttcatgttaaaaaaaaaaaaaaaaaaaaa

SEQ ID NO: 290 - protein, 197 aa, Arabidopsis thaliana
  G462
MEKEGLGLEITELRLGLPGRDVAEKMMKKRAFTEMNMTSSGSNSDQCESGVVSSGGDAEKVNDSPAAKSQVVGWPPVCSYRKKNSCKEASTTKVGLGYVKVSMDGVPYLRKMDLGSSQGYDDLAFALDKLFGFRGIGVALKDGDNCEYVTIYEDKDGDWMLAGDVPWGMFLESCKRLRIMKRSDATGFGLQPRGVDE

SEQ ID NO: 291 - DNA, 992 bp, Arabidopsis thaliana
  G464
ctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatgatgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaaaggttaaacctttaaggcttttagatggatcatcagactttgtactcacttatgaagataaggaaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctctt

SEQ ID NO: 292 - protein, 239 aa, Arabidopsis thaliana
  G464
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNDELKDVSMKVNPKVQGLGFVKVNMDGVGIGRKVDMRAHSSYENLAQTLEEMFFGMTGTTCREKVKPLRLLDGSSDFVLTYEDKEGDWMLVGDVPWRMFINSVKRLRIMGTSEASGLAPRRQEQKDRQRNNPV

SEQ ID NO: 293 - DNA, 1239 bp, Arabidopsis thaliana
  G467
ggttgcttcaagagttttggatagtgtagcagagagattttaactaatgggtttataaaattttgttcttttgcgtgaacaagttgtcaacttctagacagattttctttttgaagtgttttcttgtcgaaattcttcttcttttggtcaaagaacgcaagattcttctgtagttcctctaaaaaaaatcctaatggagggttattcaagaaacggtgaaatctctccgaagctgcttgacttgatgattccacaagagagaagaaattggtttcacgatgagaaaaactctgttttcaaaacagaggagaagaagcttgagctaaagcttggaccacctggtgaagaagatgatgatgaatcgatgataagacacatgaagaaagaaccaaaagacaaatctatcctctctctcgctggcaaatacttctctccttcttccaccaaaaccacatcccataaaagaactgctcctggtccagttgtgggatggcctccggttcgatccttcaggaagaatttagctagtggaagttcttcaaagcttggaaatgactcaaccacctccaatggtgttaccctcaagaaccaaaagtgtgatgctgctgctaagacaacagaaccaaagagacaaggaggcatgtttgtgaagatcaacatgtatggtgttcccattggtcgtaaagttgatctcagtgctcataatagctatgagcagttatctttcacagttgacaagctcttcagaggtcttcttgcagctcaaagagactttccatcatccatagaagatgaaaaaccaatcactggattattagatgggaatggagaatatactcttacatatgaagacaatgaaggagacaagatgcttgtaggagatgttccatggcaaatgtttgtgtcttcggtgaagaggctgcgtgtgattaaaacttctgagatttcttcagcattaacatatggaaatggtaagcaagagaaaatgagaagatgaagaaaaagatcttttacagcttttaaagaagtagagagatgttattaattgcattttgcctttaaactttgatgagtttttggtcttggaaaagtttctgatataagtctgatgtacattctggtttgttacatcttcttttggcttttgagatatcatagagttttgttggaactcaaagaccaaacagtgcaatgatgattttggggtcttgagtaaatttacaaacccttttaggcaaa

SEQ ID NO: 294 - protein, 267 aa, Arabidopsis thaliana
  G467
MEGYSRNGEISPKLLDLMIPQERRNWFHDEKNSVFKTEEKKLELKLGPPGEEDDDESMIRHMKKEPKDKSILSLAGKYFSPSSTKTTSHKRTAPGPVVGWPPVRSFRKNLASGSSSKLGNDSTTSNGVTLKNQKCDAAAKTTEPKRQGGMFVKINMYGVPIGRKVDLSAHNSYEQLSFTVDKLFRGLLAAQRDFPSSIEDEKPITGLLDGNGEYTLTYEDNEGDKMLVGDVPWQMFVSSVKRLRVIKTSEISSALTYGNGKQEKMRR

SEQ ID NO: 295 - DNA, 2580 bp, Arabidopsis thaliana
  G470
atggcgagttcggaggtttcaatgaaaggtaatcgtggaggagataacttctcctcctctggttttagtgaccctaaggagactagaaatgtctccgtcgccggcgaggggcaaaaaagtaattctacccgatccgctgcggctgagcgtgctttggaccctgaggctgctctttacagagagctatggcacgcttgtgctggtccgcttgtgacggttcctagacaagacgaccgagtcttctattttcctcaaggacacatcgagcaggtggaggcttcgacgaaccaggcggcagaacaacagatgcctctctatgatcttccgtcaaagcttctctgtcgagttattaatgtagatttaaaggcagaggcagatacagatgaagtttatgcgcagattactcttcttcctgaggctaatcaagacgagaatgcaattgagaaagaagcgcctcttcctccacctccgaggttccaggtgcattcgttctgcaaaaccttgactgcatccgacacaagtacacatggtggattttctgttcttaggcgacatgcggatgaatgtctcccacctctggatatgtctcgacagcctcccactcaagagttagttgcaaaggatttgcatgcaaatgagtggcgattcagacatatattccggggtcaaccacggaggcatttgctacagagtgggtggagtgtgtttgttagctccaaaaggctagttgcaggcgatgcgtttatatttctaaggggcgagaatggagaattaagagttggtgtaaggcgtgcgatgcgacaacaaggaaacgtgccgtcttctgttatatctagccatagcatgcatcttggagtactggccaccgcatggcatgccatttcaacagggactatgtttacagtctactacaaacccaggacgagcccatctgagtttattgttccgttcgatcagtatatggagtctgttaagaataactactctattggcatgagattcaaaatgagatttgaaggcgaagaggctcctgagcagaggtttactggcacaatcgttgggattgaagagtctgatcctactaggtggccaaaatcaaagtggagatccctcaaggtgagatgggatgagacttctagtattcctcgacctgatagagtatctccgtggaaagtagagccagctcttgctcctcctgctttgagtcctgttccaatgcctaggcctaagaggcccagatcaaatatagcaccttcatctcctgactcttcgatgcttaccagagaaggtacaactaaggcaaacatggaccctttaccagcaagcggactttcaagggtcttgcaaggtcaagaatactcgaccttgaggacgaaacatactgagagtgtagagtgtgatgctcctgagaattctgttgtctggcaatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctagggagcaagtaacaaaacaacccttcacgatacaagaggagacagcaaagtcaagagaagggaactgcaggctctttggcattcctctgaccaacaacatgaatgggacagactcaaccatgtctcagagaaacaacttgaatgatgctgcggggcttacacagatagcatcaccaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcaggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaa

SEQ ID NO: 296 - protein, 859 aa, Arabidopsis thaliana
  G470
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 297 - DNA, 2332 bp, Arabidopsis thaliana
  G471
gcaattcttagtttctcttctatcccctttctgggttttgtttgaaccctagctcgctttggatccagtggttttaagttaaaggtaaatttatcgaaagtaagtagattcctaatggcagcttccaatcattcatctggtaaacctggaggagttttaagtgatgctttatgtagggagctctggcatgcctgtgctggacctcttgtaaccctacctcgtgaaggggaacgagtttattatttccctgaaggccacatggagcagctcgaggcatcaatgcaccaaggtttggagcaacagatgccttccttcaacctcccatctaagatcctctgtaaagttatcaacatccagcgcagggcagagcccgagactgacgaagtatatgcgcaaataaccttattgccagaactggatcaaagcgaacccactagcccagatgcccctgttcaagaacctgaaaagtgcaccgtacattcattttgcaagacactaactgcttcagacacaagcacacatggtggcttctcggtgctacggagacatgcagatgattgtctcccacccttggatatgtcccaacaaccaccgtggcaagaattggttgcaactgatttgcacaatagtgaatggcattttaggcacattttccgaggccaaccaaggcgtcatttgctaacaactggatggagtgtttttgttagctcgaagaaactagtggctggtgatgctttcatattcttaaggggtgagaatgaagagctccgagtaggtgttaggcggcacatgagacaacagactaatatcccgtcatctgtcatttcaagtcatagcatgcatattggggtccttgcaacagcagctcatgccattacaacaggaacaatcttttctgtcttctacaagccaaggacaagtaggtcagagtttattgtgagcgtcaataggtatctcgaagctaagacccagaagctgtctgtaggcatgcgtttcaagatgagattcgagggggaagaagctcccgagaaaaggttcagtggcacaatagttggtgttcaggaaaataagtcttcggtctggcatgattctgaatggagatcgctaaaggttcaatgggacgaaccctcatctgtatttcgtcctgaaagagtttcaccttgggaacttgagcccctagttgcaaatagtactccgtcttcacaacctcagcctccgcaaaggaacaaacgaccaagacctcctggtttaccttcaccagccactggtccatctggtcctgttactccagatggtgtgtggaaatccccggcagacactccttcctcagtgccattattctctcctcctgccaaagctgctacgtttggtcatggtgggaacaaatcatttggagtatctattggatcagccttttggcccaccaatgcagatagtgcagctgaatcctttgcttcagcgtttaacaatgaatctactgaaaagaaacaaactaatggaaatgtctgtaggctttttgggtttgagctagttgaaaatgttaatgtggatgaatgtttctctgctgcctctgtgtctggtgctgtcgctgtagatcaacctgtcccatccaacgagtttgactctggccagcaatctgagccattaaacatcaaccaatctgatattccttcggggagtggtgaccctgagaaatcctctttgaggtctcctcaagaatcacaaagtagacagatacgtagctgcacaaaggtgcacatgcaaggcagtgcagtaggcagagctattgatttgacaaggtcagagtgttatgaagatctgttcaagaagctggaagagatgtttgatatcaagggtgaactcttagaatctaccaaaaaatggcaagtcgtttacaccgatgatgaagatgacatgatgatggttggtgatgatccatggaatgagttctgtggaatggtgaggaagatattcatctacacacctgaggaagtgaagaaactttcaccgaagaacaaactcgcagtcaatgcaaggatgcagctcaaagctgatgcagaggaaaatgggaatacagagggcagatcatcatctatggcgggatcaagatgagtatatcactgtgttatgttttaaatgtacttgccacgtaggaaatatgaaagcagaagcaagagatcgttagacaatatgaaagttgagatgtctgtgtatagcaatgaagttttatgtcttcaagtcttatgaattcacttagatgcaatgtgttttgaggagttgtgtagcttttgtacgggaaatatggaaattaagtttcacgtcttgttctacc

SEQ ID NO: 298 - protein, 665 aa, Arabidopsis thaliana
  G471
MAASNHSSGKPGGVLSDALCRELWHACAGPLVTLPREGERVYYFPEGHMEQLEASMHQGLEQQMPSFNLPSKILCKVINIQRRAEPETDEVYAQITLLPELDQSEPTSPDAPVQEPEKCTVHSFCKTLTASDTSTHGGFSVLRRHADDCLPPLDMSQQPPWQELVATDLHNSEWHFRHIFRGQPRRHLLTTGWSVFVSSKKLVAGDAFIFLRGENEELRVGVRRHMRQQTNIPSSVISSHSMHIGVLATAAHAITTGTIFSVFYKPRTSRSEFIVSVNRYLEAKTQKLSVGMRFKMRFEGEEAPEKRFSGTIVGVQENKSSVWHDSEWRSLKVQWDEPSSVFRPERVSPWELEPLVANSTPSSQPQPPQRNKRPRPPGLPSPATGPSGPVTPDGVWKSPADTPSSVPLFSPPAKAATFGHGGNKSFGVSIGSAFWPTNADSAAESFASAFNNESTEKKQTNGNVCRLFGFELVENVNVDECFSAASVSGAVAVDQPVPSNEFDSGQQSEPLNINQSDIPSGSGDPEKSSLRSPQESQSRQIRSCTKVHMQGSAVGRAIDLTRSECYEDLFKKLEEMFDIKGELLESTKKWQVVYTDDEDDMMMVGDDPWNEFCGMVRKIFIYTPEEVKKLSPKNKLAVNARMQLKADAEENGNTEGRSSSMAGSR

SEQ ID NO: 299 - DNA, 2292 bp, Arabidopsis thaliana
  G472
gacgatagaagctggttttacgggagagaaattagagaggttacagttacagagcaggaaggattgcgttgcgttacgattcagatctctctcgatcgttacttacatgcattagagaacaagaaaacgtggagacggaatccaagggaccttcttcttcaatttaattcctcactttattacgcacccttcttttattttcgactgtttcagcttccggttcttcatcggagagagatagagagactgtgtgttttggtgtgactgatagaagatttaatcagctgatggcaaatcgcggaggtgaatatctgtacgatgagttatggaaattatgcgcgggacctcttgttgatgttcctcaagctcaagaaagagtttattattttcctcaaggtcacatggaacaactcgaagcgtcaacgcaacaagtcgacttaaatacgatgaagcctctttttgttcttcctcctaagattctctgcaatgttatgaacgttagtcttcaggcggagaaagatacggatgaggtctatgctcagattactttgatccctgttggaactgaagttgatgaacctatgagtcctgatccctctcctcctgagttgcaaaggccgaaagttcactctttcagcaaggttttgacagcgtctgatacaagcacccatggtggcttttctgttctaaggaaacatgccacggaatgtcttcctccgctggatatgactcagcaaaccccgacccaggagttagtagccgaagatgtgcacggttatcagtggaaattcaagcatatttttagaggccaaccacggaggcatctattgacgacagggtggagcacctttgttacatcaaagagattggttgctggggacacctttgtattcctgagaggggagaacggagagttgcgagttggagtcagacgtgctaatcttcaacagagcagtatgccttcatccgttatatcaagtcatagtatgcatctgggagtgcttgctactgcacgccatgctactcaaacgaaaactatgttcattgtatactataaaccaaggacaagccaattcatcattagcttgaacaaatatctagaagccatgagcaataagttctctgtagggatgagatttaagatgcgttttgagggagaggattcccctgaaagaagatattctggcacggttattggtgtgaaagactgctcccctcactggaaagactcaaaatggcgatgcttagaagttcattgggatgagcctgcatcgatttcaagacccaataaggtttcaccatgggaaattgaaccgtttgtaaattcagaaaacgttcccaaatcagttatgctgaagaacaaaaggccccgtcaagttagtgaagtatctgcacttgatgtaggcataacagcttcaaacctttggagctctgttttgacgcaaccccatgagtttgcacaatcgtgcatcacctcacagtggagttctcctcagcaatgtcatcgtgatgcaaatgaggatgctaagaaatctgactggctaaataactcttactctgtgtcaaatgtagcaaaagactcaacactgaacgaccaaatggtttccccagtcgagcagaagaagcctgagacaaccgctaattatagattatttggaattgatctgatgagttcctccctagcggttcctgaggagaaaactgcacccatgcgaccaatcaacatatccaaaccgactatggacagccactcagacccaaaatcagagatttcaaaagtatcagaagagaaaaagcaggaacctgcggagggatcaccaaaagaggtccaaagcaagcaaagcagttctacaagaagccgtaccaaggtgcagatgcaaggcgtacctgtgggcagggctgtggatttaaatgcgctaaaggggtacaacgagctcatagatgacattgagaagctgtttgacataaaaggggaactgcggagtcgcaatcaatgggaaatagtgttcacagacgatgagggagatatgatgcttgtcggtgatgacccatggcctgagttctgcaacatggtgaagagaatattcatatggtcgaaagaggaagtgaagaaaatgacgcctgggaaccaactccggatgctgttaagggaagttgaaacaacactaacaacaacttccaaaacagataatcattccaactaatttttattctattctctatcagtcttcgtctccttcttatttgctttgtctttcggaattatcttgtttgtgtctgtgttttgttgcg

SEQ ID NO: 300 - protein, 638 aa, Arabidopsis thaliana
  G472
MANRGGEYLYDELWKLCAGPLVDVPQAQERVYYFPQGHMEQLEASTQQVDLNTMKPLFVLPPKILCNVMNVSLQAEKDTDEVYAQITLIPVGTEVDEPMSPDPSPPELQRPKVHSFSKVLTASDTSTHGGFSVLRKHATECLPPLDMTQQTPTQELVAEDVHGYQWKFKHIFRGQPRRHLLTTGWSTFVTSKRLVAGDTFVFLRGENGELRVGVRRANLQQSSMPSSVISSHSMHLGVLATARHATQTKTMFIVYYKPRTSQFIISLNKYLEAMSNKFSVGMRFKMRFEGEDSPERRYSGTVIGVKDCSPHWKDSKWRCLEVHWDEPASISRPNKVSPWEIEPFVNSENVPKSVMLKNKRPRQVSEVSALDVGITASNLWSSVLTQPHEFAQSCITSQWSSPQQCHRDANEDAKKSDWLNNSYSVSNVAKDSTLNDQMVSPVEQKKPETTANYRLFGIDLMSSSLAVPEEKTAPMRPINISKPTMDSHSDPKSEISKVSEEKKQEPAEGSPKEVQSKQSSSTRSRTKVQMQGVPVGRAVDLNALKGYNELIDDIEKLFDIKGELRSRNQWEIVFTDDEGDMMLVGDDPWPEFCNMVKRIFIWSKEEVKKMTPGNQLRMLLREVETTLTTTSKTDNHSN

SEQ ID NO: 301 - DNA, 624 bp, Arabidopsis thaliana
  G475
gagagagagagttgaattttgcagatgagtatgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatatgagcaaagccaaacagtaccacaaacgacacaaagtctgccagtttcatgccaaagctcctcatgttcggatctctggtcttcaccaacgtttctgccaacaatgcagcaggtttcacgcgctcagtgagtttgatgaagccaagcggagttgcaggagacgcttagctggacacaacgagagaaggcggaaaagcacaactgactaaagacggtgaaacgtgtgagatcccggtttgaaggttaatgaaacaggctttgcttactctcttctgtcagtctcttttagctccttgtaatcctctgtgtctctgtctgtttctccatattacctgtaatcaaagctatctgctaaacctacgacatggttaaataaatgcattgagacttagtaaaaaaaaaaaaaaaaaaaa

SEQ ID NO: 302 - protein, 131 aa, Arabidopsis thaliana
  G475
MSMRRSKAEGKRSLRELSEEEEEEEETEDEDTFEEEEALEKKQKGKATSSSGVCQVESCTADMSKAKQYHKRHKVCQFHAKAPHVRISGLHQRFCQQCSRFHALSEFDEAKRSCRRRLAGHNERRRKSTTD

SEQ ID NO: 303 - DNA, 1218 bp, Arabidopsis thaliana
  G477
atggattcttggagctacgggagaagcgttttcatgtcaaatgaaactcttttaccttgtgatacttttgctaagaatagaagatttgaacagagactctctaataatgatgatgtgttgatttctgacatggctggtaactccaatggattcagtgctgtttctattactaaagttgttcctgaagaggaagatgaggagaacatatcttcttcttcaaagttctctagtcaggaattgaataggatagatttcaaacttaggagctttttggatttaggaaatgatgatgatgatacatcctctagaggttttgctctgccatctaaaaagtctcgagcttcaaacttgtgctctcagaatcccttgtgtcaagtttatgggtgtagtaaggatctgagctcttcgaaagattaccacaaaaggcatagagtttgcgaggctcattcgaaaacttctgtggtcatagttaatggtcttgaacagaggttttgtcaacagtgcagcaggtttcatttcctctcagagtttgatgatggcaaaagaagttgcagaaggcgattagccggtcacaatgaacgaagaaggaaacctgcattctatttcctaccgggtaagcgccataagcttcttcgcacctctcaagatgtagtaggcaacaagtttctggagaattcatcattggtattgccagagtcatttcctggtagtctcttatacagagtaatagatgaagacgaccaccgtacaagtagactcgtgagtttcaaagatgaacctacttgttccatgtttcctactaatgagcaaaacagcagcagaacttatgaatctaaaccagcaatttattccacggaagtatcctccatttgggacttacatgagacggcggcatcacgctctactcgtgctctctctcttctgtcagctcagtcccaacaacacttgtctaagtttccaaacacaacgttctcaatcacccaacccaaccaaaatctcaatcactcatcatcaactgactatcatcagatggaacaaccgttgtggatcgatcctggcaagaccaattctgctggttctagttcttgtaaaggaaaaggaacatccacggttgatctactgcaactgtcatcacatcttcaaagaatcgagcaacagaggaattacactggtgatgtgaagcaggaatataatgagctttatttccctggctcctaa

SEQ ID NO: 304 - protein, 405 aa, Arabidopsis thaliana
  G477
MDSWSYGRSVFMSNETLLPCDTFAKNRRFEQRLSNNDDVLISDMAGNSNGFSAVSITKVVPEEEDEENISSSSKFSSQELNRIDFKLRSFLDLGNDDDDTSSRGFALPSKKSRASNLCSQNPLCQVYGCSKDLSSSKDYHKRHRVCEAHSKTSVVIVNGLEQRFCQQCSRFHFLSEFDDGKRSCRRRLAGHNERRRKPAFYFLPGKRHKLLRTSQDVVGNKFLENSSLVLPESFPGSLLYRVIDEDDHRTSRLVSFKDEPTCSMFPTNEQNSSRTYESKPAIYSTEVSSIWDLHETAASRSTRALSLLSAQSQQHLSKFPNTTFSITQPNQNLNHSSSTDYHQMEQPLWIDPGKTNSAGSSSCKGKGTSTVDLLQLSSHLQRIEQQRNYTGDVKQEYNELYFPGS

SEQ ID NO: 305 - DNA, 1065 bp, Arabidopsis thaliana
  G482
tcgacccacgcgtccggacacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaaaaaaaaaaaaaaaa

SEQ ID NO: 306 - protein, 190 aa, Arabidopsis thaliana
  G482
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 307 - DNA, 420 bp, Arabidopsis thaliana
  G486
atgacagacgaagatagattgttgccaatagccaatgtagggagacttatgaagcaaatcctaccatcaaatgcaaagatctcaaaagaagcaaaacaaacagttcaagaatgtgcaacagagttcataagctttgttacatgcgaagcatcagagaagtgccacagggagaatcggaagacggtgaatggagacgacatctggtgggctctcagcactctcggcctcgataactatgctgacgccgtgggtaggcatcttcacaagtaccgtgaagccgagagagaaagaactgagcacaacaaaggtagcaatgatagtgggaatgagaaagaaaccaacactagaagtgatgtacagaaccaatcgacaaaatttattagagttgttgagaagggaagcagctcctcggcccgttga

SEQ ID NO: 308 - protein, 139 aa, Arabidopsis thaliana
  G486
MTDEDRLLPIANVGRLMKQILPSNAKISKEAKQTVQECATEFISFVTCEASEKCHRENRKTVNGDDIWWALSTLGLDNYADAVGRHLHKYREAERERTEHNKGSNDSGNEKETNTRSDVQNQSTKFIRVVEKGSSSSAR

SEQ ID NO: 309 - DNA, 1008 bp, Arabidopsis thaliana
  G489
tggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgccggtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttccagcttcgcggccgctctagacaggcctcgtaccggatcctctagctagagctttcgttcgtatcatcggtttcgacaacgttcgtcaagttcaatgcatcagtttcattgcgcacacaccagaatcctactgagtttgagtattatggcattgggaaaactgtttttcttgtccatttgttgtgcttgtaatttactgtgttttttattcggttttcgctatcgaactgtgaaatggaaatggatggagaagagttaatgaatgatatggccttttgttcattctcaaattaa

SEQ ID NO: 310 - protein, 220 aa, Arabidopsis thaliana
  G489
MNYGTNPYQTNPMSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 311 - DNA, 1346 bp, Arabidopsis thaliana
  G501
cttacgggtccctatccttcgcaagacccttcctctatataaggaagttcttttcatttggagaggtcacgctgacaagctgactctagcagatctggtaccgtcgacccacgcgtccgaaaaaatccagatccagctgaaattgaattttcaaccaacgaagaagagatttttccaagagcaacagacaagaagaagagaatgaagtcggagctaaatttaccagctgggttccgattccatccaacggacgaggagcttgtgaaattctacttgtgccggaaatgtgcttccgagcagatctcggctccggttatcgccgagattgatctctacaagttcaatccttgggagcttccagagatgtctctgtacggagagaaagagtggtacttcttctcacctagagatcggaaatacccaaacggttcgcgtcctaaccgggcagcaggaaccggttattggaaagctaccggagcagataaaccgattggtaaaccgaagacgttgggtatcaagaaagcactcgtcttctacgcagggaaagctccaaaagggattaagaccaattggataatgcatgagtatcgtctcgctaatgttgatagatcagcttctgttaacaaaaagaacaacctacgacttgatgattgggttttatgtcgaatatacaacaagaaaggaaccatggagaagtatttccccgcggatgagaagccgaggaccacgacaatggctgaacagtcatcatcaccttttgatacatcagactcgacttacccgacattgcaagaggatgattccagcagctcaggtggtcacggtcacgtggtgtcaccggatgttttggaggttcagagcgagcctaaatggggagagcttgaggatgctttggaagcttttgatacttcaatgtttggtagttccatggagttgttgcagcctgacgcttttgtccctcagttcttgtatcagtctgattatttcacttccttccaggatccgcctgagcagaaaccattcttgaattggagttttgctccacaggggtaaaaacggaagagaccaaaaaaggtgtttgctagtagtactgtgatgtgccagagagaagagtctcatctcaactcatccctggctcttagtagtaaaagaagattgtagaatgttaatagcttttagcatcaatgtctcattagcaggcacattcttgttctttcatgagaagtttatatgaaaactaaaaatttatattcaaattcttcaagatgttgcacttatgtagatactgatattaaataacaacctaacctttatgagaaaaaaaaaaaaaaaaaaaaaaaaaaaaa

SEQ ID NO: 312 - protein, 283 aa, Arabidopsis thaliana
  G501
MKSELNLPAGFRFHPTDEELVKFYLCRKCASEQISAPVIAEIDLYKFNPWELPEMSLYGEKEWYFFSPRDRKYPNGSRPNRAAGTGYWKATGADKPIGKPKTLGIKKALVFYAGKAPKGIKTNWIMHEYRLANVDRSASVNKKNNLRLDDWVLCRIYNKKGTMEKYFPADEKPRTTTMAEQSSSPFDTSDSTYPTLQEDDSSSSGGHGHVVSPDVLEVQSEPKWGELEDALEAFDTSMFGSSMELLQPDAFVPQFLYQSDYFTSFQDPPEQKPFLNWSFAPQG

SEQ ID NO: 313 - DNA, 1409 bp, Arabidopsis thaliana
  G502
ttgatgccgctcaatcccactatccttcgcaaggacccttcctctatataaggaagttcatttcatttggagaggacacgctgacaagctgactctagcagatctgggaccgtcgacccacgcgtccgaattgattaggataggatcaggatcatcctcaacaacctcctcctaattcctcctccattcatagtaacaataatattaagaaagagggtaaactatgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcaggctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactagaagggaattcctttcctgccgccgaaacgcaacgcaaaacgaccctcgtttttgcgtttatggcaacacgagaccgttttatatggtcaatgagtgtgccgattcggccattagatttctgttcagtcttcgtttattctatagaccgtccgatttcagatcatccctaatcggacggtggtcgttggatgtatcagtagtgtattactgtgttaggtagaagaaaatccacttgttcttaaattggcataaaagtcagaagctaatatttatatgtgccgcaatcaatttaatattttctgtctaaaaaaaaaaa

SEQ ID NO: 314 - protein, 289 aa, Arabidopsis thaliana
  G502
MSELLQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRIYNKKGATERRGPPPPVVYGDEIMEEKPKVTEMVMPPPPQQTSEFAYFDTSDSVPKLHTTDSSCSEQVVSPEFTSEVQSEPKWKDWSAVSNDNNNTLDFGFNYIDATVDNAFGGGGSSNQMFPLQDMFMYMQKPY

SEQ ID NO: 315 - DNA, 914 bp, Arabidopsis thaliana
  G503
gaacatcaaaaactaacacacagaaagaaaaaaaacagttcctgttccattagattcttttctaaattgtctgaaaatcatggaagtaacttcccaatctaccctccctccagggttccgatttcatcctaccgacgaagaactcatcgtttactatctccgaaaccagaccatgtctaaaccatgccctgtctccatcatcccagaagttgatatctacaaattcgacccatggcaattacccgagaaaacagagtttggagaaaatgagtggtatttcttcagccctagagaaagaaaatatccaaacggagtcagaccaaaccgggcagctgtttccggttattggaaagcaaccggtacagacaaagccattcacagcggttcgagtaacgtaggtgtcaagaaagctctcgtcttctacaaaggtagacctcctaaaggaatcaaaactgactggatcatgcatgagtatcgtctccatgattcacgtaaagcatcaacgaaacgtagcggatctatgaggttagatgaatgggtactatgtaggatatacaagaagagaggagcaagtaagcttctgaatgagcaagagggtttcatggacgaagtactaatggaggatgagaccaaagttgttattaacgaagcagagagaagaaatgatgaagagataatgatgatgacgtcgatgaaacttccaaggacgtgttcgctggctcatttgttggaaatggattacatgggacccgtctctcacattgataattttagtcagttcgatcatcttcatcaacctgattcggagtctagttggttcggggatctacagtttaaccaagacgagatcttaaaccatcatcgtcaagctatgtttaagttttagtgatggggtcagtaaaaaaaaaaaaaaa

SEQ ID NO: 316 - protein, 268 aa, Arabidopsis thaliana
  G503
MEVTSQSTLPPGFRFHPTDEELIVYYLRNQTMSKPCPVSIIPEVDIYKFDPWQLPEKTEFGENEWYFFSPRERKYPNGVRPNRAAVSGYWKATGTDKAIHSGSSNVGVKKALVFYKGRPPKGIKTDWIMHEYRLHDSRKASTKRSGSMRLDEWVLCRIYKKRGASKLLNEQEGFMDEVLMEDETKVVINEAERRNDEEIMMMTSMKLPRTCSLAHLLEMDYMGPVSHIDNFSQFDHLHQPDSESSWFGDLQFNQDEILNHHRQAMFKF

SEQ ID NO: 317 - DNA, 1454 bp, Arabidopsis thaliana
  G509
cttcctcctttgctaataaacttttctttgaaccttacacgccttgttgatattactctcttaaatatatattttcgtacattaacacagacatatataaagctaaagatttcttcacgtaatgggtttgaaagatattgggtccaaattgccaccggggtttcgatttcatccaagtgatgaagagttggtttgtcattatctttgcaacaagattagggccaaatctgatcatggtgatgttgatgatgatgatgatgatgttgatgaagctttgaagggttctactgatcttgtggagattgacttgcatatctgtgagccatgggagcttcctgatgtggcaaagttaaacgcaaaggaatggtacttcttcagtttccgtgatcgaaagtatgctactggatatcgcacgaacagagcgacagtaagcggatactggaaagcaacaggaaaagatcgaacggtgatggatccacgtacaaggcaattggtagggatgagaaaaacactagtgttctacagaaacagagcaccaaatgggatcaaaactacttggatcatgcacgagttccgtcttgagtgtcctaacatcccacataaggaagactgggtcttgtgcagagtgttcaacaaaggcagagactcatcgctacaagacaataattattataacaatgataatcagacgcaaaggcttgaagttaatgacgctccggatcttaattacaacaatcagttgccacctttgctatcatcccctcctcataatcatcaacatgagaagatgaaaatccaagtttgtgatcagtgggagcagctaatgaagcagccttcaaggaccaccggccacccctatcatcaccattgtcatcatcaaaccatagcatgtggttgggagcagatgatgatcggttcgctgtcatcaccttcgagtcatggccctgatcacgagtcctttgctaaatttgctttaccgtcgacaataacaacagtgtcaacatcagtggtgatcatcatcagaattatgagaagattttgttgtcatcactagacatgacgagtttggatcacgacaagacatgtatgggatcatcatcggatggtggtatggtctctgatcttcacatggaatgtggtggattgagttttgagaccgaaaatatcctcgctttccaatgaacataattcaaggggttcgccaatttgttgattcgtgaattatacaaacattttatctatagatttatcacattatcaaacatgtaagttgtgtggcatttgggtatagggtttgtgtgattctaggtttttaggacgatgtatgttgttatatttagcgtgtttttaggatttattctcattttaaaattatatgaaaacccattactatgaatacaattagttttctttgttgtaaataatattttagattatcaaaaaaaaaaaaaaaa

SEQ ID NO: 318 - protein, 310 aa, Arabidopsis thaliana
  G509
MGLKDIGSKLPPGFRFHPSDEELVCHYLCNKIRAKSDHGDVDDDDDDVDEALKGSTDLVEIDLHICEPWELPDVAKLNAKEWYFFSFRDRKYATGYRTNRATVSGYWKATGKDRTVMDPRTRQLVGMRKTLVFYRNRAPNGIKTTWIMHEFRLECPNIPHKEDWVLCRVFNKGRDSSLQDNNYYNNDNQTQRLEVNDAPDLNYNNQLPPLLSSPPHNHQHEKMKIQVCDQWEQLMKQPSRTTGHPYHHHCHHQTIACGWEQMMIGSLSSPSSHGPDHESFAKFALPSTITTVSTSVVIIIRIMRRFCCHH

SEQ ID NO: 319 - DNA, 913 bp, Arabidopsis thaliana
  G511
gtttcttgttgttaaaaatatcgtacaaaaatggccgatgaggtcacaatcgggtttcgcttctatcccacggaagaagaactggtttcgttctacctacgaaaccagctcgaaggaaggagtgatgactcaatgcatcgtgtcattcccgtacttgacgtctttgaggtcgagcctagtcatcttccaaatgttgctggagtgagatgtcgaggagacgctgagcaatggttcttcttcgtgccacgacaagaacgcgaagcaagaggaggcagaccgagtagaactactggttcaggatactggaaagcaactggatcacctggtccagtcttttccaaagacaacaaaatgattggagcaaagaaaactatggttttctacactggaaaagcacccacaggaagaaaaactaaatggaaaatgaatgagtaccacgccgttgacgaaacagtcaacgcttccacaatccctaagctgagacgtgagttcagtttatgtcgagtctacataacaacaggaagctccagagcttttgatagacgtcctgagggagttttgcagacagagagaatgctaacaagtgatgttgcagtagctgagacatcgttccgtgtggaaagctcactggaaacttcgatttcaggaggagaacatattgatgtctctatgaacacagagtttgttgatggactatcagaaccgatgtgggactgggaacagctgacttggccttgaagctatatagattttataatcaagcaaatttaaacttgtttcaattgcttattgttagtttgaattttatgacccgaaagattctttttctttctttaccttgtaacgtgagaatttgagaaataataaatgacctagacagtgacatttgaaaaaaaaaaaaaaaaaaaaaaaa

SEQ ID NO: 320 - protein, 235 aa, Arabidopsis thaliana
  G511
MADEVTIGFRFYPTEEELVSFYLRNQLEGRSDDSMHRVIPVLDVFEVEPSHLPNVAGVRCRGDAEQWFFFVPRQEREARGGRPSRTTGSGYWKATGSPGPVFSKDNKMIGAKKTMVFYTGKAPTGRKTKWKMNEYHAVDETVNASTIPKLRREFSLCRVYITTGSSRAFDRRPEGVLQTERMLTSDVAVAETSFRVESSLETSISGGEHIDVSMNTEFVDGLSEPMWDWEQLTWP

SEQ ID NO: 321 - DNA, 1285 bp, Arabidopsis thaliana
  G512
aaagctccctgagcaagtgagaagagaccacactgagaagaaaaatccttcaggttatcgaaaattcccggattttactctttgggcggtggccgatttcttacgcgctctttttgtggcgactgttgtatacgcgcgagccttcatggacacgaaggcggttggagtttctaaggatacggcggcgtcgatggaagcgtcgacggtgtttcctgggtttaaattctcgccgacggatgtggagttgatttcgtattacctgaagcggaagatggatggcttggagaggtccgttgaggttataccggaccttgagatttacaatttcgagccttgggatttacccgataagtcgattgtgaaatctgatagcgagtggttcttcttctgtgcgcgtgggaaaaagtatccacatggttcacagaacaggagagcaacgaagatgggatactggaaagcaactgggaaagagcgtgatgtgaagtctggttctgaggtcattggaacaaagaggacgcttgttttccatattggtcgtgcaccaaaaggcgaaagaactgactggattatgcacgagtactgcgtgaaaggagtatctctggatgatgctatggttgtttgccgggttaggaggaacaaagaatacaatagtggtacaagtcagaaggcaccaaagccaaattcatcagccgagaagcatgcgaaagtccaaaatggcgctacgagttcagggagcccgtctgattgggacaacttggttgatttttacctagcaggtgaatcaggggagaaactactcgctgagatggcagagtcatcagaaaatctacaggtggataatgacgaggatttctttgcggatatcctaagagacgaaatcatcaatctcgatgaagcggtgatgacagggaacacaccaaacgaagtgccaacactagaatcagcatcaatggagataagggtacttcctttaccaaacatgatagacaaacaaatgtcatcactgttagaggaaagaccatcacagaagaagaaaggaaaagacgccacggaatcattgtcgagctgcttcgtgggtttatactcgatcaaatcagtgaacaaggcacgatgggatgttattataggtgtagtggctctgatagcaatgttgttttatctagaataagaggcttatggaagtagcgaaaaacagtgtcctagctatgtttgtatcatcttttctcggacattgacaaggattatatgatgtttttgtgtaaaaaaaaaaaaaaaaaaaaaaaaa

SEQ ID NO: 322 - protein, 340 aa, Arabidopsis thaliana
  G512
MDTKAVGVSKDTAASMEASTVFPGFKFSPTDVELISYYLKRKMDGLERSVEVIPDLEIYNFEPWDLPDKSIVKSDSEWFFFCARGKKYPHGSQNRRATKMGYWKATGKERDVKSGSEVIGTKRTLVFHIGRAPKGERTDWIMHEYCVKGVSLDDAMVVCRVRRNKEYNSGTSQKAPKPNSSAEKHAKVQNGATSSGSPSDWDNLVDFYLAGESGEKLLAEMAESSENLQVDNDEDFFADILRDEIINLDEAVMTGNTPNEVPTLESASMEIRVLPLPNMIDKQMSSLLEERPSQKKKGKDATESLSSCFVGLYSIKSVNKARWDVIIGVVALIAMLFYLE

SEQ ID NO: 323 - DNA, 1812 bp, Arabidopsis thaliana
  G513
atcgtgtcaaattttagggttttttcttttcgtacttcatcaaattctggaatctggttttttcttagttttcttctatatacctttgaatcgcatctttgatccaaattcattttagatatcaccttgaagtcgaatttgtgattttttcttttcctctcgaattctcaaagtctcacgcaactatgaaagaagacatggaagtactatcgctcgcttcactaccggttgggttcagatttagtccaacggacgaagagttagtccggtactatctccggctcaagatcaacggtcacgataacgacgttagagtaattcgtgagatcgatatctgcaaatgggagccttgggatttgcctgatttttctgtggtgaagacaacagactcagagtggctcttcttttgtcctttggaccggaaatatccgagtggaagtcgaatgaatagagctactgtggctggatactggaaggcgacgggaaaagaccgtaagatcaaatcaggaaagactaagattataggtgttaagaggactctagtgttttatacaggtcgtgctcctaaagggacacgaacttgttggattatgcatgagtatcgtgctactgagaaggatcttgatggaacaaagtctggccagaatccgtttgttgtttgtaagttgtttaagaagcaagatattgtgaacggagctgctgaaccagaagagtcaaagtcatgtgaagttgaaccagcggtatcgtctccaactgttgtggacgaggttgaaatgtctgaggtatctcctgttttccctaaaacagaagagactaatccttgtgacgtcgcagagtcttctcttgtaatccccagcgaatgtcgtagtggatactctgtccctgaggttacaaccaccgggcttgacgatatcgattggctctcgtttatggagtttgattccccgaagctgttctctccgttgcactctcaggtgcaatctgagctcggttcctctttcaatggcttacaatctgagtctagtgaattgttcaaaaaccacaatgaggattacattcagactcagtacggtacaaatgatgcggatgaatatatgtccaagttcttggattcttttcttgacattccctatgagccagaacagatcccatatgagccacagaatcttagctcatgcaacaagatcaatgatgaatctaagagaggaattaagattagagctcgacgagcacaagccccgggttgtgctgagcagtttgtaatgcagggcgatgcctcaagaaggctgcgtcttcaggttaaccttaacagccacaagtcagaaactgacagtacacaacttcaatttatcaagaaagaggttaaggacacaacaacggaaactatgacgaaaggatgtggaaatttcacaagatcaaagagcaggactagtttcatattcaagaaaattgcagccatgggatgttcatacagagggcttttcagagtcggtgtggtagcggttgtgtgtgtgatgtcggtctgcagtctagtcgcataaatccgctgaatgtgatgtttgttccgatcaattcatatagtaagaataaagaaagtggtttttacgggtggagagagcgcggatttgtgtgtataacaggggttttggcctggttctgcatctgttgttattgttgttgtttttgtcggcttaagcttaaccatggtcggtttaggagtgtagtagacttgtagttaacatgtacgacgactcataatattcagatggtaatgtttggaaatttttttattcctaaaaaaaaaaaaaaaaa

SEQ ID NO: 324 - protein, 451 aa, Arabidopsis thaliana
  G513
MKEDMEVLSLASLPVGFRFSPTDEELVRYYLRLKINGHDNDVRVIREIDICKWEPWDLPDFSVVKTTDSEWLFFCPLDRKYPSGSRMNRATVAGYWKATGKDRKIKSGKTKIIGVKRTLVFYTGRAPKGTRTCWIMHEYRATEKDLDGTKSGQNPFVVCKLFKKQDIVNGAAEPEESKSCEVEPAVSSPTVVDEVEMSEVSPVFPKTEETNPCDVAESSLVIPSECRSGYSVPEVTTTGLDDIDWLSFMEFDSPKLFSPLHSQVQSELGSSFNGLQSESSELFKNHNEDYIQTQYGTNDADEYMSKFLDSFLDIPYEPEQIPYEPQNLSSCNKINDESKRGIKIRARRAQAPGCAEQFVMQGDASRRLRLQVNLNSHKSETDSTQLQFIKKEVKDTTTETMTKGCGNFTRSKSRTSFIFKKIAAMGCSYRGLFRVGVVAVVCVMSVCSLVA

SEQ ID NO: 325 - DNA, 1217 bp, Arabidopsis thaliana
  G514
tccaagatcaaatcaagaaacccattaaaaaaaaaaatcaggttttggtttcagttttaagggtttaaggtttcttggggaagaaacgatggagactttttgtgggtttcaaaaggaggaagagcagatggatttacctcctgggttcaggtttcatccaacagatgaagaactcataactcactatctccataataaggttcttgacaccagcttctcagctaaagctatcggtgaagttgatttaaacaaatcagagccatgggagttaccatggatggcaaaaatgggtgagaaagaatggtattttttctgtgtgagagacagaaagtatcccaccggtttaagaactaaccgagcaactgaagccggttattggaaggcgaccgggaaggataaagagatataccgaggcaaatcacttgttgggatgaagaagacacttgttttctatagaggaagagctcctaaaggtcagaaaaccaactgggtgatgcatgagtacaggcttgaaggaaaattctctgcccataacttgccgaaaaccgcaaagaagtgggtatgcagggtgttccaaaagagtgctggagggaagaagatcccgatttcgagtctaatccgaatcggttcactcggaaccgactttaacccttcgcttttgccctctttaaccgattcttcgccttacaacgataaaaccaaaacagaaccggtctacgtgccctgcttctccaaccaaacggatcaaaaccaaggaaccacactcaattgcttcagcagccctgttcttaactcgatccaagccgacatttttcacaggattccactctatcaaactcagtccctccaggtttctatgaatctacagagcccggttctcacgcaagaacactcagttctacatgctatgatcgagaacaacagaagacaaagtctcaaaacgatgagtgtctcacaagaaaccggagtttcaactgacatgaacactgatatctcatcggattttgaatttggtaagagacggtttgattctcaagaagatccgtcttcctctactggaccggttgatcttgaacctttctggaattactgaagatgattcaagattctcatgtccattaatttactgtggtgtgttaaagtttgtataggctattgtcatatactctcatatcaacttccactatatattataacaaattaaagaaacttaaaaa

SEQ ID NO: 326 - protein, 334 aa, Arabidopsis thaliana
  G514
METFCGFQKEEEQMDLPPGFRFHPTDEELITHYLHNKVLDTSFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRLEGKFSAHNLPKTAKKWVCRVFQKSAGGKKIPISSLIRIGSLGTDFNPSLLPSLTDSSPYNDKTKTEPVYVPCFSNQTDQNQGTTLNCFSSPVLNSIQADIFHRIPLYQTQSLQVSMNLQSPVLTQEHSVLHAMIENNRRQSLKTMSVSQETGVSTDMNTDISSDFEFGKRRFDSQEDPSSSTGPVDLEPFWNY

SEQ ID NO: 327 - DNA, 1462 bp, Arabidopsis thaliana
  G515
caaccatggcgaaagctctccaatgcatatttttttgatcttttccttttcccttcttttttgatcgctgcagagaaatggaaactcctgtgggtttaagattctgtccgaccgacgaggagatcgtcgtcgattacctttggccgaaaaattccgatagagacacgagccatgtcgatcgattcattaacacagtccctgtctgtagactcgatccttgggagttaccttgccagtcaaggatcaaactgaaagatgtggcttggtgtttcttcagacctaaggagaacaaatatggcagaggtgatcagcagatgagaaaaacgaaatctgggttttggaagagtactggcagaccaaagcctatcatgcgtaatcgccaacagatcggtgagaaaaagattttgatgttttacacgagtaaggaatccaaatccgattgggttatacacgagtaccacggtttctctcataaccagatgatgatgacatacacactctgtaaagttatgtttaatggtggcatgagagagaagtcttcctcttctccttcttcttctggtgttagtggaattgagcagagtcgtcgtgactctttaatccctcagcttgtcaacaattctgagggatcctcacttcacagagaagatccaagtcagtttggtgatgtgctgcaagaagctccaatcgaggatgctaaactgaccgaggaattggtaaaatggctgatgaatgatgaggatgatgctcaaatcgaggatgctataccgattgaggaatgggaaacatggttgaatgatattgatgatgctaaggagaagagtatcatgtttatgcatgataatcgaagtgattacagacctccaaactcattaactggtgtcttcagtgatgatgttagcagtgatgataatgattctgatttgctaactccaaaaacaaactctattcaaacttcgagcacttgtgatagttttggtagctcaaatcatcgcatagaccagatcaaagacctgcaagaatctcctacctcaacaatcaacttagtgtcactaactcaagaggtgagccaagctctaataaccagtattgataccgccgagaagaagaagaatccttatgatgatgcacaagggactgagattggtgagcataaattgggtcaagagacgatcaagaagaaaagagctggtttctttcacaggatgatacaaaaattcgtcaagaaaattcacctatgttcttccatctcaagaacttgataacaataaaagtgatcaataacaccttttctactttccaaattatttacaacagtacaagtgtatgctatgatgtctatcttggtttgtaactttaccatactgtatgtgtgatatgtataaaactggtaaatttgtgaagacaaatttgtatccattgacataataatgtctatcttgttttgttaaaaaaaaaaaaa

SEQ ID NO: 328 - protein, 394 aa, Arabidopsis thaliana
  G515
METPVGLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGGMREKSSSSPSSSGVSGIEQSRRDSLIPQLVNNSEGSSLHREDPSQFGDVLQEAPIEDAKLTEELVKWLMNDEDDAQIEDAIPIEEWETWLNDIDDAKEKSIMFMHDNRSDYRPPNSLTGVFSDDVSSDDNDSDLLTPKTNSIQTSSTCDSFGSSNHRIDQIKDLQESPTSTINLVSLTQEVSQALITSIDTAEKKKNPYDDAQGTEIGEHKLGQETIKKKRAGFFHRMIQKFVKKIHLCSSISRT

SEQ ID NO: 329 - DNA, 1053 bp, Arabidopsis thaliana
  G516
atggcgaatccggtgggttttagattccgtccgactgacggggagatcgtcgacatttacctccgaccgaaaaatctcgaaagtaacacgagccatgtcgatgaagtcattagcacagttgatatttgtagcttcgacccttgggacttaccttcccattctaggatgaaaacaagagatcaggtttggtatttcttcggccgtaaggagaacaaatatggtaaaggtgatcgacagataagaaaaaccaagtctggtttttggaagaaaactggcgttaccatggatataatgcgcaaaacgggagatcgtgagaagatcggtgagaaaagggttttggtgtttaagaatcacggtggttccaagtccgattgggctatgcatgagtatcacgctacgttctcgtctcctaatcagggtgaaaggagagaattttcagttgctactggtagtggaattaagcatactcactctttaatccctcctaccaacaattctggagttttgagtgtagagacagagggatcgttgtttcacagccaagaatcacagaatccaagtcagttttctggctttcttgatgtggatgcactagatagggacttctgcaatattttgagtgatgatttcaaaggcttctttaatgatgacgatgagcagagtaagattgtttctatgcaagatgatcgcaacaaccacacacctcaaaagccattgaccggtgtcttcagtgatcatagcaccgatggtagtgattctgatccgatttctgcaacaactatttccattcaaactttaagcacttgtcctagttttggtagctcaaatcctctataccaaatcactgacttgcaggaatctcctaactcaatcaagttagtgtcattagctcaagaggtgagcaaaacaccgggaaccggtattgataatgatgcacaagggactgagattggtgagcataaattgggtcaagagacgatcaagaacaaaagagctggtttctttcacaggatgatacaaaaattcgtcaagaaaattcacctaagaacatga

SEQ ID NO: 330 - protein, 350 aa, Arabidopsis thaliana
  G516
MANPVGFRFRPTDGEIVDIYLRPKNLESNTSHVDEVISTVDICSFDPWDLPSHSRMKTRDQVWYFFGRKENKYGKGDRQIRKTKSGFWKKTGVTMDIMRKTGDREKIGEKRVLVFKNHGGSKSDWAMHEYHATFSSPNQGERREFSVATGSGIKHTHSLIPPTNNSGVLSVETEGSLFHSQESQNPSQFSGFLDVDALDRDFCNILSDDFKGFFNDDDEQSKIVSMQDDRNNHTPQKPLTGVFSDHSTDGSDSDPISATTISIQTLSTCPSFGSSNPLYQITDLQESPNSIKLVSLAQEVSKTPGTGIDNDAQGTEIGEHKLGQETIKNKRAGFFHRMIQKFVKKIHLRT

SEQ ID NO: 331 - DNA, 1071 bp, Arabidopsis thaliana
  G521
atggggaaaactaacttggcacctggttttcggtttcatccgactgatgttgaacttgtgagatactacttgaagaggaaagttatgggaaaaaagttccaagttgatgccattgctgaggtcgacatttacaagttcgaacctcctgatttacccgacaaatcatgtctagggactggagatcttaagtggtacttcttctgtccaagagaaaagaagtatcccaaaggcggtaaggcaaaccgctctactgaatgtggttactggaagaccacagggagagacagagatgtttcttataatgacgaagtcactgggaagataagaactctgatttatcactacgggaaaatacctcgcggtgatcggactgattgggtcatacatgaatatagacttgaagacaaagtactggctcaaaagaatgttcctcaggatacttatgtgctttgcgttctctttaagaaaaatggacttggaccaagacatggatctcaatatggtgctccatttaaggaagaggattggagtgataaggaagaagaatatactcagaatcatcttgtagctggtcctagtaaagaaaccagtctagctgctaaggcctcacactcgtacgctcctaaggatggtttgacaggagtgatctcagaatcttgcgtctctgatgtgccgccactaactgccacagtgcttccacctctaacaagtgatgttatagcttacaatcccttttcttcttcacctcttcttgaggttcctcaagtatctctcgatggtggcgagttaaattcgatgcttgatctcttttctgttgacaatgacgactgtttacttttcgacgatttcgactaccataatgaggtaagacatcctgatggttttgtaaacaaggaagctccggtgttcttaggagatggcaatttcagtggaatgtttgacctgagcaatgaccaagtcgtagagctacaggatctgatacagtcacccactcctcatcctccttctcctccagctcaagctagtattcctgatgactcaagaagcaacggtcagactaaggacgattaa

SEQ ID NO: 332 - protein, 356 aa, Arabidopsis thaliana
  G521
MGKTNLAPGFRFHPTDVELVRYYLKRKVMGKKFQVDAIAEVDIYKFEPPDLPDKSCLGTGDLKWYFFCPREKKYPKGGKANRSTECGYWKTTGRDRDVSYNDEVTGKIRTLIYHYGKIPRGDRTDWVIHEYRLEDKVLAQKNVPQDTYVLCVLFKKNGLGPRHGSQYGAPFKEEDWSDKEEEYTQNHLVAGPSKETSLAAKASHSYAPKDGLTGVISESCVSDVPPLTATVLPPLTSDVIAYNPFSSSPLLEVPQVSLDGGELNSMLDLFSVDNDDCLLFDDFDYHNEVRHPDGFVNKEAPVFLGDGNFSGMFDLSNDQVVELQDLIQSPTPHPPSPPAQASIPDDSRSNGQTKDD

SEQ ID NO: 333 - DNA, 1106 bp, Arabidopsis thaliana
  G523
cttgtaccggaatcaggtttttgcttttcttctagggtttaaggttatttaaaaacagatggaaactttcggtgtgtttcacaaggaagatgatgagcagatggatttgcctcctggttttaggtttcatccaacagacgaagaactcataacccactatctccacaagaaggttcttgaccttggtttctcggctaaagctattggtgaggttgatttgaacaaagctgagccatgggagttgccatataaagcaaaaattggtgagaaagaatggtactttttctgtgtgagggatagaaagtatccgactggtctgaggactaaccgagcaactcaagccggttattggaaggcgacagggaaggataaagagatcttccgaggcaaatcgcttgttggtatgaagaaaacacttgttttctacagaggaagagctcctaaaggccagaaaacaaattgggtgatgcatgagtataggctagatggaaaactctctgctcacaacttgcctaaaaccgctaagaatgaatgggtgatctgcagggtatttcataaaactgctggaggtaagaagatcccgatttcgacgttaatccgaatcggttcttacggaaccgggtctagtttaccacctttaactgattcttcaccatacaacgacaaaaccaagaccgaaccagtttacgtgccctgcttctccaaccaagctgaaactagaggaacaatactcaattgcttcagcaacccttcccttagctccatccaaccagattttctccagatgattccactctaccaacctcaatctctcaacatttccgagagttccaatccggttcttacgcaagaacaatcagttttacaagcgatgatggaaaacaacagaaggcagaacttcaaaacattgagcatctcgcaagaaaccggggtttcgaacaccgataactcatcggtttttgaatttgggaggaagcgatttgatcatcaagaagttccatctccctcttccggtccggttgatcttgaacctttctggaattactgaagattcagaacctggaaaggctattaatttaaggtcaccaagtaaagaaaatcttttg

SEQ ID NO: 334 - protein, 329 aa, Arabidopsis thaliana
  G523
METFGVFHKEDDEQMDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 335 - DNA, 1062 bp, Arabidopsis thaliana
  G524
ttcgtctctctttctacggttcaaacattaaaaagatagatggagaagaggagctctattaaaaacagaggagtacttagattaccaccagggttccgatttcacccgaccgatgaagagctagtggttcaatatttacgtcgaaaagtaaccggtttacccttaccagcttctgtaataccggaaaccgatgtttgtaaatccgatccatgggatttaccaggtgattgtgaatcagagatgtatttttttagcacgagggaagctaaatacccgaacggaaaccggtcgaaccggtctaccggttcgggttattggaaagcgactggtctcgataagcagatcggtaagaagaagcttgtcgtggggatgaagaaaactcttgttttctacaaaggtaaaccaccaaacggaacaagaactaactgggttcttcatgaatatcgtcttgttgattcacaacaagattcattatatggacagaacatgaattgggttttgtgtagagtgttcttgaagaagagaagcaatagtaatagtaagaggaaagaagatgagaaagaagaggtggagaatgagaaagagacagagacagagagagaacgtgaggaggagaacaagaagagtacttgtcccatattttatgactttatgagaaaagacacgaagaaaaagagaaggagaagaagatgctgtgatttgaatttgactcctgctacttgttgttgttgctcttcttcgacttcttcgtcgtctgtttgctcaagtgctttaactcacacatcttctaatgataatcgtcaagaaatcagttatcgggaaaataagttttgtttgtttctatagattaacaaacttgggaacaacttctattaactttaataaattagattatgattgtttccaaagttaattatgcaatccaggagtctttcttggttttggtaattaatagccatattttatagcttatctaattgtatcaaatattgaaaactggttgatcaaatatctaatttgttaaaaaaaaaaaaaaaaaaaaaaaaaaaaaaaaaaaaaaaa

SEQ ID NO: 336 - protein, 268 aa, Arabidopsis thaliana
  G524
MEKRSSIKNRGVLRLPPGFRFHPTDEELVVQYLRRKVTGLPLPASVIPETDVCKSDPWDLPGDCESEMYFFSTREAKYPNGNRSNRSTGSGYWKATGLDKQIGKKKLVVGMKKTLVFYKGKPPNGTRTNWVLHEYRLVDSQQDSLYGQNMNWVLCRVFLKKRSNSNSKRKEDEKEEVENEKETETEREREEENKKSTCPIFYDFMRKDTKKKRRRRRCCDLNLTPATCCCCSSSTSSSSVCSSALTHTSSNDNRQEISYRENKFCLFL

SEQ ID NO: 337 - DNA, 1179 bp, Arabidopsis thaliana
  G525
cttctctcttctcaaaaacccttccctcttcgtctccaaacaacaacaaacacaacaacaacaaaaatcttacaagaagatcatttttagaaaccctattaggataaaatggattacgaggcatcaagaatcgtcgaaatggtagaagatgaagaacatatagatctaccaccaggattcagatttcaccctactgatgaagaactcataactcactacctcaaaccaaaggttttcaacactttcttctctgctactgccattggtgaagttgatctcaacaagattgagccttgggacttaccatggaaggctaagatgggagaaaaagaatggtatttcttctgtgtgagagaccggaaatacccgaccggtttaaggacaaaccgggcgacagaagccggttattggaaagccacaggaaaagacaaagagatattcaagggaaaatcacttgtgggtatgaagaaaactttggttttctataaaggaagagctcctaaaggagttaaaaccaattgggttatgcatgaatatcgtttagaaggcaaatattgtattgaaaatcttccccaaacagctaagaacgaatgggttatatgtcgtgttttccaaaaacgtgccgatggtacaaaggttccaatgtcaatgcttgatccacacattaaccgaatggaaccagccggtttaccttcgttaatggattgttctcaacgagactccttcaccggttcgtcgtctcacgtgacctgcttctccgaccaagaaaccgaagacaaaagacttgtccacgagtccaaagacggttttggttctctgttttactcggatcctctgtttttacaagacaattattcgctaatgaagctgttgcttgacggtcaagaaactcaattctccggcaaacctttcgacggtcgtgattcgtccggtacagaagaattggattgcgtttggaatttctgagttgtataagttatgttgtagacttgtagtagtcatgtgttcgtgtgtgtgaatgaatattcttgttacatttttttgtaaaaaaggagaaaaaaatatgctagaaagtcaattgcttttgttatgtagcattagtgttttttatgtactcaatagacttcctaattaaataaaaatcttaatttatttgccaaaaaaaaaaaaaaaaaaaaa

SEQ ID NO: 338 - protein, 285 aa, Arabidopsis thaliana
  G525
MDYEASRIVEMVEDEEHIDLPPGFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYCIENLPQTAKNEWVICRVFQKRADGTKVPMSMLDPHINRMEPAGLPSLMDCSQRDSFTGSSSHVTCFSDQETEDKRLVHESKDGFGSLFYSDPLFLQDNYSLMKLLLDGQETQFSGKPFDGRDSSGTEELDCVWNF

SEQ ID NO: 339 - DNA, 1481 bp, Arabidopsis thaliana
  G526
cgacccacgcgtccgagattctctcccagctagctttctcaattcatttttctttcttcatcttcttcttgtgtgatctctctttccaaataagcttatcattcttacaaaaatatttctgggtttctgatattgttcttgttctcttgaatctttattacttgaaaaacatataaagtgatggcggttgtggttgaagaaggtgtggtgttgaatcatggaggtgaagagcttgtggatttgccacctggtttcaggtttcatccaacagacgaagagatcataacatgttaccttaaggagaaggttttaaacagccgattcacggctgtggccatgggagaagctgatctcaacaagtgtgagccttgggatttgccaaagagggcaaagatgggggagaaagagttctacttcttctgtcaaagggacaggaagtatccgactgggatgaggacgaaccgtgcgacggagtcaggatactggaaagccaccgggaaggataaggagatcttcaaaggcaaaggttgtctcgttgggatgaagaaaacacttgtgttttatagaggaagagctccaaaaggtgaaaagactaattgggtcatgcatgaatatcgtcttgaaggcaaatattcgtattacaatctcccaaaatctgcaagggacgaatgggtcgtgtgtagggtttttcacaagaacaatccttctaccacaacccaaccaatgacgagaatacccgttgaagatttcacaaggatggattctctagagaacattgatcatctcctagacttctcatctcttcctcctctcatagacccgagtttcatgagtcaaaccgaacaaccaaacttcaaacccatcaaccctccaacttacgatatctcatcaccaatccaaccccatcatttcaattcttaccaatcaatctttaaccaccaggtttttggttctgcttcgggctctacgtacaacaacaacaacgagatgatcaagatggagcaatcacttgttagtgtatctcaagaaacatgcctaagctcagatgtgaacgcgaacatgactacaaccacggaggtatcttcgggtcctgtaatgaaacaagaaatggggatgatgggaatggtgaatggtagcaagtcgtatgaagatctatgtgacttgaggggggacttgtgggacttctaattaatcatttgactgtggtgaaagagtatatttgttgggatttaaatcatgttagttaatacatatacatataggatttactagaggcttaatcctagttaactattttcacttcattgatattatttaattagttgattgtttaattagtttatactttatagtgtggttaaaaaagaaaagaaaggattgtgataatttgggattttagtgcataagttatatctcaatgtaaactgtatttgtatccaaaaaaaaaaaaaaaaaaaaaaaaaaaaaaaaaaaaaaaaaaa

SEQ ID NO: 340 - protein, 335 aa, Arabidopsis thaliana
  G526
MAVVVEEGVVLNHGGEELVDLPPGFRFHPTDEEIITCYLKEKVLNSRFTAVAMGEADLNKCEPWDLPKRAKMGEKEFYFFCQRDRKYPTGMRTNRATESGYWKATGKDKEIFKGKGCLVGMKKTLVFYRGRAPKGEKTNWVMHEYRLEGKYSYYNLPKSARDEWVVCRVFHKNNPSTTTQPMTRIPVEDFTRMDSLENIDHLLDFSSLPPLIDPSFMSQTEQPNFKPINPPTYDISSPIQPHHFNSYQSIFNHQVFGSASGSTYNNNNEMIKMEQSLVSVSQETCLSSDVNANMTTTTEVSSGPVMKQEMGMMGMVNGSKSYEDLCDLRGDLWDF

SEQ ID NO: 341 - DNA, 1040 bp, Arabidopsis thaliana
  G528
ccacgcgtccgccattaaacaaaaaaaaatcaaatctctctctttctctctctaatggcggcgacattaggcagagaccagtatgtgtacatggcgaagctcgccgagcaggcggagcgttacgaagagatggttcaattcatggaacagctcgttacaggcgctactccagcggaagagctcaccgttgaagagaggaatctcctctctgttgcttacaaaaacgtgatcggatctctacgcgccgcctggaggatcgtgtcttcgattgagcagaaggaagagagtaggaagaacgacgagcacgtgtcgcttgtcaaggattacagatctaaagttgagtctgagctttcttctgtttgctctggaatccttaagctccttgactcgcatctgatcccatctgctggagcgagtgagtctaaggtcttttacttgaagatgaaaggtgattatcatcggtacatggctgagtttaagtctggtgatgagaggaaaactgctgctgaagataccatgctcgcttacaaagcagctcaggatatcgcagctgcggatatggcacctactcatccgataaggcttggtctggccctgaatttctcagtgttctactatgagattctcaattcttcagacaaagcttgtaacatggccaaacaggcttttgaggaggccatagctgagcttgacactctgggagaggaatcctacaaagacagcactctcataatgcagttgctgagggacaatttaaccctttggacctccgatatgcaggagcagatggacgaggcctgaggatctagatgaagggggggagggttgttacgcgatgtttctgccaccaaatcgatctcaaaatccccataacctttgctcaaaaactgtgaaaaaagattgaagtgtttatgatgattatgattgtgcacagcttgatgatttatctactctactaaacctctgtgctcttaatatttattgtctcgactctgctcaagccttaaaaacatctttctccttaaaaaaaaaaaaaaaaa

SEQ ID NO: 342 - protein, 248 aa, Arabidopsis thaliana
  G528
MAATLGRDQYVYMAKLAEQAERYEEMVQFMEQLVTGATPAEELTVEERNLLSVAYKNVIGSLRAAWRIVSSIEQKEESRKNDEHVSLVKDYRSKVESELSSVCSGILKLLDSHLIPSAGASESKVFYLKMKGDYHRYMAEFKSGDERKTAAEDTMLAYKAAQDIAAADMAPTHPIRLGLALNFSVFYYEILNSSDKACNMAKQAFEEAIAELDTLGEESYKDSTLIMQLLRDNLTLWTSDMQEQMDEA

SEQ ID NO: 343 - DNA, 768 bp, Arabidopsis thaliana
  G536
atgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggagagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgcagcctcgcaaagcaggcgtttgatgatgcaatcgctgagttagatacattgggtgaggaatcatacaaggacagtacactgattatgcagcttcttagagacaatctcactctctggacttcagatatgactgacgaagcaggagatgagattaaggaggcatcaaagcccgatggtgccgagtaa

SEQ ID NO: 344 - protein, 255 aa, Arabidopsis thaliana
  G536
MSTREENVYMAKLAEQAERYEEMVEFMEKVAKTVDVEELSVEERNLLSVAYKNVIGARRASWRIISSIEQKEESKGNEDHVAIIKDYRGEIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 345 - DNA, 890 bp, Arabidopsis thaliana
  G545
gcaaccttcaaactaaaactcgagagacaagaaatcctcagaatctttaacttaatggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaaggaaatttacttagacgataagatttcgtttgtatactgttgagagttgtgtaggaatttgttgactgtacataccaaattggactttgactgattccaattcttcttgttctttcattttaaaaattattaaaccgattctttaccacaaa

SEQ ID NO: 346 - protein, 227 aa, Arabidopsis thaliana
  G545
MALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 347 - DNA, 438 bp, Arabidopsis thaliana
  G548
atgggtcaaaatttcccaaatggattgggtacattctacatcggaatttataaacttgtggaagatccttcgtcggatccaataatctcgtggagcaaaagcaacaatggtttcgtcatgtgtaatgaggaagcgcgaatccgcagtaagatactcttgagattcaattgcggcaaactctcagagtttctctccgagctcaagtattacgtaagttttctatatatcctccgaatcgagttttggaatcatggctttacaagagttaagaagacggactctgggaaaatggaatttagaaatgaagatttcgttagaggccaacctgagcgtttaagggacatgatgctcaaagcttgtaggaagcacagagccaaattcaaagccaaagaagctgccaaagaagcagccaaagaattacaacgtttacagatttga

SEQ ID NO: 348 - protein, 145 aa, Arabidopsis thaliana
  G548
MGQNFPNGLGTFYIGIYKLVEDPSSDPIISWSKSNNGFVMCNEEARIRSKILLRFNCGKLSEFLSELKYYVSFLYILRIEFWNHGFTRVKKTDSGKMEFRNEDFVRGQPERLRDMMLKACRKHRAKFKAKEAAKEAAKELQRLQI

SEQ ID NO: 349 - DNA, 1529 bp, Arabidopsis thaliana
  G553
ttgatcggaatattccttttagaatgccaagattcattcttcatctctcgagctcctcatgaatttcttctctgcttatcaatggagatgatgagctcttcttcttctactactcaagttgtatcattcagagacatggggatgtatgaaccatttcaacagttatctggttgggagagtcctttcaaatcagatatcaacaatattactagtaatcagaataacaatcagagttcttcaacaacacttgaggttgatgctagaccagaagcagatgataacaatagagtgaattatacttctgtgtataataactctcttgaagcagaaccgtcgagtaataatgatcaggacgaagaccggatcaatgataagatgaaacggcgtttggctcagaaccgagaagctgctcgcaaaagtcgtttgagaaagaaggcccatgttcaacagttagaagaaagccggttgaagttgtcacagctcgagcaggaacttgtaagagctaggcagcagggattatgcgtacgcaattcttcagatactagttatctaggaccagctgggaatatgaactcaggtattgctgcatttgagatggaatacacacactggctagaagagcaaaacaggagagttagtgagattcgaacagcgctccaagctcatataggtgacattgagctcaaaatgttggtagatagttgcttgaaccactacgcaaatctcttccgcatgaaagctgatgctgcaaaggctgatgtgttcttcttgatgtcgggaatgtggcgaacttcaactgaacgcttcttccaatggattggaggtttccgcccatccgagcttttaaatgttgtgatgccatacgttgagcccttaaccgatcagcaactgttggaggtgcgtaacctgcaacagtcgtctcagcaagcagaggaggctctctctcaaggcttagataaacttcagcagggtttggtcgaaagcatagcaattcagataaaagttgttgagtctgtgaatcacggggctccaatggcttcagccatggagaatcttcaagcattggagagttttgtgaaccaggcggatcatctgagacaacagaccctgcagcaaatgagtaagatattgacgacaagacaggctgctcgagggttgctcgctctaggagaatacttccacaggctgcgtgctcttagttctctctgggcagctcgtccacgagaacacacttgacaagttaggaggcaaacaaaacaaagagaaagaagcacaaggcagatgatgttagctatagggacttgctttatctctcagaaagtgttggctgatattttctccattagagagcatcatcttcctcattgatgattttgtttacttgaaaggaataagagatgtgtaaatttgggtggaaaacatgtaatgtctttgatgcattaggctctttatttgtaaaatatatagggtttgttgtcactcatctcctcgtatatgaaaatttgagcccacaatcaaattttttgtct

SEQ ID NO: 350 - protein, 384 aa, Arabidopsis thaliana
  G553
MEMMSSSSSTTQVVSFRDMGMYEPFQQLSGWESPFKSDINNITSNQNNNQSSSTTLEVDARPEADDNNRVNYTSVYNNSLEAEPSSNNDQDEDRINDKMKRRLAQNREAARKSRLRKKAHVQQLEESRLKLSQLEQELVRARQQGLCVRNSSDTSYLGPAGNMNSGIAAFEMEYTHWLEEQNRRVSEIRTALQAHIGDIELKMLVDSCLNHYANLFRMKADAAKADVFFLMSGMWRTSTERFFQWIGGFRPSELLNVVMPYVEPLTDQQLLEVRNLQQSSQQAEEALSQGLDKLQQGLVESIAIQIKVVESVNHGAPMASAMENLQALESFVNQADHLRQQTLQQMSKILTTRQAARGLLALGEYFHRLRALSSLWAARPREHT

SEQ ID NO: 351 - DNA, 1832 bp, Arabidopsis thaliana
  G554
ccttccaaacactattggggaaatggcttcttctcttttttccggtgtaggtttaaggttttagatttgaaggcggatggtgaggagtttgtgttgatgaaatgggtgatttgaagttaaatacctttaagttcttttagccttaagttcttttagcctgtcattacaatatatgtttcagttgtgatcttttggtgctctccaaggtcttagggaatctccgtgtcccctctggtttctttctttgtataaagtctctggaatttaaagatgattttgtcctgttttcttcgaagaatttggcgaagaaacatcaaaagttcactatttgctttacgtgttatgcttgtttgactttgtgtgatctaacttttggttgaaaactaatgctcatcttttgttctttggaatgtcttgatctgcttgattttgaatgctttgtcacattgtttaaacaatttgttctttgttttcagttgaggaaaacatgaattcgacatcgacacattttgtgccaccgagaagagttggtatatacgaacctgtccatcaattcggtatgtggggggagagtttcaaaagcaatattagcaatgggactatgaacacaccaaaccacataataataccgaataatcagaaactagacaacaacgtgtcagaggatacttcccatggaacagcaggaactcctcacatgttcgatcaagaagcttcaacgtctagacatcccgataagatacaaagacggcttgctcaaaaccgcgaggctgctaggaaaagtcgcttgcgcaagaaggcttatgttcagcaactggaaacaagcaggttgaagctaattcaattagagcaagaactcgatcgtgctagacaacagggattctatgtaggaaacggaatagatactaattctctcggtttttcggaaaccatgaatccagggattgctgcatttgaaatggaatatggacattgggttgaagaacagaacagacagatatgtgaactaagaacagttttacacggacacattaacgatatcgagcttcgttcgctagtcgaaaacgccatgaaacattactttgagcttttccggatgaaatcgtctgctgccaaagccgatgtcttcttcgtcatgtcagggatgtggagaacttcagcagaacgattcttcttatggattggcggatttcgaccctccgatcttctcaaggttcttttgccacattttgatgtcttgacggatcaacaacttctagatgtatgcaatctaaaacaatcgtgtcagcaagcagaagacgcgttgactcaaggtatggagaagctgcaacacaccttgcggaccgttgcagcgggacaactcggtgaaggaagttacattcctcaggtgaattctgctatggatagattagaagctttggtcagtttcgtaaatcaggctgatcacttgagacatgaaacattgcaacaaatgtatcggatattgacaacgcgacaagcggctcgaggattattagctcttggtgagtattttcaacggcttagagccttgagctcaagttgggcaactcgacatcgtgaaccaacgtaggtttgagttattttgtaacaaccaaatgaagaaaatggaaagacctcaaaaatgaagaatgagtgcatctgaaaacagaggactactctgaataaatagaggggttgctgctgatatttatttttactctgcggcggaattagaaaatttgaaaaacatcatgtattgataagttgtaaatatcagaaaaaggtgggggtgcaaaaatttgtactttttagcttttgaaagaggcaagttt

SEQ ID NO: 352 - protein, 367 aa, Arabidopsis thaliana
  G554
MNSTSTHFVPPRRVGIYEPVHQFGMWGESFKSNISNGTMNTPNHIIIPNNQKLDNNVSEDTSHGTAGTPHMFDQEASTSRHPDKIQRRLAQNREAARKSRLRKKAYVQQLETSRLKLIQLEQELDRARQQGFYVGNGIDTNSLGFSETMNPGIAAFEMEYGHWVEEQNRQICELRTVLHGHINDIELRSLVENAMKHYFELFRMKSSAAKADVFFVMSGMWRTSAERFFLWIGGFRPSDLLKVLLPHFDVLTDQQLLDVCNLKQSCQQAEDALTQGMEKLQHTLRTVAAGQLGEGSYIPQVNSAMDRLEALVSFVNQADHLRHETLQQMYRILTTRQAARGLLALGEYFQRLRALSSSWATRHREPT

SEQ ID NO: 353 - DNA, 1360 bp, Arabidopsis thaliana
  G555
caaaagtagtaacctttgttggtgattgatactatatctgttgtgggttttagacaaagaccacgtctttgcagttgtagattggaattttccggatctttctctaaatcgctttttctccgagcaacttttgtttggggttaagctcaaagaatccgttcttttcagtctttactccatctagggtaccacgattggatcggtttttatctgatgatttagtaacagagattttgaagaaaaagaaaaatgggagatactagtccaagaacatcagtctcaacagatggagacactgatcataataacctaatgttcgatgaagggcatttgggtatcggtgcttctgattctagtgaccgttcaaagagtaaaatggatcaaaagacgcttcgtaggctcgctcaaaaccgtgaggctgcaaggaaaagcagattgaggaagaaagcatatgttcagcagctagagaacagtcgattgaagctaacacaacttgagcaggagctacaaagagcacggcaacagggtgtctttatctcaagctctggagaccaagcccattctaccgctggagatggggcaatggcatttgatgtagaatacagacgatggcaggaagataaaaacagacagatgaaggagctgagttctgctatagattctcacgcgactgattctgagcttcggataattgtagatggagtaatagctcactatgaggagctttacaggataaaaggcaacgcagctaagagtgatgtcttccatttattatcagggatgtggaaaaccccagctgagagatgtttcttgtggctcggcggtttccgttcatcagaacttctcaagcttatagcgtgtcagttggagcccttgacagaacaacaatcgctagacataaataacttgcaacagtcaactcagcaagcagaagatgctttgtctcaagggatggacaacttacagcaatcactcgctgatactttatcgagtgggactctcggttcaagttcatcagggaatgtagctagctacatgggtcagatggccatggcgatggggaagttaggtacccttgaaggatttatccgccaggctgataacttaaggctacaaacatatcaacagatggtgagactattaacaacccgacaatcggctcgtgctctccttgcagtacacaattatacattgcggttacgtgctcttagctctctatggcttgccagaccaagagagtgaaccatgactctattatacttcaacgaaggtccagaaaatttgagattcttagcataagatttgacgactttagacacgtagctcgtatacaagattatgattatactgttttgtgttg

SEQ ID NO: 354 - protein, 330 aa, Arabidopsis thaliana
  G555
MGDTSPRTSVSTDGDTDHNNLMFDEGHLGIGASDSSDRSKSKMDQKTLRRLAQNREAARKSRLRKKAYVQQLENSRLKLTQLEQELQRARQQGVFISSSGDQAHSTAGDGAMAFDVEYRRWQEDKNRQMKELSSAIDSHATDSELRIIVDGVIAHYEELYRIKGNAAKSDVFHLLSGMWKTPAERCFLWLGGFRSSELLKLIACQLEPLTEQQSLDINNLQQSTQQAEDALSQGMDNLQQSLADTLSSGTLGSSSSGNVASYMGQMAMAMGKLGTLEGFIRQADNLRLQTYQQMVRLLTTRQSARALLAVHNYTLRLRALSSLWLARPRE

SEQ ID NO: 355 - DNA, 1638 bp, Arabidopsis thaliana
  G558
ggaatttcggatcgtgtctctctctgtttctttgtttcaatccgatttcgaatcaagccctttacttgtgcaccttcaagatttcgttttttccagcgcccagaatgctccgggtgaccaacatttgttcctgattcatttcctattggttcgtattgtctgtgcacacaagagaaatttcaagaagttgttactaaaagagaggccacaagtggatattgtctttgttatcaagtgttagtacagaaaagtggtgagaaagtaatatggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtgaaactgtattttggtcacatgtcagctgtacaaaatccatatggacacaaaaccaggagagactattaatcaacacttgtcagattcttcttaccaaatccatcaacaaataagcaaatttctgggaaacaaaagactctttgtatgtaggtttcttctacatggttgtggtaattcatgttgttttagttgtagtcatcagtttttaatttagcatttgaaaagttcaatgttgtttatatagcatcttcgattatcttagaaaggttattgaattttgtttttttttgttacttttgtgtgtggtaaaggtgttttaaccttgcaacttctgtactgtaatcatttaacaatattaagatgttctatttgagttttgt

SEQ ID NO: 356 - protein, 330 aa, Arabidopsis thaliana
  G558
MADTSPRTDVSTDDDTDHPDLGSEGALVNTAASDSSDRSKGKMDQKTLRRLAQNREAARKSRLRKKAYVQQLENSRLKLTQLEQELQRARQQGVFISGTGDQAHSTGGNGALAFDAEHSRWLEEKNKQMNELRSALNAHAGDSELRIIVDGVMAHYEELFRIKSNAAKNDVFHLLSGMWKTPAERCFLWLGGFRSSELLKLLANQLEPMTERQLMGINNLQQTSQQAEDALSQGMESLQQSLADTLSSGTLGSSSSGNVASYMGQMAMAMGKLGTLEGFIRQADNLRLQTLQQMIRVLTTRQSARALLAIHDYFSRLRALSSLWLARPRE

SEQ ID NO: 357 - DNA, 1407 bp, Arabidopsis thaliana
  G559
aaagttgctagctttaatttgccaacttactattcttatgtgtaataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcaaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggattttagggttttagctaacaca

SEQ ID NO: 358 - protein, 398 aa, Arabidopsis thaliana
  G559
MDKEKSPAPPCGGLPPPSPSGRCSAFSEAGPIGHGSDANRMSHDISRMLDNPPKKIGHRRAHSEILTLPDDLSFDSDLGVVGNAADGASFSDETEEDLLSMYLDMDKFNSSATSSAQVGEPSGTAWKNETMMQTGTGSTSNPQNTVNSLGERPRIRHQHSQSMDGSMNINEMLMSGNEDDSAIDAKKSMSATKLAELALIDPKRAKRIWANRQSAARSKERKTRYIFELERKVQTLQTEATTLSAQLTLLQRDTNGLTVENNELKLRLQTMEQQVHLQDELNEALKEEIQHLKVLTGQVAPSALNYGSFGSNQQQFYSNNQSMQTILAAKQFQQLQIHSQKQQQQQQQQQQQHQQQQQQQQQYQFQQQQMQQLMQQRLQQQEQQNGVRLKPSQAQKEN

SEQ ID NO: 359 - DNA, 1413 bp, Arabidopsis thaliana
  G561
aatttgtttttttttcttttgtgggttcaattcgaattgttttccctgagactcaagttactgtgtcattactctgcattgagcaatgggtagcaacgaagaaggaaaccccactaacaactctgataagccatcgcaagctgctgctcctgagcagagtaatgttcatgtgtatcatcatgactgggctgctatgcaggcatattatgggcctagagttggtatacctcaatattacaactcaaatttggcgcctggtcatgctccaccgccttatatgtgggcgtctccatcgccaatgatggctccttatggagcaccatatccaccattttgccctcctggtggagtttatgctcatcctggtgttcaaatgggctcacaaccacaaggtcctgtttctcaatcagcatctggagttacaacccctttgaccattgatgcaccagctaattcagctggaaactcagatcatgggttcatgaaaaagctgaaagagttcgatggacttgcaatgtcaataagcaataacaaagttgggagtgctgaacatagcagcagtgaacataggagttctcagagctccgagaatgatggctctagcaatggtagtgatggtaatacaactgggggagaacaatctaggaggaaaagaaggcaacaaagatcaccaagcactggtgaaagaccctcatctcaaaacagtctgcctcttagaggtgaaaatgagaaacccgatgtgactatggggactcctgttatgcccacagcaatgagtttccaaaactctgctggcatgaacggtgtgccacagccatggaatgaaaaagaggttaaacgagagaagagaaaacagtcaaaccgagaatctgctaggaggtcaagactgaggaagcaggctgaaacagaacaactatctgtcaaagttgacgcattagtagctgagaacatgtctctgaggtctaaactaggccagctaaacaatgagtctgagaaactacggctggagaacgaagctatattggatcaactgaaagcgcaagcaacagggaaaacagagaacctgatctctcgagttgataagaacaactctgtatcaggtagcaaaactgtgcagcatcaactgttaaatgcaagtccgataaccgatcctgtcgcggctagctgaccgtggccgcaacaatgagaacccgatatttcttcctttgggttgtgattgtaacttaaaaggagactttttgtttttattcttagatttgtagctctctgcatagtgagcataaattgatgtaatatggtttaagagattcggtgttctctggtgtgtgctgcaaccacataattggtgatagataggtttagttatataagcaaatgtattagagataaggggagacatatttgatggtcttt

SEQ ID NO: 360 - protein, 360 aa, Arabidopsis thaliana
  G561
MGSNEEGNPTNNSDKPSQAAAPEQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 361 - DNA, 1554 bp, Arabidopsis thaliana
  G562
atttgaatttctgggtttctctctgtttaagcttcttcttcttcatcttctgcttacgtttcttcttcaaggagctttcggattcttgtagaaagagtcattgttctcttgagtgggaaaccttgaaaccattcctatgggaaatagcagcgaggaaccaaagcctcctaccaaatcagataaaccatcttcacccccggtggatcaaacaaatgttcatgtctaccctgattgggcagctatgcaggcatattatggtccaagagtagcaatgcctccttattacaattcagctatggctgcatctggtcatcctcctcctccttacatgtggaatcctcagcatatgatgtcaccatctggagcaccctatgctgctgtttatcctcatggaggaggagtttacgctcatcccggtattcccatgggatcactgcctcaaggtcaaaaggatccacctttaacaactccggggacgcttttgagcatcgacactcctactaaatctacagggaacacagacaatggattgatgaagaagctgaaagagtttgatgggcttgctatgtctctaggaaatgggaatcctgaaaatggtgcagatgaacataaacgatcacggaacagctcagaaactgatggttctactgatggaagtgatgggaatacaactggggcagatgaaccgaaacttaaaagaagtcgagagggaactccaacaaaagatgggaaacaattggttcaagctagctcatttcattctgtttctccgtcaagtggtgataccggcgtaaaactcattcaaggatctggagctatactctctcctggtgtaagtgcaaattccaaccccttcatgtcacaatctttagccatggttcctcctgaaacttggcttcagaacgagagagaactgaaacgggagcgaaggaaacagtctaatagagaatctgctagaaggtcaagattaaggaaacaggccgagacagaagaacttgctaggaaagtggaagccttgacagccgaaaacatggcattaagatctgaactaaaccaacttaatgagaaatctgataaactaagaggagcaaatgcaaccttgttggacaaactgaaatgctcggaacccgaaaagagagtccccgcaaatatgttgtctagagttaagaactcaggagctggagataagaacaagaaccaaggagacaatgattctaactctacaagcaaattccatcaactgctcgatacgaagcctcgagctaaagcagtagctgcaggctgaatcgatggtaattcatgtcgatttctacttaatttgtcgacataaacaaagaaaataagtgctactaatttcagaaaaacttgatagatagatagtatagtagagagagagagagagagagaggtgtgatgattattgatctataaattttcggagagagagagggagaaagagaaacttttcctccagatgaaaatttggtgttatggtttgttactgttaatatagagaggcttttctttttttataaaatggcttcctttgttgca

SEQ ID NO: 362 - protein, 382 aa, Arabidopsis thaliana
  G562
MGNSSEEPKPPTKSDKPSSPPVDQTNVHVYPDWAAMQAYYGPRVAMPPYYNSAMAASGHPPPPYMWNPQHMMSPSGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKFHQLLDTKPRAKAVAAG

SEQ ID NO: 363 - DNA, 916 bp, Arabidopsis thaliana
  G563
attgttctttctctttgacaaaacccagatagataaaaattcgttccaattccagtgagctccggaaatggcgtccttcaagttgatgtcttcttccaattccgacttgtctcgccgtaattcttcttctgcttcatcttccccttctataagatcatcgcaccatctccgaccaaatcctcacgccgatcactccagaatcagtttcgcttacggcggaggagtcaacgattacactttcgcgtctgattcaaagcccttcgagatggcgattgatgttgatcggagtatcggagatcggaacagcgttaacaacggaaagagtgttgacgatgtttggaaagagattgtatctggagagcaaaagacgatcatgatgaaggaagaagaaccagaagatataatgacacttgaggatttcttagcgaaagcagaaatggacgagggagcttcagatgaaatcgatgtgaagattccaacggagagactcaacaacgacggtagctatacatttgattttccgatgcagcgacacagttcgttccagatggttgaaggatcaatgggtggaggagtaacgagaggaaagagagggagagtgatgatggaggcaatggataaagctgcagctcagagacagaagaggatgatcaagaaccgtgaatccgctgctaggtctcgagagaggaaacaggcttatcaggttgagttagagactttggctgccaagttagaggaggagaatgagcagcttttgaaggagattgaagagagcactaaagagagatacaagaagctcatggaggttctgattccggtcgatgagaaaccaaggccaccgtcgaggcccttaagcaggagccattccttggaatggtgaagtgtggtaaaaaaaacttttgcggccgcgaattcc

SEQ ID NO: 364 - protein, 270 aa, Arabidopsis thaliana
  G563
MASFKLMSSSNSDLSRRNSSSASSSPSIRSSHHLRPNPHADHSRISFAYGGGVNDYTFASDSKPFEMAIDVDRSIGDRNSVNNGKSVDDVWKEIVSGEQKTIMMKEEEPEDIMTLEDFLAKAEMDEGASDEIDVKIPTERLNNDGSYTFDFPMQRHSSFQMVEGSMGGGVTRGKRGRVMMEAMDKAAAQRQKRMIKNRESAARSRERKQAYQVELETLAAKLEEENEQLLKEIEESTKERYKKLMEVLIPVDEKPRPPSRPLSRSHSLEW

SEQ ID NO: 365 - DNA, 1110 bp, Arabidopsis thaliana
  G564
aatcagcagttcttggtgtttgagacacatgtctccaataatactcagtgagatctttctctctgggtttatgttaaattccacaatcaggcgcaggacccatcttgttcaatctttctctgttgtcttcctttactggctttactatgtctcatgatctctgaacttatctccagttttatatctatacgcataattacaacaaaaccctagtttcttttcaaatttctcttcttcgtttttcgtcatctgggtcctgtcctgttctgttgtgtcttgttctgttctgtttttaattcccctaaaaacccattttaaaatattttatctctcttctcttaaaaaaaactcttccctgtttttgtttgtgtgttactaaatggaatcgtcgtcgtcgggaacaacttcgtcgacgattcaaacgtcgtcaggatcggaggagagtctcatggagcagaggaaacgtaaacggatgctctcaaaccgtgaatctgcaaggagatcaagaatgaagaaacaaaagctcctagacgatctaacggctcaggttaatcatctgaaaaaagagaacacggagatcgtgacaagtgtcagcatcacaacgcaacactacctaaccgttgaagcagagaactctgttctcagagctcagcttgatgaacttaaccacaggctccaatctctcaacgacatcatcgagttcctcgacagtagcaacaacaacaacaacaacaacaacatgggcatgtgttcgaaccctctggttggtttggagtgtgatgatttcttcgtgaatcagatgaacatgtcttatattatgaaccagcctctcatggcgtcttctgatgctttaatgtattaaatgtggacctaaaaaccccctcgaaatcacaaagaaatggggccgtttttatttgtccgatttagagacatgtccaaagagagagatttatatataaaaatgggtctgttgtttgatttgtttccatttcaaatttttgtttgtttgggtccgttttaggcgttaggtatctctaagcatcatcgttatgagtgtgtctgtaataaaggctctgttgccgcatgagtacaaagtgttttcttaatatt

SEQ ID NO: 366 - protein, 160 aa, Arabidopsis thaliana
  G564
MESSSSGTTSSTIQTSSGSEESLMEQRKRKRMLSNRESARRSRMKKQKLLDDLTAQVNHLKKENTEIVTSVSITTQHYLTVEAENSVLRAQLDELNHRLQSLNDIIEFLDSSNNNNNNNNMGMCSNPLVGLECDDFFVNQMNMSYIMNQPLMASSDALMY

SEQ ID NO: 367 - DNA, 2415 bp, Arabidopsis thaliana
  G566
attcctccataacccctttcttccttttgaatctctccttcttcttcttcatccccaaattcgaaaccctaaccctaaaactcagtttcaaaatggctgaaccaatcaccaaggagcagcctcctccacctgcgccggaccctaattccacctaccctcctccgtccgattttgattccatctcgatccctccgttagatgatcatttctccgatcagactccgattggtgaactaatgtccgatctggggtttcccgatggtgaattcgagctcactttcgacggtatggacgatctttacttccctgctgagaatgagtcgtttctcatccctatcaatacgtccaatcaagaacagtttggtgatttcactccggagtctgaaagttctggaatttccggtgattgtattgttcccaaagatgcagataagactattacaacttccggttgcattaaccgggaatctcctagagattccgatgatcgttgctccggtgctgaccataatttagatctaccgactccattgtcctctcagggttcgggtaattgcggttctgatgtttcggaagctacaaatgaatcgtcgcctaaatcgagaaacgttgcggtcgaccagaaggttaaagtggaagaagctgctacgacgacgacgtctattaccaagaggaagaaagagatcgatgaggatttgactgacgagtctaggaacagtaagtacaggagatcgggagaggattcttacgctagtgctgttaccggtgaagaagatgagaaaaagagagctagactcatgagaaaccgtgaaagtgctcagctttctaggcagaggaagaagcattacgtcgaggagcttgaagaaaaggttaggaatatgcattctacgattacggatttgaacggtaagatatcgtatttcatggctgagaatgctactctaaggcagcaattgggtggcaatggaatgtgcccgccgcatcttccaccacctccgatgggaatgtatccacctatggctccaatgccttatccatggatgccttgtcctccttatatggtgaagcaacaaggatctcaagtgcctttgattcctattcctaggttgaaaccacagaacacccttggaacatccaaggctaagaagtccgagagtaagaagagtgaagctaagaccaagaaggtggctagtattagttttctgggtcttctgttttgtctatttttgtttggtgcattagctccaattgtgaacgttaattatggaggaattagtggtgctttttatgggaactatagatctaattatattactgaccagatttacagtcagcatagggatagagttttggatacatctcgtagtggtgctggtactggggtttctaatagtaatgggatgcatcgtgggagagattctgatcgaggagctaggaaaaatatatctgcaacagagagttctgtcactcctggaaatggtagtgagcctctagttgcatcactctttgttccgaggaatgacaagcttgtgaagatagatgggaatttgattatcaattctatattggcgagtgagaaagccgtggcttcgagaaaggcttctgaatcaaaggagaggaaagctgacttgatgatctctaaagattatacccctgcactgcctctacctgacgtgggaaggacagaggaattggctaagcatctctatagatctaaggctgaaaaacagaaagctctatcctctggctctgctgatactctgaaagaccaagtcaaaacaaaagcagccaacggtgaaatgcagcaatggttccgtgaaggtgttgcaggtcccatgtttagttcagggatgtgcactgaagtgtttcagtttgatgtatcctcaacctctggagccatcattcctgcagctaccaacgtctctgctgaacacggtaagaacaccacagacacacacaagcaacagaacagaagaatccttcgtggtcttcccattccactcccaggatcagattttaacctcacgaaagagcaccaaagaaacagcagtagcaaagaaatcaagcctgcttcatcaatggttgtatctgtgcttgttgatcccagagaaggaggtgatggagatatagatgggatgattgggggaccaaaatcactgtctcgagtttttgtagtcgtgcttctggacagtgcaaagtatgtaacatactcctgtgtcctacctcgatcaggagctcctcatcttgtgaccacttgaagacatatgaggattgaaacatatatcagcaggtcttctctcatataggctttgtatgtaaaagaataaatacctgctctctggtatcccgtaatatccttagctaataccgttgtccggtttttgtttccagatgtagaatccgaatgctgtaact

SEQ ID NO: 368 - protein, 721 aa, Arabidopsis thaliana
  G566
MAEPITKEQPPPPAPDPNSTYPPPSDFDSISIPPLDDHFSDQTPIGELMSDLGFPDGEFELTFDGMDDLYFPAENESFLIPINTSNQEQFGDFTPESESSGISGDCIVPKDADKTITTSGCINRESPRDSDDRCSGADHNLDLPTPLSSQGSGNCGSDVSEATNESSPKSRNVAVDQKVKVEEAATTTTSITKRKKEIDEDLTDESRNSKYRRSGEDSYASAVTGEEDEKKRARLMRNRESAQLSRQRKKHYVEELEEKVRNMHSTITDLNGKISYFMAENATLRQQLGGNGMCPPHLPPPPMGMYPPMAPMPYPWMPCPPYMVKQQGSQVPLIPIPRLKPQNTLGTSKAKKSESKKSEAKTKKVASISFLGLLFCLFLFGALAPIVNVNYGGISGAFYGNYRSNYITDQIYSQHRDRVLDTSRSGAGTGVSNSNGMHRGRDSDRGARKNISATESSVTPGNGSEPLVASLFVPRNDKLVKIDGNLIINSILASEKAVASRKASESKERKADLMISKDYTPALPLPDVGRTEELAKHLYRSKAEKQKALSSGSADTLKDQVKTKAANGEMQQWFREGVAGPMFSSGMCTEVFQFDVSSTSGAIIPAATNVSAEHGKNTTDTHKQQNRRILRGLPIPLPGSDFNLTKEHQRNSSSKEIKPASSMVVSVLVDPREGGDGDIDGMIGGPKSLSRVFVVVLLDSAKYVTYSCVLPRSGAPHLVTT

SEQ ID NO: 369 - DNA, 1479 bp, Arabidopsis thaliana
  G567
aaaaagaagaatcagaaagtgaaaaagagagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatatataagctctgtcttataacattacaagattcttatttgagaatcgtctttctatttatagctaataaaaaaaaaaaaaaaaa

SEQ ID NO: 370 - protein, 411 aa, Arabidopsis thaliana
  G567
MNSIFSIDDFSDPFWETPPIPLNPDSSKPVTADEVSQSQPEWTFEMFLEEISSSAVSSEPLGNNNNAIVGVSSAQSLPSVSGQNDFEDDSRFRDRDSGNLDCAAPMTTKTVNVDSDDYRRVLKNKLEAECATGVSLRVGSVKPEDSTSSPETQLQPVQSSPLTQGELGVTSSLPAEVKKTGVSMKQVTSGSSREYSDDEDLDEENETTGSLKPEDVKKSRRMLSNRESARRSRRRKQEQTSDLETQVNDLKGEHSSLLKQLSNMNHKYDEAAVGNRILKADIETLRAKVKMAEETVKRVTGMNPMLLGRSSGHNNNNRMPITGNNRMDSSSIIPAYQPHSNLNHMSNQNIGIPTILPPRLGNNFAAPPSQTSSPLQRIRNGQNHHVTPSANPYGWNTEPQNDSAWPKKCVD

SEQ ID NO: 371 - DNA, 1370 bp, Arabidopsis thaliana
  G569
gtcgacccacgcgtccgggtttttcttttatcctcttatcgctaatctggagctctatatagactataaagggtttttgattgattcgggagctcgagatttgacttcttttagctgattcggcaagtttgtatctagaaaggatcgattggtgaggtcaatagtggttggtgggttttagtaatggaagacggtgagcttgatttctccaatcaggaagtgttttcgagttcggagatgggtgaattaccacctagcaattgttcgatggatagtttctttgatgggcttttaatggatactaatgctgcttgtacccacactcacacctgtaaccccactggaccagagaacactcatactcacacgtgcttccatgtccacaccaagattctcccggatgagagcgatgaaaaagtttctactgatgatacagctgagtcttgtgggaagaagggtgaaaagagacctttgggaaaccgggaagcggttagaaagtatagagagaagaagaaggctaaagctgcttctttggaggatgaggttgcaaggcttagggcggtgaatcagcagctggtgaagaggttgcaaaatcaggctaccttggaagctgaggtttcgaggcttaagtgtttgcttgtggatttgagaggaagaatagatggagagattggatcttttccttatcagaaacctatggctgcaaatattccttctttctcgcacatgatgaatccttgtaatgtacaatgtgatgatgaagtttattgccctcagaatgtgtttggagtgaatagccaagaaggtgcctcgatcaatgaccaagggttaagtggttgtgattttgatcagctacaatgcatggctaatcagaacttaaatggaaatggaaacggatcattcagcaacgtcaatacatctgtctcgaataagagaaaaggtgggcatcgtgcatcaagagcagtttgaagcatcatcaagcttgtactatctatttccaccagcatagatattgtattccaaataagttgtagagttcagctgcaggatcagcttcgctcagctttgaggggttggtggtgtggtctttctttgtggcacgagtgagatctatggacagaacccagatttagtagtagtagaggcaggatttcgacttccactaaccatcatgttgcttggtgaagaacaaggtatgcccatgaagcacactgttttgtacattgagcttgaggggctgtctctgatctagccttactgtaacattgcaacgttctcacaattgtgatcccaagttgctttgttgacttaaatgtgataatatagcttaacttttacttgaaaaaaaaaaaaaaaaaaaaaaaaaaaaa

SEQ ID NO: 372 - protein, 261 aa, Arabidopsis thaliana
  G569
MEDGELDFSNQEVFSSSEMGELPPSNCSMDSFFDGLLMDTNAACTHTHTCNPTGPENTHTHTCFHVHTKILPDESDEKVSTDDTAESCGKKGEKRPLGNREAVRKYREKKKAKAASLEDEVARLRAVNQQLVKRLQNQATLEAEVSRLKCLLVDLRGRIDGEIGSFPYQKPMAANIPSFSHMMNPCNVQCDDEVYCPQNVFGVNSQEGASINDQGLSGCDFDQLQCMANQNLNGNGNGSFSNVNTSVSNKRKGGHRASRAV

SEQ ID NO: 373 - DNA, 1662 bp, Arabidopsis thaliana
  G570
aagcttgatcctcctagttgtacgaaagcttgagtaatggggtctagattaaacttcaagagctttgttgatggtgtgagtgagcagcagccaacggtggggactagtcttccattgactaggcagaactctgtgttctcgttaacctttgatgagtttcagaactcatggggtggtggaattgggaaagattttgggtctatgaacatggatgagctcttgaagaacatttggactgcagaggaaagtcattcaatgatgggaaacaataccagttacaccaacatcagcaatggtaatagtggaaacactgttattaacggcggtggtaacaacattggtgggttagctgttggtgtgggaggagaaagtggtggttttttcactggtgggagtttgcagagacaaggttcacttaccttgcctcggacgattagtcagaaaagggttgatgatgtctggaaggagctgatgaaggaggatgacattggaaatggtgttgttaatggtgggacaagcggaattccgcagaggcaacaaacgctgggagagatgactttggaggagtttttggtcagggctggtgtggttagggaagaacctcaaccggtggagagtgtaactaacttcaatggcggattctatggatttggcagtaatggaggtcttgggacagctagtaatgggtttgttgcaaaccaacctcaagatttgtcaggaaatggagtagcggtgagacaggatctgctgactgctcaaactcagccactacagatgcagcagccacagatggtgcagcagccacagatggtgcagcagccgcaacaactgatacagacgcaggagaggccttttcccaaacagaccactatagcattttccaacactgttgatgtggttaaccgttctcaacctgcaacacagtgccaggaagtgaagccttcaatacttggaattcataaccatcctatgaacaacaatctactgcaagctgtcgattttaaaacaggagtaacggttgcagcagtatctcctggaagccagatgtcacctgatctgactccaaagagcgccctggatgcatctttgtcccctgttccttacatgtttgggcgagtgagaaaaacaggtgcagttctggagaaagtgattgagagaaggcaaaaaaggatgataaagaatagggaatcagctgcaagatcccgcgctcgcaagcaagcttatacgatggaactggaagcagaaattgcgcaactcaaagaattgaatgaagagttgcagaagaaacaagttgaaatcatggaaaagcagaaaaatcagcttctggagcctctgcgccagccatggggaatgggatgcaaaaggcaatgcttgcgaaggacattgacgggtccctggtagagcttataatggcgtctaaggaacccaacaaagcgccgaagttatagaacaactcagaagatagaaagctagctttgtacgtagtttaggcaggttctgtgggtgattgtaaatcttgaagtgtggcggatttgacagagatagataaacacatatctgttctattttcctaaatcttttggttttatcttcctgatgtaatggatctttatcatttgtcttgaacatctttgtgacttaaccagagtgaatttatcttgt

SEQ ID NO: 374 - protein, 454 aa, Arabidopsis thaliana
  G570
MGSRLNFKSFVDGVSEQQPTVGTSLPLTRQNSVFSLTFDEFQNSWGGGIGKDFGSMNMDELLKNIWTAEESHSMMGNNTSYTNISNGNSGNTVINGGGNNIGGLAVGVGGESGGFFTGGSLQRQGSLTLPRTISQKRVDDVWKELMKEDDIGNGVVNGGTSGIPQRQQTLGEMTLEEFLVRAGVVREEPQPVESVTNFNGGFYGFGSNGGLGTASNGFVANQPQDLSGNGVAVRQDLLTAQTQPLQMQQPQMVQQPQMVQQPQQLIQTQERPFPKQTTIAFSNTVDVVNRSQPATQCQEVKPSILGIHNHPMNNNLLQAVDFKTGVTVAAVSPGSQMSPDLTPKSALDASLSPVPYMFGRVRKTGAVLEKVIERRQKRMIKNRESAARSRARKQAYTMELEAEIAQLKELNEELQKKQVEIMEKQKNQLLEPLRQPWGMGCKRQCLRRTLTGPW

SEQ ID NO: 375 - DNA, 1888 bp, Arabidopsis thaliana
  G571
tagccgacctctcttctctcttctgaaaaaaacaccaaaggagctttaaatgctccgttacataatctctatctctttccaagaatatagagaaaggaaaataatatacaagaattaaaagaaggtatatcatcatctctctagctagtgatcaaagcaccgtcatcatcatcatatatcatcagcttgcctcagaggagaagaccaacataagagagatcgaagatcaaaatctatctctcttcatcatcttctgctgttactatcatatcacacgctctctcaaacatcatcctatatatagacttctcttcatcatcatcaaatgcaaggtcatcaccagaatcatcatcaacacttatcatcatcctccgccacgtcttcccatggaaacttcatgaacaaagatgggtatgatattggagagatagacccatcactcttcctctatcttgatggacaaggacatcatgatcctccatcaactgctccttctcctttacatcatcatcacacaactcagaatttggcgatgagacctccaacatcgacgctcaacatctttccatctcagcctatgcacatagagccacctccttcttctacacacaataccgataatacaagattagttccggctgctcaacctagtggttccactcgaccagcttctgacccgtccatggacttgaccaatcattctcagtttcatcaacctcctcaaggttctaaatccatcaagaaggaagggaaccgcaagggtcttgcctcatcggaccatgacatacctaaatcgtcagaccctaaaacattgagaagactagcacaaaacagagaagcagcaagaaaaagcagattacgtaaaaaggcttatgttcagcaactcgagtcatgtaggatcaaactgacccaactagaacaagagattcaacgggccagatcccaaggcgtattctttggagggtctcttataggaggagatcaacagcaaggtggactacccattggccctggcaacatcagctctgaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataatactaaaacaactgatgaaggaaaccaaaaacaaaaacaagagaataggttgattagttagccgccagcttgacctctttatcatatatatcgtctctctactcaaatacagtgcaattagggaaaattgtttggcttctttttggtatatgattcttactattatgtttttaatcaaga

SEQ ID NO: 376 - protein, 460 aa, Arabidopsis thaliana
  G571
MQGHHQNHHQHLSSSSATSSHGNFMNKDGYDIGEIDPSLFLYLDGQGHHDPPSTAPSPLHHHHTTQNLAMRPPTSTLNIFPSQPMHIEPPPSSTHNTDNTRLVPAAQPSGSTRPASDPSMDLTNHSQFHQPPQGSKSIKKEGNRKGLASSDHDIPKSSDPKTLRRLAQNREAARKSRLRKKAYVQQLESCRIKLTQLEQEIQRARSQGVFFGGSLIGGDQQQGGLPIGPGNISSEAAVFDMEYARWLEEQQRLLNELRVATQEHLSENELRMFVDTCLAHYDHLINLKAMVAKTDVFHLISGAWKTPAERCFLWMGGFRPSEIIKVIVNQIEPLTEQQIVGICGLQQSTQEAEEALSQGLEALNQSLSDSIVSDSLPPASAPLPPHLSNFMSHMSLALNKLSALEGFVLQADNLRHQTIHRLNQLLTTRQEARCLLAVAEYFHRLQALSSLWLARPRQDG

SEQ ID NO: 377 - DNA, 1104 bp, Arabidopsis thaliana
  G572
aggtaaccatggtccacaattgtccccctactagtctatatgaacacctcttctcaccacacacaccaaacattcatcacaattccctaaatcctacaatctttcttttcttccatcacctaagagtaaaccctaccttgcgtcccaagtctccaccgataatgcaaccatccaccaacatttttagcctccatggttgtccaccttcgtacctttcccatattcctacatcctcaccattttgcggacaaaaccctaatccattcttcagcttcgaaactggcgtgaacacttcacagttcatgagtttgatcagcagcaacaactcgacctcagatgaagcagaagagaatcataaggagataataaatgagaggaagcaaaagaggaagatatctaacagagaatcggcaagaagatcgcgtatgaggaagcagagacaagtggatgagctttggtcacaggtgatgtggcttagggatgagaatcatcagctgcttcgtaagcttaactgcgttttagagtctcaagagaaggttattgaagagaatgttcagctcaaagaggaaaccactgagcttaagcaaatgattagtgatatgcagcttcagaatcagagtcctttctcttgcatcagagacgacgacgacgttgtatagatgatttttatttttatttttttggggctctagtatgtatcaacaaatgtatatccagagatctgtctcagcttaagatttaattaagactctaaattagtaattgttaaagcagagttcttcaaacttgtgttgcccgtgaatagaagtaagaaattgtttcacaattgtttgcataacaaacgataaaaattcacattgctgaagtataattttaaaaaaaattacatgcataaatatttttgcaaaatgtaaatacaagcatcaattactaacagtagactttcttctttttctctttaaaattttacgtttataatgaccaattttgttctttctaaattggcttaagtagtgtctttgaaaaaaatatacaccagccgtaaacggtttattttcttccatttccatttgcatttttatgttgaaaaattattaagaaaag

SEQ ID NO: 378 - protein, 216 aa, Arabidopsis thaliana
  G572
MVHNCPPTSLYEHLFSPHTPNIHHNSLNPTIFLFFHHLRVNPTLRPKSPPIMQPSTNIFSLHGCPPSYLSHIPTSSPFCGQNPNPFFSFETGVNTSQFMSLISSNNSTSDEAEENHKEIINERKQKRKISNRESARRSRMRKQRQVDELWSQVMWLRDENHQLLRKLNCVLESQEKVIEENVQLKEETTELKQMISDMQLQNQSPFSCIRDDDDVV

SEQ ID NO: 379 - DNA, 978 bp, Arabidopsis thaliana
  G578
atgcatagtttgaatgaaacagtaattcctgatgttgattacatgcagtctgatagagggcatatgcatgctgctgcctctgattccagtgatcgatcaaaggataagttggatcaaaagacccttcgtaggcttgctcaaaatcgtgaggcagcaagaaaaagcagattgaggaagaaggcgtatgttcagcagctggaagatagtcgattaaagctgactcaagttgagcaggagctgcaaagagcaagacagcagggagttttcatctcaagttcaggagaccaagctcattctactggtggcaatggtggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcatctaagaatgatgtcttccacttgttatctggaatgtggaaaacaccagctgagcgatgtttcttgtggcttggcgggttcccgtcatccgaacttctcaagcttcttgcgaatcagctagagcccatgacagaacgacaggtaatgggcatcaatagcttgcagcagacgtcgcagcaggcagaagatgctttatctcaagggatggagagtttacagcaatccctagctgatactttatccagtggaactcttggttccagttcatcggataatgtcgcgagctacatgggtcagatggccatggcaatgggcaagttaggcaccctcgaaggattcatacgccaggctgataacttgaggctgcaaacactacaacagatgcttcgagtattaacaacacgtcagtcagctcgtgctcttcttgctatacacgattattcatctcgattacgtgctcttagttccttgtggcttgcccggccaagagagtga

SEQ ID NO: 380 - protein, 325 aa, Arabidopsis thaliana
  G578
MHSLNETVIPDVDYMQSDRGHMHAAASDSSDRSKDKLDQKTLRRLAQNREAARKSRLRKKAYVQQLEDSRLKLTQVEQELQRARQQGVFISSSGDQAHSTGGNGGALAFDAEHSRWLEEKNRQMNELRSALNAHAGDTELRIIVDGVMAHYEELFRIKSNASKNDVFHLLSGMWKTPAERCFLWLGGFPSSELLKLLANQLEPMTERQVMGINSLQQTSQQAEDALSQGMESLQQSLADTLSSGTLGSSSSDNVASYMGQMAMAMGKLGTLEGFIRQADNLRLQTLQQMLRVLTTRQSARALLAIHDYSSRLRALSSLWLARPRE

SEQ ID NO: 381 - DNA, 1054 bp, Arabidopsis thaliana
  G580
ccaaaaaacaaagcattctatgctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatcaactcttttgacttttgtactttttttcttctctacttaacctctattattgtaatgccaagtcaagtccttatctagctagtacatgagtttctgttttcactggttaagccat

SEQ ID NO: 382 - protein, 234 aa, Arabidopsis thaliana
  G580
MLSSAKHNKINNHSAFSISSSSSSLSTSSSLGHNKSQVTMEEVWKEINLGSLHYHRQLNIGHEPMLKNQNPNNSIFQDFLNMPLNQPPPPPPPPSSSTIVTALYGSLPLPPPATVLSLNSGVGFEFLDTTENLLASNPRSFEESAKFGCLGKKRGQDSDDTRGDRRYKRMIKNRESAARSRARKQAYTNELELEIAHLQTENARLKIQQEQLKIAEATQNQVKKTLQRSSTAPF

SEQ ID NO: 383 - DNA, 1544 bp, Arabidopsis thaliana
  G582
cttttacacaacaaactcctgcagccatagtgtcctcttctcctccggatttagtacttcaacaaaaactccggtttgtcgtggaaacctcaccggaccgatgggcttatgtcattttttggcaaaagatgtttgatgatcaatcggaccggtcttacttggtttgggttgatggtcatttctgtggaaacaagaacaacaattcccaagaaaatgttcatttttctttgcctcttatgttatctaatcaaaatatccaaaatttatttaaatcaacttcttaaaaaagttctattaagaaaataatataattttccttacccttgattttttgtttttgtttctttcttaagtatacaacaaacagcatcgagtgtgagctgatgatggacggtggagatgatctggagttgttctatgccgcatcgttttacggtgaagatagatcgccgagaaaggaagtatccgatgaatctttggtttggttaaccggtcccgacgagctccggtttagcaactacgagagggctaaagaagccggttttcacggggtacacacattggtctccatacccatcaacaatggcattatcgaacttggttcgtctgaatcaattatacaaaaccggaactttataaaccgagtcaagtccatattcgggtcgggtaaaacaacaaaacacactaaccaaaccggttcttaccctaaaccggcggtatcagatcattcgaaaagcggaaatcagcaattcgggtcggaaagaaaacggaggaggaaacttgagacgacaagggtagctgcggcgacgaaagagaaacatcatccggcggttttgtcccacgtggaagcggagaagcaacggagagagaagctaaaccaccggttttacgctctacgtgccatcgtaccaaaagtgtcacgaatggacaaagcgtcacttttatccgacgcagtttcgtacatagaaagtcttaaatccaaaatcgatgatctcgaaactgagatcaagaaaatgaagatgacggagacagataaattagacaacagcagcagcaatacgtctccgtcttccgttgagtaccaagttaaccagaaaccttcaaaatcaaacagaggctctgacttggaagtgcaagtgaagatcgtcggagaagaagccataattagggttcagacagagaatgtgaaccatcctacgtcggcattgatgagtgcgttaatggaaatggattgtcgtgtacaacacgcgaacgcgtcgcgcttgagtcaggttatggttcaagatgttgttgttttggttccagaaggattaagatcggaagataggcttaggaccacacttgtccgaaccctaagcctataacaatttctttgttttgtgacgtcaacataggatgtgataataatttttgtttttttttgcgaccttttgttttatttgataagtactagaaaaatcaaattccttctagcgattaatgttgttttatcaaaagtttgatctcgttgatacgtagtttatgtgttacttttttactttaaa

SEQ ID NO: 384 - protein, 326 aa, Arabidopsis thaliana
  G582
MMDGGDDLELFYAASFYGEDRSPRKEVSDESLVWLTGPDELRFSNYERAKEAGFHGVHTLVSIPINNGIIELGSSESIIQNRNFINRVKSIFGSGKTTKHTNQTGSYPKPAVSDHSKSGNQQFGSERKRRRKLETTRVAAATKEKHHPAVLSHVEAEKQRREKLNHRFYALRAIVPKVSRMDKASLLSDAVSYIESLKSKIDDLETEIKKMKMTETDKLDNSSSNTSPSSVEYQVNQKPSKSNRGSDLEVQVKIVGEEAIIRVQTENVNHPTSALMSALMEMDCRVQHANASRLSQVMVQDVVVLVPEGLRSEDRLRTTLVRTLSL

SEQ ID NO: 385 - DNA, 2162 bp, Arabidopsis thaliana
  G584
aaaaagtcttctcttttataactacgtcagagaactgttatgtctccgacgaatgttcaagtaaccgattaccatctcaaccaatcaaaaacggatacaacaaatctctggtcaaccgacgacgatgcatcggtaatggaagctttcatcggcggcggctccgatcattcttctctttttcctccacttcctcctcctcctcttcctcaagtcaacgaagataatctccagcaacgtctccaagctttaatcgaaggagcaaacgagaactggacttacgccgtgttctggcaatcatctcacggtttcgccggagaagacaacaacaacaacaacacagtgttgttaggttggggagatggttattacaaaggagaagaagagaagtctagaaagaagaaatcaaatccagctagtgcagctgaacaagagcatcgtaagagagtgattagagagctcaactctttaatctccggtggtgtaggaggaggagatgaagctggagatgaagaagttacagatactgaatggttcttcttagtttcaatgacacagagctttgtcaagggtactggtttacctggtcaagctttctcaaattcagacacgatttggttatctggttctaatgctttagctggatcaagttgtgagagagctcgtcaaggtcagatttatgggttacaaacaatggtgtgtgtagcgacagagaatggtgtcgttgagcttggttcgtcggagattattcatcaaagttcagatcttgttgataaagttgacacctttttcaattttaacaatggtggtggtgaatttggttcttgggcgtttaatttgaatccagatcaaggagagaatgatccaggtttgtggattagtgaacctaatggtgttgactctggtcttgtagctgctccggtgatgaataatggtggaaatgactcaacttctaattctgattctcaaccaatttctaagctttgtaatggaagctctgttgaaaaccctaaccctaaagttctgaaatcttgtgaaatggtgaatttcaagaatgggattgagaatggtcaagaagaagatagtagtaataagaagagatcaccggtttcgaataatgaagaagggatgctttcttttacctctgttcttccatgtgactcgaatcactctgatcttgaagcttcagtggctaaagaagctgagagtaacagagttgtggttgaaccggagaagaaaccgaggaaacgagggagaaaaccggcgaatggaagagaagagcctttgaatcatgtagaggcagagagacagagaagagagaagttgaatcagagattctattctttaagagctgtggttcctaatgtgtctaagatggataaagcttctctattaggagatgctatttcgtatatcagtgagcttaagtctaagttgcaaaaggctgaatctgataaagaagagttgcagaagcagattgatgtgatgaataaagaagcgggaaatgcgaaaagttcggtaaaagatcgaaaatgtttgaatcaagaatcgagtgtgttgatagagatggaggttgatgtgaagattattggttgggatgcaatgataaggattcaatgtagtaagaggaatcatcctggtgctaagttcatggaagcacttaaggagttggatttggaagtgaatcatgcgagtttatcggtagtgaatgatcttatgatccaacaagcgactgtgaaaatggggaatcagtttttcacgcaagatcaactcaaggttgctctaacggagaaagttggagaatgtccatgaattgaagtcagcatctttagggctaatacaccggagaatactgcgaaaagtcgaaaacaacgatcatagtataagccgcggtaaaaagtgttaaacctttcacacaagtttctctagtgaatgtagttgtaaactctattgtgtaagggtaattttgtagtacccacttgttgctattgaatgcttgttagagaggattcttagtgtagtatatgattaggttggggtttgttgtttcatgagataaataaatgtgtttgatcaatggttaagtctttggtttgttggtgtatgtatgtaaataaggcttttgttagaaataagacaaatgggactgaagttggagtttaaaa

SEQ ID NO: 386 - protein, 589 aa, Arabidopsis thaliana
  G584
MSPTNVQVTDYHLNQSKTDTTNLWSTDDDASVMEAFIGGGSDHSSLFPPLPPPPLPQVNEDNLQQRLQALIEGANENWTYAVFWQSSHGFAGEDNNNNNTVLLGWGDGYYKGEEEKSRKKKSNPASAAEQEHRKRVIRELNSLISGGVGGGDEAGDEEVTDTEWFFLVSMTQSFVKGTGLPGQAFSNSDTIWLSGSNALAGSSCERARQGQIYGLQTMVCVATENGVVELGSSEIIHQSSDLVDKVDTFFNFNNGGGEFGSWAFNLNPDQGENDPGLWISEPNGVDSGLVAAPVMNNGGNDSTSNSDSQPISKLCNGSSVENPNPKVLKSCEMVNFKNGIENGQEEDSSNKKRSPVSNNEEGMLSFTSVLPCDSNHSDLEASVAKEAESNRVVVEPEKKPRKRGRKPANGREEPLNHVEAERQRREKLNQRFYSLRAVVPNVSKMDKASLLGDAISYISELKSKLQKAESDKEELQKQIDVMNKEAGNAKSSVKDRKCLNQESSVLIEMEVDVKIIGWDAMIRIQCSKRNHPGAKFMEALKELDLEVNHASLSVVNDLMIQQATVKMGNQFFTQDQLKVALTEKVGECP

SEQ ID NO: 387 - DNA, 1292 bp, Arabidopsis thaliana
  G590
tcgacagacactctccctctctccatgcccataaaatctcaaagactgtttaaaaaaaaaaatgttttagctttaactgctttttttttgttgttggtgtaatgatatcacagagagaagaaagagaagagaagaagcagagagtgatgggagataagaaattgatttcatcttcttcttcttcctcggtttacgatactcgtatcaatcatcatcttcatcatcctccgtcttcttccgacgaaatctctcagtttctccggcatattttcgaccgttcttctcctttaccttcttactactccccggcgacgactacaacgacggcgtctttgattggtgtgcacgggagcggtgacccacatgcagataactcgagaagtctcgtttctcatcatccaccgtcagattctgtgcttatgtcgaaacgtgtcggagatttctctgaggttttaatcggcggaggatcaggctcagccgccgcgtgttttggtttctccggtggtggtaataataacaacgttcaaggaaatagctctgggactcgagtatcgtcttcttccgttggagctagtggcaacgagacagatgagtatgactgtgaaagcgaggaaggaggagaagctgtagttgatgaagctccctcttccaagtcaggtccttcttctcgtagttcatctaaaagatgcagagctgctgaagttcataatctctctgagaagaggaggagaagtagaattaatgaaaaaatgaaagctttacaaagtctcatccctaattcaaataagacggataaggcttcaatgcttgatgaagccattgagtatctgaaacagcttcagctccaagttcagatgttgactatgagaaatggaataaacttgcatcctttgtgtttacctggaactacattacacccattgcaactctctcagattcgaccccctgaagcaaccaatgatcctctgcttaatcataccaatcagtttgcttcgacttctaatgcaccggaaatgatcaatactgtggcttcttcatacgctttggaaccttctattcgcagtcactttggacctttccctctccttacttcacccgtggagatgagtcgggaaggtgggttaactcatccaaggttgaacattggtcattccaacgcaaacataaccggggaacaagctctgtttgatggacaacctgacctaaaagatcgaattacttgaacagtgtcccaacttcgggatctctatgtgttcttgtttcttagaacgcaagccataaagctgtctgac

SEQ ID NO: 388 - protein, 373 aa, Arabidopsis thaliana
  G590
MISQREEREEKKQRVMGDKKLISSSSSSSVYDTRINHHLHHPPSSSDEISQFLRHIFDRSSPLPSYYSPATTTTTASLIGVHGSGDPHADNSRSLVSHHPPSDSVLMSKRVGDFSEVLIGGGSGSAAACFGFSGGGNNNNVQGNSSGTRVSSSSVGASGNETDEYDCESEEGGEAVVDEAPSSKSGPSSRSSSKRCRAAEVHNLSEKRRRSRINEKMKALQSLIPNSNKTDKASMLDEAIEYLKQLQLQVQMLTMRNGINLHPLCLPGTTLHPLQLSQIRPPEATNDPLLNHTNQFASTSNAPEMINTVASSYALEPSIRSHFGPFPLLTSPVEMSREGGLTHPRLNIGHSNANITGEQALFDGQPDLKDRIT

SEQ ID NO: 389 - DNA, 1240 bp, Arabidopsis thaliana
  G591
gtaaatctctctttgaaggttcctaactcgttaatcgtaactcacagtgactcgttcgagtcaaagtctctgtctttagctcaaaccatggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgaaccgacttggtggagccggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtaggatttctgcaataaagagtttgtacagctaatccaactgtccaacatgggtttttcttctgctctaatgactctggtttcttctctcctctctcaccgacttgaaaggtaaaaaagtgaaaaaggctttgtagatggaatcaatgtaggatttgcagtagagggcaaaaaaatgtcatatagctcaattgatcaagtcttaaaaaaaaaaaaaaaaaaaa

SEQ ID NO: 390 - protein, 310 aa, Arabidopsis thaliana
  G591
MASNNPHDNLSDQTPSDDFFEQILGLPNFSASSAAGLSGVDGGLGGGAPPMMLQLGSGEEGSHMGGLGGSGPTGFHNQMFPLGLSLDQGKGPGFLRPEGGHGSGKRFSDDVVDNRCSSMKPVFHGQPMQQPPPSAPHQPTSIRPRVRARRGQATDPHSIAERLRRERIAERIRALQELVPTVNKTDRAAMIDEIVDYVKFLRLQVKVLSMNRLGGAGAVAPLVTDMPLSSSVEDETGEGGRTPQPAWEKWSNDGTERQVAKLMEENVGAAMQLLQSKALCMMPISLAMAIYHSQPPDTSSVVKPENNPPQ

SEQ ID NO: 391 - DNA, 1413 bp, Arabidopsis thaliana
  G592
aagctattaagatttggttttctacaaatttgttcttcctgaaacgtcacgagacagagcttacaagaagagaaaacagaggaaatttcgttgcattttttttacatattgattcgattaatggattcaaataatcatctctacgacccgaatcccaccgggtcgggtcttcttcgttttagatcagctccgagctctgttctcgccgcttttgttgacgacgacaagattggtttcgactccgataggttgctttcaagattcgtgacctctaatggcgttaacggagatctgggttcacctaaattcgaggataagtctccggtttcgttaacgaacacctctgtttcatacgccgccactctgccgccaccgccgcagcttgagccgtcgagttttctgggtttgccgccgcattacccgaggcagagtaaagggataatgaactcggttggtttggatcagtttctcggtatcaataatcatcacaccaaaccagttgaatctaatcttctccgtcaaagcagctctccagccggaatgtttactaatctctctgaccaaaacggttatggttcaatgaggaatttgatgaattacgaagaagatgaagagagtccatctaattccaatggattaagacgccattgcagtctctcttcaaggccaccttcttcacttggaatgctttctcaaatacctgaaatcgcacccgaaactaattttccatatagccattggaatgatccatccagctttattgataacttatcctcacttaaaagagaagccgaggacgatggaaaattgtttctcggagctcagaacggagagtccgggaatcgtatgcagttactgtcgcatcatttgagcctaccaaagtcatcatcgacagcctcggacatggtttcagtggataagtatcttcagctacaagattctgttccttgtaaaatcagagccaaacgtggttgcgctacacatcctcgaagcatcgctgaacgggtaagaagaacgcggataagcgagcgaatgaggaagttacaagagcttgttcctaacatggacaagcaaaccaacacttcggatatgttggatttagctgtggattacatcaaagatttacaaagacagtataagattttaaacgacaacagagctaactgtaagtgtatgaacaaggagaagaagtcaatatagggcgcaacaaagtgtgtagtagataggactaaaaagcagggagaaggacaagaaagaaacaatgtcatgtctgaatattttttagccgaaacagaccaaattgtctatgtaagctctcgagaaaagcatctgcttccaacaaaattctaagtaataaaatagtactcgatttgttcttatttcattattacaatgcagaatctactaatcaaa

SEQ ID NO: 392 - protein, 359 aa, Arabidopsis thaliana
  G592
MDSNNHLYDPNPTGSGLLRFRSAPSSVLAAFVDDDKIGFDSDRLLSRFVTSNGVNGDLGSPKFEDKSPVSLTNTSVSYAATLPPPPQLEPSSFLGLPPHYPRQSKGIMNSVGLDQFLGINNHHTKPVESNLLRQSSSPAGMFTNLSDQNGYGSMRNLMNYEEDEESPSNSNGLRRHCSLSSRPPSSLGMLSQIPEIAPETNFPYSHWNDPSSFIDNLSSLKREAEDDGKLFLGAQNGESGNRMQLLSHHLSLPKSSSTASDMVSVDKYLQLQDSVPCKIRAKRGCATHPRSIAERVRRTRISERMRKLQELVPNMDKQTNTSDMLDLAVDYIKDLQRQYKILNDNRANCKCMNKEKKSI

SEQ ID NO: 393 - DNA, 1226 bp, Arabidopsis thaliana
  G598
gtccgttgtcatattttaaatttatcaccttcttgagaattccacatttttatcctttttgtcatgtagtgtatattttttcctctaacctaattaaaatcaaaacaaaatcctttgacccaattagcttcgcgatatatcagaagagatcaaactactttgatcagaccatgatcttcttcttcttcttcttcttcttcttcttctttttagacgatcacaattcctaaaccctatttctcagattatgctgactctttaccatcaagaaaggtcaccggacgccacaagtaatgatcgcgatgagacgccagagactgtggttagagaagtccacgcgctaactccagcgccggaggataattcccggacgatgacggcgacgctacctccaccgcctgctttccgaggctatttttctcctccaaggtcagcgacgacgatgagcgaaggagagaacttcacaactataagcagagagttcaacgctctagtcatcgccggatcctccatggagaacaacgaactaatgactcgtgacgtcacgcagcgtgaagatgagagacaagacgagttgatgagaatccacgaggacacggatcatgaagaggaaacgaatcctttagcaatcgtgccggatcagtatcctggttcgggtttggatcctggaagtgataatgggccgggtcagagtcgggttgggtcgacggtgcaaagagttaagagggaagaggtggaagcgaagataacggcgtggcagacggcaaaactggctaagattaataacaggtttaagagggaagacgccgttattaacggttggtttaatgaacaagttaacaaggccaactcttggatgaagaaaattgagtataatgtaggttcattcaacaatcgtctaaatgaggaagctagaggagagaaaagcaaaagcgatggagaaaacgcaaaacaatgtggcgaaagcgcagaggaaagcggaggagagaagagcgacggcagaggcaaagagagggacagaggttgcaaaagtagttgaagttgctaatctcatgagagcccttggacgtcctcctgccaaacgctccttcttctctttctcctaatttttagttatatcaaaccattaaattaaacagtactcgttatatatctagttagtaaacaaaggggcagttttatagctcatgtacacataattgagagtgtagtactgttgtgtcaaa

SEQ ID NO: 394 - protein, 263 aa, Arabidopsis thaliana
  G598
MLTLYHQERSPDATSNDRDETPETVVREVHALTPAPEDNSRTMTATLPPPPAFRGYFSPPRSATTMSEGENFTTISREFNALVIAGSSMENNELMTRDVTQREDERQDELMRIHEDTDHEEETNPLAIVPDQYPGSGLDPGSDNGPGQSRVGSTVQRVKREEVEAKITAWQTAKLAKINNRFKREDAVINGWFNEQVNKANSWMKKIEYNVGSFNNRLNEEARGEKSKSDGENAKQCGESAEESGGEKSDGRGKERDRGCKSS

SEQ ID NO: 395 - DNA, 1263 bp, Arabidopsis thaliana
  G605
aattccatcctaataattttcaaagctttaattctaagaaataatatctacaagaaaatattatctcatgtatggagactaccggagaagttgttaaaacaaccaccgggagcgacggaggcgttacggtggtgagatccaacgcgccgtcagacttccacatggctccgaggtcagaaacttcaaacacacctcccaactccgtcgctcctcctcctcctccaccgccgcaaaactcctttactccgtcggcggctatggatggtttctcaagcggaccgataaagaagagacgtgggcgccctaggaagtacggacacgacggagcagcggtgacgctatctccgaatccgatatcatcagccgcaccaacgacttctcacgtcatcgatttctcgacgacatcggagaaacgtggcaaaatgaaaccagcaactccaactccaagctcattcatcaggccaaagtaccaggtcgagaatttaggtgaatggtctccttcctctgccgccgctaatttcacgccgcatattattacggtgaatgcaggcgaggacgttacgaagaggataatatcattttctcaacaagggtctctagctatttgcgttttatgcgcaaacggtgtcgtttcgagcgttacacttcgtcagcctgattcatctggtggtacattgacctatgagggtcggtttgagatattgtcactatctggaacattcatgcctagtgactcagacgggacacgaagcagaacaggcgggatgagcgtgtcgcttgctagccctgatggacgtgtagtaggtggtggtgttgctggcttgctggttgcagccactcctattcaagtggttgtaggaactttcttaggtggaacaaaccagcaagaacagacaccgaagccgcataaccacaacttcatgtcttctccattaatgccaacttcttcgaatgtagctgatcatcgaaccatccgtcccatgacatctagtctcccgatcagtacatggacaccgtcttttccttctgattcacgacacaagcattctcatgactttaatatcactttgacgtgatttcttccttgaagaactcgtagatcctctgtattttggtttccagtttagggctctacatgttagactctcaaagtctaggtgttatgttggtctgtcacttaggattgtcacttaggattgttagaccatctccatcaatggtttctcattgagaaactgttcaatataaaaataaaatataatc

SEQ ID NO: 396 - protein, 334 aa, Arabidopsis thaliana
  G605
METTGEVVKTTTGSDGGVTVVRSNAPSDFHMAPRSETSNTPPNSVAPPPPPPPQNSFTPSAAMDGFSSGPIKKRRGRPRKYGHDGAAVTLSPNPISSAAPTTSHVIDFSTTSEKRGKMKPATPTPSSFIRPKYQVENLGEWSPSSAAANFTPHIITVNAGEDVTKRIISFSQQGSLAICVLCANGVVSSVTLRQPDSSGGTLTYEGRFEILSLSGTFMPSDSDGTRSRTGGMSVSLASPDGRVVGGGVAGLLVAATPIQVVVGTFLGGTNQQEQTPKPHNHNFMSSPLMPTSSNVADHRTIRPMTSSLPISTWTPSFPSDSRHKHSHDFNITLT

SEQ ID NO: 397 - DNA, 2311 bp, Arabidopsis thaliana
  G610
tcttaatcagagattcgtgagaggtaaaggtagcgtaattattcagtttgcgtgatctataatttaactggcgccagattgtgatccaggaatcgttggcttgttaggttgttgttttgttatgcataattgagagatggtggtcaaaaggaagttaaattgtggtggctctgatggttttgatttccccaatattcccaaggctcctcgttcaagcaggaggaaggtctcaggtaagagatctgatgatgaaagtgagatctgtgcaattgatttgctagcttctcttgctggaaagttgttggaagaaagtgaaagttcctcaacgtctacctatgcatctgaagctgataatcttgatcatttgggtggactgattaagcaagaacttgaagatggctatactactaagccttgtaaatccgagtttttcgatccaggaaaccctgcttcaaagtccactagtgaaaatactagcgtgacttgtttgccattttcgtctttcgaaaatgattgcattttggagcaaacaccggtttctgattgtaagagggcatctggtttgaagtccctggtagggagcatcactgaggagacatgtgttgttaatgaggatgccggatctgaacaaggtgctaatactttcagcttaaaggatccaagtcaattacattcgcagtctccagaatcggtccttctggatggcgatgtgaaattagcaccatgcacggatcaagtccctaatgattcttttaaaggatataggaatcattctaagttagtttgcagagatgatgacgaaaactattgtaagtattataaatttagtgacaaatgtaagtcatataggcctctctcccgggttggcaatagaagaataatgcagtcggtgagagcaatctccaagttgaagtgttttgaagacactagaacagatggtcgtttgaaggctctctaccgcaagagaaaattatgttatggttacaacccatggaagcgtgagaccattcataggaagagaagattgtctgacaaaggtttggtcgtaaattatgatggtgggctcagtagtgaaagtgtttccaattcacctgaaaagggagaatcagaaaatggtgatttctctgctgcaaaaataggtcttctttcgaaagactcccgtgtaaagttcagcatcaagtcccttaggattccggagcttgtaattgaagttccagaaacagcaacagtaggcttactgaagaggacggtgaaggaggcggttactgctttactcggtggtggaatacgtattggggtgttagtccaagggaaaaaagttagagatgacaacaacactctatcacagactggtctttcgtgtagagaaaatcttggcaaccttggcttcaccttagagcctggtttggaaacactgcctgtacctctttgttctgaaactcctgtcctttctctgccaactgactctacaaagttgtcagaaaggtccgcagcttctccagcgttagagactggaattcctctccctccccaagatgaagattacttgattaatttgggaaatagtgtggagaacaatgatgaattagtcccacatctgagtgacataccagctgatgaacaaccttcatcagattcaagagcgctggttccagttttggccttggagtccgacgctcttgcacttgttccagttaacgagaaacctaagcgtacagagctttcacaacgcagaaccaggagaccattctctgttacagaggtagaagctctagtaagcgcagttgaagaagttgggactggaagatggcgtgatgtgaagttgcgttcttttgagaatgcaagtcatcgaacctatgtggacttgaaggacaaatggaaaacgttggttcacacagcaagtatatcaccacagcaacgaagaggagaaccagtgcctcaagaactgctagacagagtcttaggagcacataggtactggacacagcaccaaatgaaacagaacgggaaacatcaggtggctacaacaatggtggttgaagcaggttcgtccatgtaaagaaggagaatggtaataacaataactttcacttgacgactaaggaaccaaagtgggcaactgtacaaagggaaacaacaaaatacagaaacatacttaatttctgaaaagaagagtctatatttttattttttttaaatcatagccggtagaaacaagacgttccttgacacttttggttacttttatggtaggtctgttcattccaaatttctaattgatttgattatgtaatttggtggtaggaccatg

SEQ ID NO: 398 - protein, 640 aa, Arabidopsis thaliana
  G610
MVVKRKLNCGGSDGFDFPNIPKAPRSSRRKVSGKRSDDESEICAIDLLASLAGKLLEESESSSTSTYASEADNLDHLGGLIKQELEDGYTTKPCKSEFFDPGNPASKSTSENTSVTCLPFSSFENDCILEQTPVSDCKRASGLKSLVGSITEETCVVNEDAGSEQGANTFSLKDPSQLHSQSPESVLLDGDVKLAPCTDQVPNDSFKGYRNHSKLVCRDDDENYCKYYKFSDKCKSYRPLSRVGNRRIMQSVRAISKLKCFEDTRTDGRLKALYRKRKLCYGYNPWKRETIHRKRRLSDKGLVVNYDGGLSSESVSNSPEKGESENGDFSAAKIGLLSKDSRVKFSIKSLRIPELVIEVPETATVGLLKRTVKEAVTALLGGGIRIGVLVQGKKVRDDNNTLSQTGLSCRENLGNLGFTLEPGLETLPVPLCSETPVLSLPTDSTKLSERSAASPALETGIPLPPQDEDYLINLGNSVENNDELVPHLSDIPADEQPSSDSRALVPVLALESDALALVPVNEKPKRTELSQRRTRRPFSVTEVEALVSAVEEVGTGRWRDVKLRSFENASHRTYVDLKDKWKTLVHTASISPQQRRGEPVPQELLDRVLGAHRYWTQHQMKQNGKHQVATTMVVEAGSSM

SEQ ID NO: 399 - DNA, 1519 bp, Arabidopsis thaliana
  G615
ttttttcttttctttctttttttgctggtgtgagaaattgtacgcttactatctctctctctctctgccagattctctctttttgatgatgtgaaagttgtgcttttgtttcttaagaaaaaggcatatttttaatacttgattcttggttcttgattcttgattcttggttttttttagcttcttaagttcggtgatgtcgtcttccaccaatgactacaacgatggtaataacaatggagtgtaccctctctctctttacctttcttcactctctggccatcaagacatcattcataatccctacaaccatcagttaaaagcatctccgggccatatggtatcagcagttcctgaatctctgatcgattacatggcgtttaagtcaaataatgttgtgaatcaacaaggctttgagtttcctgaggtgtcaaaggaaatcaagaaggtggtgaagaaggaccgacatagcaagattcaaacggcacaagggattagagacaggagggttaggctttttattgggattgctcgccaattctttgatcttcaggatatgttggggtttgataaagctagtaaaacgttagactggctgctcaagaagtcaagaaaagccatcaaagaggtcgtacaagcaaaaaacctcaacaatgatgatgaagattttggaaacattggaggcgatgtagaacaagaagaggagaaggaggaggatgacaatggcgataagagcttcgtgtatggtttgagccccgggtacggtgaagaagaagtggtatgtgaggccacgaaggcagggataagaaagaagaagagtgagttgagaaacatctcatcaaaggggctaggagccaaagctagaggaaaagcaaaggagcgaacaaaagagatgatggcctatgataatccagagactgcctctgatattacacaatctgaaatcatggacccattcaagaggtctatagtcttcaatgaaggagaagatatgacacaccttttctacaaggaaccaatcgaggagtttgataatcaagaatctatcttaaccaatatgactctaccaacgaagatgggtcaaagttacaatcaaaataatgggatacttatgttggtagatcagagttctagcagcaactataatacatttctgcctcaaaatttggattatagttatgatcaaaacccttttcatgaccaaaccttatatgtagtcaccgacaaaaatttccccaaaggtttcctataaatctcgacagttttgaaggactatgcatgatcaagtttaaacatgtaagccaatatagtcccttattcctctgaatgtatacaaaatctatagttatgtatatctgttcctttttaacgtatctttattgatcttctgtgccttgatcaaaattgtcattttaagattcagtttgtgtaatattttagctacaacttttaagtggtattattgtaaccttttgaactatatattttgaagatgaataagaacatgtttatataaaaa

SEQ ID NO: 400 - protein, 351 aa, Arabidopsis thaliana
  G615
MSSSTNDYNDGNNNGVYPLSLYLSSLSGHQDIIHNPYNHQLKASPGHMVSAVPESLIDYMAFKSNNVVNQQGFEFPEVSKEIKKVVKKDRHSKIQTAQGIRDRRVRLFIGIARQFFDLQDMLGFDKASKTLDWLLKKSRKAIKEVVQAKNLNNDDEDFGNIGGDVEQEEEKEEDDNGDKSFVYGLSPGYGEEEVVCEATKAGIRKKKSELRNISSKGLGAKARGKAKERTKEMMAYDNPETASDITQSEIMDPFKRSIVFNEGEDMTHLFYKEPIEEFDNQESILTNMTLPTKMGQSYNQNNGILMLVDQSSSSNYNTFLPQNLDYSYDQNPFHDQTLYVVTDKNFPKGFL

SEQ ID NO: 401 - DNA, 1431 bp, Arabidopsis thaliana
  G616
ctttaaatcccaaaccaaccctaaagttttgatttttaattttgggggtaaccaaaaaaaaaacaaaaccctaattttttttctttagtgatgagattattggtgatgatgaaatgattggagatctaatgaagaataacaacaatggcgacgttgtggataacgaagtgaacaaccggttaagccggtggcatcacaattcttcccggataattagggtttcacgagcttccggtggtaaagatcgacacagcaaagtcttgacttctaaaggaccacgtgaccgtcgtgtccggttatcagtctccaccgctcttcaattctatgatcttcaagatcggttaggttatgatcaacctagcaaagctgttgaatggttaatcaaagctgctgaagattcaatctctgagcttccttcactcaacaacactcattttccgaccgatgacgagaatcaccagaatcagacattaacaacagttgctgctaattccttgtctaaatctgcttgtagtagcaattcagacacgagcaagaactcttctggtttgtctttatcaagatcggagcttagagataaagctagagagagggctagagagagaacagctaaagagaccaaggaaagagatcataaccacacttcgtttacggatttgttaaattccggttcagatccggttaactcaaaccggcaatggatggcttcagctccttcttcatctccaatggagtatttcagttcgggtttaattctcgggtcgggtcaacaaacccatttccctatttcaacaaattctcatcctttctcatcaatctccgatcatcatcatcatcatcctcatcatcagcatcaagagttttcattcgttcccgaccatttgatatcaccggcagaatccaacggcggagcattcaatcttgattttaatatgtcaacaccctccggcgccggagctgccgtctccgccgcatcaggtggtggcttcagtggtttcaacagggggacccttcagtccaattcaacaaatcagcatcagtcattcctcgctaatctacagaggtttccaacatcagaaagtggaggaggtccacagttcttattcggtgcactgcctgcagagaatcaccaccacaatcaccagtttcagctttactatgaaaatggatgcagaaactcatcagaacataagggtaaaggcaagaactgatgatattaattattgcatctttggttttgttcaaatgctcattttgtatgtttatctttggtttatttcaaaacaaatgttaatctctttcgttgtctgatgtgtgttagggttttgttttatgtattgagggtctttggaaatctttttgcattgtgcttgtaatgttgtatttgtgataatagcattttgtttgtgagttaaaaaaaaaaaaaaaaaa

SEQ ID NO: 402 - protein, 360 aa, Arabidopsis thaliana
  G616
MKNNNNGDVVDNEVNNRLSRWHHNSSRIIRVSRASGGKDRHSKVLTSKGPRDRRVRLSVSTALQFYDLQDRLGYDQPSKAVEWLIKAAEDSISELPSLNNTHFPTDDENHQNQTLTTVAANSLSKSACSSNSDTSKNSSGLSLSRSELRDKARERARERTAKETKERDHNHTSFTDLLNSGSDPVNSNRQWMASAPSSSPMEYFSSGLILGSGQQTHFPISTNSHPFSSISDHHHHHPHHQHQEFSFVPDHLISPAESNGGAFNLDFNMSTPSGAGAAVSAASGGGFSGFNRGTLQSNSTNQHQSFLANLQRFPTSESGGGPQFLFGALPAENHHHNHQFQLYYENGCRNSSEHKGKGKN

SEQ ID NO: 403 - DNA, 2291 bp, Arabidopsis thaliana
  G624
ccactatttctcctttctcagctgctttcaccattttctctttttctcctccatcaatctttctcacggttttctagggttttatatatgctttcctcttcatccatgtcatcgtcttcgttatctgctagattttgcttcaaccacgaatgttttgagttcaaactcgaccattgccgtcctggttggcgtctccgttctggcgatttcgtcgacctctgtgatcgttgcgcctctgcgtatgaacaaggaaagttttgtgacgtatttcaccaaagggcttctggatggaggtgttgtgagtcatgtggaaagcgaattcattgtggatgtattgcgtctgcttctgcttatacgttaatggatgctggaggaattgagtgtttggcttgcgcaagaaaaaagtttgctttgggacccaatttttcgccatcaccgtcctttcttttccagtctccaatttctgagaaattcaaggacttgtcgatcaactggagttcttcaactagatcaaatcagataagctaccagcctcctagttgtttagatccttcagttctgcagtttgattttcgtaatcgtggaggtaataatgaatttagtcaacctgcttctaaagaaagggtcactgcatgtaccatggagaaaaaaaggggaatgaatgacatgatagggaaattaatgagtgaaaactcgaaacattatagagtatctccttttccaaatgtcaatgtatatcacccactgatctcactaaaggagggtccatgtgggacacagcttgcgtttcctgtgccaattacaacaccaattgagaaaactggtcactctagactagatggaagtaatttatggcacacacgtaattcttctccgctaagtcgcttacacaatgacttgaatggtggagcagactcgccattcgaaagcaaaagtcgtaatgtgatggctcatcttgagacgccaggaaaatatcaggtggttccacgattttggcccaaggtttcatataaaaaccaagttctgcagaatcaatcaaaagaatctgaatccgttgtcactcctctctttgagaagatcctgagtgcaactgatactggaaagcggctggtcctgccaaagaaatatgcagaggctttcttgccccaactttcccacaccaaaggtgtgcctctcacagtacaggacccaatgggtaaagagtggagatttcagtttcgcttttggcccagcagcaaaggcagaatatatgttctagagggagtaactccattcatacagaccttgcagttgcaggctggtgatacagtcatattcagtcgattagatccagaaaggaagttaattttgggattcagaaaggcttcgattactcaatcgtctgatcagcaggctgatccggctgatatgcattcaccgtttgaagttaagaagtctgcttatataactaaagaaaccccaggagtagaatgttcctctggtaagaagaaaagcagcatgatgattacaagaagtaaacgtcaaaaagttgaaaagggagacgacaacttgctgaagctaacatgggaagaagctcaaggatttctcctgcctcctcccaacctcactccatctagagttgtgatagaggattacgagtttgaggagtatgaggaggctccaatcatcgggaagcctactgatgttgcaggtttcagatcaacgtgcactgaagttgaaggactgttgatatcaccaacaaccacaaagcacccacgacatagagatggctgtacttgcatcatttgcatacaatccccaagtgggataggtcctaaacacgaccgatgctgttcttgtgcagtctgcgacactaacaaacgccgtaggcgttccctgttgctacggagggaaaagaagcagatggagaaagaagacaatgcgcgcaagttgctcgagcaactgaattctgataatggacttcaccaatctgctaacaacagtgagaatcatgagcgtcatgcttcgcctttgaaagttcaattagatttgaacttcaaaccagaaaaggacgaagaatctctccctggttctaacaaaactaccaagagcgagactctgcctcatgatgacacagtaaagtctagcttcacgtcaccaagctcatcaagtgctcatagccaaaataacaaggaagatgaaggaaaactcaagacaaccacagaaattgcagacaccaccaccacaagctccatgtagattttgcagactcttatagctgcaaggtgaatagattatgatgggaaacacca

SEQ ID NO: 404 - protein, 716 aa, Arabidopsis thaliana
  G624
MLSSSSMSSSSLSARFCFNHECFEFKLDHCRPGWRLRSGDFVDLCDRCASAYEQGKFCDVFHQRASGWRCCESCGKRIHCGCIASASAYTLMDAGGIECLACARKKFALGPNFSPSPSFLFQSPISEKFKDLSINWSSSTRSNQISYQPPSCLDPSVLQFDFRNRGGNNEFSQPASKERVTACTMEKKRGMNDMIGKLMSENSKHYRVSPFPNVNVYHPLISLKEGPCGTQLAFPVPITTPIEKTGHSRLDGSNLWHTRNSSPLSRLHNDLNGGADSPFESKSRNVMAHLETPGKYQVVPRFWPKVSYKNQVLQNQSKESESVVTPLFEKILSATDTGKRLVLPKKYAEAFLPQLSHTKGVPLTVQDPMGKEWRFQFRFWPSSKGRIYVLEGVTPFIQTLQLQAGDTVIFSRLDPERKLILGFRKASITQSSDQQADPADMHSPFEVKKSAYITKETPGVECSSGKKKSSMMITRSKRQKVEKGDDNLLKLTWEEAQGFLLPPPNLTPSRVVIEDYEFEEYEEAPIIGKPTDVAGFRSTCTEVEGLLISPTTTKHPRHRDGCTCIICIQSPSGIGPKHDRCCSCAVCDTNKRRRRSLLLRREKKQMEKEDNARKLLEQLNSDNGLHQSANNSENHERHASPLKVQLDLNFKPEKDEESLPGSNKTTKSETLPHDDTVKSSFTSPSSSSAHSQNNKEDEGKLKTTTEIADTTTTSSM

SEQ ID NO: 405 - DNA, 699 bp, Arabidopsis thaliana
  G627
atggtgaggggcaaaacggagatgaagaggatagagaacgcaacaagcaggcaagtgacgttttcgaagagaagaaatggactcttgaagaaagccttcgaattatcggtcctttgtgatgctgaagttgctttggttatcttctctccaagatccaaactctatgagttctctagctctagtatagcagcaacaattgaacgctatcagagacgaataaaagaaattgggaataatcataagagaaatgataattctcagcaagcgagagacgaaacatctggattgacaaaaaagattgaacagctagagatatctaaacgaaaattgcttggagaaggcattgatgcatgttccatcgaggagctgcaacagttagagaatcagttggaccgaagcttgagcaggataagagccaagaagtaccaattactccgtgaagaaattgagaagttgaaggcagaggagaggaatctcgttaaggaaaataaagatctgaaggagaagtggcttggaatgggaacagcaacaatagcatcatcacaatcaacgttatcatcatcagaagtgaacatagatgacaatatggaagtggagactggtttgttcattggacctcctgagacaagacaatccaaaaaattccctcctcaaaattaatcttacaacttcttcaaaaagaatgttttaactatatga

SEQ ID NO: 406 - protein, 219 aa, Arabidopsis thaliana
  G627
MVRGKTEMKRIENATSRQVTFSKRRNGLLKKAFELSVLCDAEVALVIFSPRSKLYEFSSSSIAATIERYQRRIKEIGNNHKRNDNSQQARDETSGLTKKIEQLEISKRKLLGEGIDACSIEELQQLENQLDRSLSRIRAKKYQLLREEIEKLKAEERNLVKENKDLKEKWLGMGTATIASSQSTLSSSEVNIDDNMEVETGLFIGPPETRQSKKFPPQN

SEQ ID NO: 407 - DNA, 1557 bp, Arabidopsis thaliana
  G629
cgaaatgaaaaaattctctgtattaccagaaacgtgtttcataagcatctttaactcttcagctctcaaattcttcatgaatatctctgcttatcggatcaagtgagagcaaatgcaatttttaagagccagctattggatctataactgaagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaagataaattatgattcttctcataaccagatcgaagcagaacaaccttctagtaatgataatcaagatgatgatggcaggattcatgataagatgaaacggcgtttagcgcagaaccgagaagcggctcgcaaaagtcgtttgagaaagaaggcttatgttcagcagttagaggaaagccggttaaagttatcgcagttagagcaagaactcgaaaaggttaagcagcagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccgaatgaaatccgatgcagcaaaagccgatgttttctacttgatatcgggaatgtggcgaacttcaaccgaaagattcttccaatggattggagggtttcgtccatccgaacttttaaacgttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttgattagaactttatggtttttgctttatgaagtatctctccagagaagattgtaaatttgggttgaaactttgtaatatattaagatccaccaaataagtttgaaatctgagcaatttgataataaaaaaaaaaaaaaaaaaaaaaaaaa

SEQ ID NO: 408 - protein, 368 aa, Arabidopsis thaliana
  G629
MMSSSSPTQLASLRDMGIYEPFQQIVGWGNVFKSDINDHSPNTATSSIIQVDPRIDDHNNNIKINYDSSHNQIEAEQPSSNDNQDDDGRIHDKMKRRLAQNREAARKSRLRKKAYVQQLEESRLKLSQLEQELEKVKQQGHLGPSGSINTGIASFEMEYSHWLQEQSRRVSELRTALQSHISDIELKMLVESCLNHYANLFRMKSDAAKADVFYLISGMWRTSTERFFQWIGGFRPSELLNVVMPYLQPLTDQQILEVRNLQQSSQQAEDALSQGIDKLQQSLAESIVIDAVIESTHYPTHMAAAIENLQALEGFVNQADHLRQQTLQQMAKILTTRQSARGLLALGEYLHRLRALSSLWAARPQEPT

SEQ ID NO: 409 - DNA, 759 bp, Arabidopsis thaliana
  G630
gagagaaattgaccatgcagccaaattatgatagctcaagtcttaacaacatgcaacaacaagactacttcaacttgaacaactactacaacaacttaaacccttcaaccaataacaacaacctcaatatcctccaataccctcaaattcaagaactcaacctacaatctccggtaagcaacaactccacaacttccgatgacgcaactgaagaaatcttcgtcatcaacgagaggaagcaaagacgtatggtatctaacagagagtcagcaagaagatcaagaatgagaaagcaaagacacttagatgagcttctctcacaggttgcttggcttcgaagcgagaaccaccagcttttagataagcttaaccaagtctccgacaacaatgatcttgttattcaagagaactcgagtcttaaagaagaaaacttggagcttcgtcaggttatcacatccatgaagaagcttggaggaggcatacatgacaaatattcttctccgtcgtctatggatgaattggatcaagacttttcttctatcacagatgatccaagaactcatcatccatcatgagttgttctgatcgagaaaaacattacttcaagtttctgcctctaatcttatctattttctttctttggtatcactttttaaaccgtttaactacgtaccaaagtttgggttttatttgtttttctgttgttttgtcagaagataattaaatgatggatatttgaaaaaaaaaaaaaaaaaaaaa

SEQ ID NO: 410 - protein, 186 aa, Arabidopsis thaliana
  G630
MQPNYDSSSLNNMQQQDYFNLNNYYNNLNPSTNNNNLNILQYPQIQELNLQSPVSNNSTTSDDATEEIFVINERKQRRMVSNRESARRSRMRKQRHLDELLSQVAWLRSENHQLLDKLNQVSDNNDLVIQENSSLKEENLELRQVITSMKKLGGGIHDKYSSPSSMDELDQDFSSITDDPRTHHPS

SEQ ID NO: 411 - DNA, 1661 bp, Arabidopsis thaliana
  G631
cttcttcttcttcttcttcttcttcttcctcctctctcgtcggatctctctgatttagtgatttttcaaatttcaagttttcttcacctttaattttgtgtctcgttgatctctctttggacattctgctttggattctggaggcttctcattagatctctattagtgggtttaggtcaagttcttgaaatggataaggagaaatctcctgcaccaccacctagtggaggtcttcctccaccatcgggtcgttactctgcgttttcacctaatggaagtagctttgcaatgaaagctgaatcatcttttcctcctttgactccaagtggaagcaatagctcagatgctaaccgattcagccatgatattagccgaatgccggataatccacctaagaacctaggccatcgccgagctcattcagagattcttactcttcctgatgacttaagctttgatagtgatcttggtgtggttggtgctgctgatggaccttctttctctgatgatactgacgaggacttactctatatgtatcttgatatggaaaaattcaattcttctgctacatcgacttctcaaatgggtgagccatcagaaccgacttggaggaatgaattagcctcgacttctaaccttcagagtacacccggtagctctagtgaaagaccgagaattagacaccaacacagccaatcgatggatggttcaacaactatcaagcctgagatgcttatgtcagggaatgaagatgtgtctggagttgactctaagaaagccatctctgctgctaaactttctgagcttgctctcattgatccaaaacgcgccaagaggatatgggcaaacaggcagtctgctgcgaggtcaaaagaaaggaagatgagatacattgcagagctcgagagaaaagtacagactttacaaacagaggccacatctctctcagcccagttgactctcttacagagagatacaaatggcctgggtgttgaaaacaatgagcttaaactgcgagtacaaactatggagcaacaggtccacctacaggatgctttaaatgatgcactaaaggaggaagtccagcatcttaaggtattgacggggcaaggtccatcaaatggtacatcaatgaactacggttcttttggatcaaaccagcaattctatcccaataatcagtcgatgcacactatcttagccgcacaacagttacagcagctccagatccagtcacagaaacagcaacaacaacaacagcaacaccagcaacaacaacagcagcagcagcagcaatttcactttcaacagcagcaactgtaccagcttcagcagcagcaacggcttcaacaacaggaacaacaaagcggggcttcagagctaagaagacccatgccttctcctggtcagaaagagagtgtgacatcgcctgatcgtgaaactcccttgacaaaagactgagtctagactgtgctaatgtccaatttagtaagttactcttggaaaatcttctttttcatcgcaggctcatggatttgggatttactgcattatagagttaaaaacaagacagcttagaagttgcggatttagaagttgttagtgaagcttttgttctcgtctgttggtagtttacaatcttctctttgtatgatcctaag

SEQ ID NO: 412 - protein, 423 aa, Arabidopsis thaliana
  G631
MDKEKSPAPPPSGGLPPPSGRYSAFSPNGSSFAMKAESSFPPLTPSGSNSSDANRFSHDISRMPDNPPKNLGHRRAHSEILTLPDDLSFDSDLGVVGAADGPSFSDDTDEDLLYMYLDMEKFNSSATSTSQMGEPSEPTWRNELASTSNLQSTPGSSSERPRIRHQHSQSMDGSTTIKPEMLMSGNEDVSGVDSKKAISAAKLSELALIDPKRAKRIWANRQSAARSKERKMRYIAELERKVQTLQTEATSLSAQLTLLQRDTNGLGVENNELKLRVQTMEQQVHLQDALNDALKEEVQHLKVLTGQGPSNGTSMNYGSFGSNQQFYPNNQSMHTILAAQQLQQLQIQSQKQQQQQQQHQQQQQQQQQQFHFQQQQLYQLQQQQRLQQQEQQSGASELRRPMPSPGQKESVTSPDRETPLTKD

SEQ ID NO: 413 - DNA, 1553 bp, Arabidopsis thaliana
  G632
ctttttttcattttgttctgagggggcttttgtgttgacggtggtgggaacaaaggaacatcgtatccattctgtccgggaaacacagcaatgttcatttccgacaaatctcgtcctactgatttctacaaagacgatcatcacaattcctccaccaccagcaccacacgcgatatgatgatcgatgtactcaccactaccaacgaatcagtagatctacaatctcaccaccaccacaatcaccacaatcatcatctccaccaatctcagccacaacaacagattctcctcggagaaagcagtggagaagatcacgaagttaaagcaccaaagaaacgagcggagacatgggttcaagacgaaactcgtagcttaatcatgttccgtagaggtatggatggtttattcaatacatccaaatctaataaacatctctgggaacagatttcgtctaagatgagagaaaaagggtttgatcgatctccgactatgtgtactgataaatggaggaatctgttgaaagagtttaagaaagctaagcatcatgatagaggaaatggatcggcgaagatgtcgtattacaaagagattgaagatattcttagagagaggagcaaaaaagtgacaccaccacagtataataagagccctaatacaccacctacatcagccaaagttgattcctttatgcaatttactgataaaggttttgatgatacgagcatttcttttggatccgttgaagctaatggcaggccagccttaaaccttgaaaggcgtcttgatcatgatggtcatcctcttgcaatcactacagcagttgatgctgttgcagcaaatggagttactccttggaattggagagagactcctggaaacggtgatgatagtcatggtcagccttttggtggtagggtcataacagtgaaatttggtgactatacaagaagaatcggtgttgatggtagtgcagaagcaatcaaagaggtaatcagatctgcttttgggttaagaactcgaagggctttttggttagaagatgaagatcagattattcgctgtcttgaccgagacatgcccttagggaactatctactccgtctggatgatggactggccattagggtttgccattatgatgaatccaaccaattaccagtccattcagaagagaaaatcttctacactgaagaagactaccgcgagtttctggctctacagggatggtcaagcctgcaagttgatggttttaggaacatagaaaacatggatgatcttcaacctggtgctgtgtatcgaggtgtgagatgaggaaatgagatcacaaaacttcttctccaattctatcaacagttatctgaacagaaaacagtcccctgtagatatgatctcattctctttatacatttcttctttttttcatgtacttgctcaaatatgaaatatcataactggcatttaccgtacagaccaagaagacctcaaaatagatttttggtctgttacatttgtaagaacagaacataagagaagtgaataaattgttcacaatc

SEQ ID NO: 414 - protein, 406 aa, Arabidopsis thaliana
  G632
MFISDKSRPTDFYKDDHHNSSTTSTTRDMMIDVLTTTNESVDLQSHHHHNHHNHHLHQSQPQQQILLGESSGEDHEVKAPKKRAETWVQDETRSLIMFRRGMDGLFNTSKSNKHLWEQISSKMREKGFDRSPTMCTDKWRNLLKEFKKAKHHDRGNGSAKMSYYKEIEDILRERSKKVTPPQYNKSPNTPPTSAKVDSFMQFTDKGFDDTSISFGSVEANGRPALNLERRLDHDGHPLAITTAVDAVAANGVTPWNWRETPGNGDDSHGQPFGGRVITVKFGDYTRRIGVDGSAEAIKEVIRSAFGLRTRRAFWLEDEDQIIRCLDRDMPLGNYLLRLDDGLAIRVCHYDESNQLPVHSEEKIFYTEEDYREFLALQGWSSLQVDGFRNIENMDDLQPGAVYRGVR

SEQ ID NO: 415 - DNA, 798 bp, Arabidopsis thaliana
  G634
atggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaacagcaactacaacaacaagaatcaatga

SEQ ID NO: 416 - protein, 265 aa, Arabidopsis thaliana
  G634
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESNNSNYNNKNQ

SEQ ID NO: 417 - DNA, 1913 bp, Arabidopsis thaliana
  G636
cgatgatgcaactgggtggtggtactccgaccactacagcggcggctacaaccgtcacaactgctacagcaccaccgccacaatcaaacaacaacgattcagcggcaacagaagcagcggcagcagcggttggggcgtttgaggtgtcggaagagatgcacgaccgtgggtttggaggaaatcgttggccgcggcaggaaacgctagcgttgttgaaaatacgatctgacatgggaatagcgtttcgagacgctagcgttaaaggtcccttatgggaagaggtttctaggaaaatggcggagcatggttacataagaaacgcaaagaaatgcaaagagaaattcgagaacgtttacaaataccacaaacgaaccaaagaaggtcgtaccggaaaatccgaaggcaaaacttatcgcttctttgatcaattagaagctctcgagtctcaatctacaacctcactccaccatcatcaacaacaaacgcctcttcgaccacagcaaaacaacaacaacaacaacaacaacaacaacaacagctccatattttcaactcctcctccggtaacgacagttatgccgacgcttccttcttcatcaattcctccgtatactcagcagattaatgtaccttcgtttccaaacatctccggtgattttctatcggataattctacatcgtcttcgtcttcttattcgacttcttctgacatggagatgggtggtggaactgcgactacaaggaagaaaaggaagaggaaatggaaggtgtttttcgagcggttgatgaaacaagtagttgataaacaggaagagcttcaacgcacattcttggaagctgttgaaaagcgagaacacaagagattggttagagaagagtcttggagagttcaagagattgccagaatcaaccgcgagcacgagatcttagctcaagaacgctctatgtccgctgcaaaagacgctgctgttatggcctttcttcaaaaactgtcagagaaacaaccgaatcagccacaaccgcagcctcagccgcaacaagttcgaccatcaatgcagcttaataacaacaatcagcagcaaccgcctcaacggtctcctccaccgcaacctcctgctccgcttccgcagccaattcaagcggttgtgtcgacgttagacacaacgaaaacgcacaatcgtggtgatcagaatatgactcctgcagcttcagcgagctcgtcgcggtggccgaaagtggagatagaagcattgataaagctgaggacgaatcttgattcgaaatatcaagaaaacggaccaaaaggaccattgtgggaagagatatcagcgggaatgagaaggttaggattcaacaggaactcaaagagatgcaaagagaaatgggaaaacataaacaaatacttcaagaaagtcaaagagagcaacaagaaacgtcccgaagattccaagacttgcccttactttcaccagcttgatgctttatatagagagaggaacaaattccacagcaacaacaacattgcagcttcttcttcatcttccggtcttgttaaaccggataattctgttcccttgatggtccaaccagagcagcaatggcctccggctgtaacgactgcgacaactactcccgcagcggctcagcctgatcagcaatctcagccgtcggagcagaactttgatgatgaagaaggtacagatgaagagtacgacgatgaagatgaggaagaggagaatgaagaagaggaaggaggtgagttcgagcttgtgcctagcaataacaacaacaacaagacgacgaataatctgtaatgatgatgattcgagttcgaaccggtttggtggtgaaagattagtaatctttttttaagttttgatacagaacatgagaatttaaatattggagggttt

SEQ ID NO: 418 - protein, 602 aa, Arabidopsis thaliana
  G636
MQLGGGTPTTTAAATTVTTATAPPPQSNNNDSAATEAAAAAVGAFEVSEEMHDRGFGGNRWPRQETLALLKIRSDMGIAFRDASVKGPLWEEVSRKMAEHGYIRNAKKCKEKFENVYKYHKRTKEGRTGKSEGKTYRFFDQLEALESQSTTSLHHHQQQTPLRPQQNNNNNNNNNNNSSIFSTPPPVTTVMPTLPSSSIPPYTQQINVPSFPNISGDFLSDNSTSSSSSYSTSSDMEMGGGTATTRKKRKRKWKVFFERLMKQVVDKQEELQRTFLEAVEKREHKRLVREESWRVQEIARINREHEILAQERSMSAAKDAAVMAFLQKLSEKQPNQPQPQPQPQQVRPSMQLNNNNQQQPPQRSPPPQPPAPLPQPIQAVVSTLDTTKTHNRGDQNMTPAASASSSRWPKVEIEALIKLRTNLDSKYQENGPKGPLWEEISAGMRRLGFNRNSKRCKEKWENINKYFKKVKESNKKRPEDSKTCPYFHQLDALYRERNKFHSNNNIAASSSSSGLVKPDNSVPLMVQPEQQWPPAVTTATTTPAAAQPDQQSQPSEQNFDDEEGTDEEYDDEDEEEENEEEEGGEFELVPSNNNNNKTTNNL

SEQ ID NO: 419 - DNA, 2136 bp, Arabidopsis thaliana
  G638
gaattaaaaggtttaacctttacctttttttcccttcactatcgataattgatcttctctttcggctgaatataaatctgaaaaaatggatcaagatcagcatcctcagtacggtataccggagctccggcagctcatgaaaggcggaggaaggacgactactacaacaccgtctacttcttctcattttccctctgatttcttcggttttaaccttgctccggtgcagccaccgccacaccgtcttcatcagttcactactgatcaagatatgggtttcttgccacgtggcatacatggattgggtggaggttcttcaacggctggaaataacagtaacttaaacgcgagtactagtggtggaggagttgggtttagtgggtttcttgacggtggtggtttcggcagcggagtaggaggagacggtggaggaactggaaggtggccgagacaagaaaccctaactctgttggaaattagatctcgtcttgatcataaattcaaagaagctaatcataaaggacctctttgggatgaagtttctaggattatgtccgaggaacatggataccaaaggagtgggaagaaatgcagagagaagtttgagaatctgtacaaatactatagtaagactaaagaaggcgaagccggaagacaagacggaaaacatcacagatttttccgccagctccaagcgctatacggggattctaataacttggtttcttgtcccaatcataacacgcagttcatgagcagtgctcttcatggtttccatactcaaaaccctatgaacgttgctacaacaacgtccaacatccataacgttgatagtgttcatggttttcatcaaagccttagtctttctaacaactacaactcctccgagcttgagctgatgacttcctcttcggaagggaatgattctagtagtagaaggaaaaagaggagttggaaagcgaagataaaggagttcattgatacgaacatgaaaaggttgatagagaggcaagatgtttggcttgagaagttgacaaaggttattgaagacaaagaggaacaacggatgatgaaagaagaggaatggaggaagattgaagctgcaaggattgataaagagcatttgttttgggctaaagagagggcgaggatggaagctagggatgttgcggtgattgaggcattgcaatacttgacaggaaagccattgataaagccgctgtgttcatccccggaagagaggacaaatggtaataatgagatccgaaacaatagtgagacacagaatgagaatggaagcgatcaaacgatgactaacaatgtttgtgttaaaggaagtagtagctgctggggtgagcaagagattttaaagcttatggagataagaacgagcatggactcgacctttcaagagatattaggagggtgctcggatgagtttctatgggaggaaatcgcagcgaagttgattcagttagggtttgatcagagaagtgccttattatgcaaggaaaagtgggaatggataagcaatggaatgaggaaagaaaagaagcaaatcaacaagaaaagaaaggataattcgtccagctgcggcgtgtactacccgagaaacgaagaaaatccaatctacaataatcgagaaagtggatataatgataatgatccgcatcaaatcaacgaacaaggcaatgtaggttcttcaacatcaaacgcaaacgcaaacgcaaacgtaaccactggaaatccgagcggtgcaatggctgctagtacaaactgcttcccgttcttcatgggagatggagatcagaatttgtgggagagttatggtttgaggctcagtaaagaagagaatcagtaagtaatttctcttaatgaagaagaagaaggtaatcatgtggttaactaattcttttgagttagctatatatgagataaaccttgacttagctattatatgtcacatgctgcttagaattaagaaatatttgttggggcttaacgaattatatatcagcatatataagatgagagtctaagaattatatcaaattaggctttaaccaacgtacgattatatattatgttttcatgtatttattctgtaagactttttaatatcaatctttctctaaa

SEQ ID NO: 420 - protein, 591 aa, Arabidopsis thaliana
  G638
MDQDQHPQYGIPELRQLMKGGGRTTTTTPSTSSHFPSDFFGFNLAPVQPPPHRLHQFTTDQDMGFLPRGIHGLGGGSSTAGNNSNLNASTSGGGVGFSGFLDGGGFGSGVGGDGGGTGRWPRQETLTLLEIRSRLDHKFKEANHKGPLWDEVSRIMSEEHGYQRSGKKCREKFENLYKYYSKTKEGEAGRQDGKHHRFFRQLQALYGDSNNLVSCPNHNTQFMSSALHGFHTQNPMNVATTTSNIHNVDSVHGFHQSLSLSNNYNSSELELMTSSSEGNDSSSRRKKRSWKAKIKEFIDTNMKRLIERQDVWLEKLTKVIEDKEEQRMMKEEEWRKIEAARIDKEHLFWAKERARMEARDVAVIEALQYLTGKPLIKPLCSSPEERTNGNNEIRNNSETQNENGSDQTMTNNVCVKGSSSCWGEQEILKLMEIRTSMDSTFQEILGGCSDEFLWEEIAAKLIQLGFDQRSALLCKEKWEWISNGMRKEKKQINKKRKDNSSSCGVYYPRNEENPIYNNRESGYNDNDPHQINEQGNVGSSTSNANANANVTTGNPSGAMAASTNCFPFFMGDGDQNLWESYGLRLSKEENQ

SEQ ID NO: 421 - DNA, 1399 bp, Arabidopsis thaliana
  G639
ttttttttaccttttcccgaaatggaacttctcgccggcgactgtcggaaacgagtcggcgacgactttgaggaagatattaacccattcgatggttcggacggtggttgcgggtggatgtacggtacccgtcaaatgggttctaacggaaacgacgacgctttggctacgctcgcagacttggcttcgcctcctcagaaattgaaacctataaggtgtggcgttaagcttccgtcgtcgtcggaggatcgacatcctcttgatattctcgccggaaccctagataggctgccggagatgggttttggctgcttcgaagctcctttgggatcgaagattgctgacgtggaggaaagtggtcaattgactcgtgggttttcaaaggaagaggatgattctcttcctcctcttcaaatggagtttcaagctcgaaatcgcatctcttgggatggtctctctctcagctcctctgttgatagcagcgatagtgactcatctccagacgttcgcaagaccgtcacgggtaaaagaaagcgggaaacaagggtaaagctggagcatttcttggagaagcttgtggggagtatgatgaagcggcaggagaagatgcataatcagttgattaatgtgatggagaagatggaagtggagagaatacgccgtgaggaagcttggaggcaacaggaaaccgagaggatgacacagaatgaagaagcacggaagcaagagatggcacgcaacttgtctctcatctctttcatcagaagtgttactggtgacgagatcgagatccctaaacagtgtgaattcccgcaaccactccagcagattcttccggaacaatgtaaagacgagaaatgtgaatccgctcagagagaaagagagataaagtttaggtactcaagcggcagtggcagcagtggtagaaggtggccgcaagaggaagtgcaggcattgataagttcgagaagcgatgtggaagagaagacggggatcaacaagggagcgatttgggatgagatatcagcaagaatgaaagaaagagggtacgaaagatctgcgaaaaagtgtaaggagaagtgggagaacatgaacaagtactataggagagtgacggaaggtgggcagaaacagcctgagcacagcaagactcgctcatactttgagaaacttggaaatttttacaagaccatttcctcgggagagagggaaaaatgagtgaaagattttaaatttaggtgtttttggcacgcaaaacgggagaacttgtagatgattacctcgagtttaatttttatatctttggtgtagtttataatttaaaactctacggctctgtatttgtagaaggttcgaataaaaaagacaaatacgttggggtgaaaaaaaaaaaaaaaaa

SEQ ID NO: 422 - protein, 398 aa, Arabidopsis thaliana
  G639
MELLAGDCRKRVGDDFEEDINPFDGSDGGCGWMYGTRQMGSNGNDDALATLADLASPPQKLKPIRCGVKLPSSSEDRHPLDILAGTLDRLPEMGFGCFEAPLGSKIADVEESGQLTRGFSKEEDDSLPPLQMEFQARNRISWDGLSLSSSVDSSDSDSSPDVRKTVTGKRKRETRVKLEHFLEKLVGSMMKRQEKMHNQLINVMEKMEVERIRREEAWRQQETERMTQNEEARKQEMARNLSLISFIRSVTGDEIEIPKQCEFPQPLQQILPEQCKDEKCESAQREREIKFRYSSGSGSSGRRWPQEEVQALISSRSDVEEKTGINKGAIWDEISARMKERGYERSAKKCKEKWENMNKYYRRVTEGGQKQPEHSKTRSYFEKLGNFYKTISSGEREK

SEQ ID NO: 423 - DNA, 1968 bp, Arabidopsis thaliana
  G640
aaaagaaaatgtttgatggtggagtacctgagcagatccaccgtttcatagcttctccaccgccaccgcctccgcttccgccgcatcaaccggcggcggaaagatcactaccttttcctgtctcattctcttcctttaacaccaatcatcaacctcagcatatgttgagcttggatagccgtaagatcattcaccatcatcatcatcatcatcaccatgacatcaaagatggtggtgctactactggtgagtggataggtcagacggatcatgatgatagcgataatcatcatcaacatcatcatcatcatccatggtgtagtgatgaagttcttgctcttcttaggttcagatctacagtggagaattggttccctgaattcacttgggagcatacttcaagaaagttggcagaagttggttttaagaggagtccacaagaatgcaaagagaaatttgaagaagaagagagaagatatttcaatagcaacaacaacaacaacaacaacactaatgatcatcaacacatcggcaattataacaacaagggaaataattataggatatttagtgaggttgaagagttttatcatcatggtcatgacaatgaacatgtttcatcagaagttggggataaccaaaacaagaggaccaatttagtagaaggaaaaggaaacgtgggagaaacggtacaagacttaatggcggaggacaaattaagagatcaggatcagggtcaagtagaagaagcatcaatggagaatcaaagaaactctattgaggttggaaaagttggaaacgtagaagatgatgccaagtcatcatcatcatcaagcttgatgatgatcatgaaggagaagaagaggaagaagaggaagaaagagaaagagaggtttggtgtgttaaaagggttttgtgagggtctagtgaggaacatgatagctcaacaagaggagatgcataagaaactcctggaagatatggtgaagaaggaagaagagaagatagcgagagaggaagcttggaagaagcaagagattgagagagttaacaaagaggtagagattagagcacaagaacaagccatggctagtgatagaaacaccaacatcatcaagttcatatccaagtttacagaccatgatcttgatgttgtccaaaacccaacaagcccttctcaagactcatcttctttagctctacgaaaaacccaaggcagaagaaagtttcaaacttcatcatcactattacctcaaaccctaactccacataaccttttaaccattgacaaatcacttgaacctttttctactaaaaccctaaaacccaaaaaccaaaacccaaaacctccaaaaagcgatgataaaagtgatcttggcaagagatggccaaaggatgaagtgttggctctgatcaacattagaagaagtatcagtaacatgaatgatgatgatcataaagatgagaactcattatcaacatcttcaaaagctgttccattatgggaaagaatatccaagaaaatgttggagattgggtacaagagaagtgccaaaagatgcaaagagaaatgggaaaacatcaacaagtattttaggaagacaaaagatgttaacaagaagagaccacttgactcaaggacttgtccttattttcaccaactcacagctttatacagccaaccaccaacagggaccaccgccaccaccgccaccacggccacgtcagccagagatctagacacccgacccgaggaaaaccgggttggatcccaagatcctgatatttctgtacccatgcatgtagatggagatggtgctggcgataaaagcaatgttcagttttcaggtttcgatcttgagttctaataaatcccttctatatatatattatcagttatattctctttttctgctttttgctaaaacctcatttttggttattatgataaagttattatatatgaat

SEQ ID NO: 424 - protein, 619 aa, Arabidopsis thaliana
  G640
MFDGGVPEQIHRFIASPPPPPPLPPHQPAAERSLPFPVSFSSFNTNHQPQHMLSLDSRKIIHHHHHHHHHDIKDGGATTGEWIGQTDHDDSDNHHQHHHHHPWCSDEVLALLRFRSTVENWFPEFTWEHTSRKLAEVGFKRSPQECKEKFEEEERRYFNSNNNNNNNTNDHQHIGNYNNKGNNYRIFSEVEEFYHHGHDNEHVSSEVGDNQNKRTNLVEGKGNVGETVQDLMAEDKLRDQDQGQVEEASMENQRNSIEVGKVGNVEDDAKSSSSSSLMMIMKEKKRKKRKKEKERFGVLKGFCEGLVRNMIAQQEEMHKKLLEDMVKKEEEKIAREEAWKKQEIERVNKEVEIRAQEQAMASDRNTNIIKFISKFTDHDLDVVQNPTSPSQDSSSLALRKTQGRRKFQTSSSLLPQTLTPHNLLTIDKSLEPFSTKTLKPKNQNPKPPKSDDKSDLGKRWPKDEVLALINIRRSISNMNDDDHKDENSLSTSSKAVPLWERISKKMLEIGYKRSAKRCKEKWENINKYFRKTKDVNKKRPLDSRTCPYFHQLTALYSQPPTGTTATTATTATSARDLDTRPEENRVGSQDPDISVPMHVDGDGAGDKSNVQFSGFDLEF

SEQ ID NO: 425 - DNA, 1083 bp, Arabidopsis thaliana
  G641
tcttgattctttcatatggatggacatcagcatcatcaccttcaccagcttcaatatctcaacaagcatcatcttcatactcaatcgcaaacgccggaaatagcctctccggtagctgttggggataggtttccacagtggagcgtcgaagagacaaaagagttgatagggataagaggagagctagatcaaactttcatggagacaaaacggaacaagcttctttgggaagttatctctaacaagatgagagacaaaagctttcctcgtagccctgaacagtgcaagtgcaagtggaagaacctcgtcactcgttttaagggatgtgagacaatggaggcagagacagcgagacaacagttccctttttatgatgatatgcaaaatatatttaccactagaatgcagagaatgctatgggctgaatccgagggaggaggagggggaacaagcggggcagcgagaaagagagagtattcttcagatgaggaagaagagaatgtgaatgaagagctagtagatgtcagcaacgacccaaaaattctaaatccgaaaaagaacattgcaaagaagcgaaaaggcggtagtaatagtagtaatagcaataatggtgtaagagaagtgttggaagagtttatgagacatcaagtgagaatggagagcgagtggagagaaggatgggaggctagggagaaggaaagagcagagaaagaagaagaatggagaaggaagatggaggagcttgagaaggagaggttggcaatggagcggatgtggcgggatagagaggagcaacggcggtcgagggaggagatgagagcagagaagagggattcacttatcaatgcattgcttgctaagcttactagagatggttccctctaatcttttgtcagctttgcttaacctaaattaacttgttcttatatgcttgtttggggtgtagtgtaggtacaattatttggtgggggaagataatatctacggcaaatctcaacactcatatattgattgatatgatgacatatttgagttttagtgaggctttagtaatttatcatccccacatttttcttcctagtt

SEQ ID NO: 426 - protein, 289 aa, Arabidopsis thaliana
  G641
MDGHQHHHLHQLQYLNKHHLHTQSQTPEIASPVAVGDRFPQWSVEETKELIGIRGELDQTFMETKRNKLLWEVISNKMRDKSFPRSPEQCKCKWKNLVTRFKGCETMEAETARQQFPFYDDMQNIFTTRMQRMLWAESEGGGGGTSGAARKREYSSDEEEENVNEELVDVSNDPKILNPKKNIAKKRKGGSNSSNSNNGVREVLEEFMRHQVRMESEWREGWEAREKERAEKEEEWRRKMEELEKERLAMERMWRDREEQRRSREEMRAEKRDSLINALLAKLTRDGSL

SEQ ID NO: 427 - DNA, 861 bp, Arabidopsis thaliana
  G654
gtgacagggtttagctcaaggagagggtgagaaaaagaagaagaaggtgagaaaagtgaaggcaaggctttgaggatgtcttttacaggaactcaacagaaatgcaaggcttgtgagaagactgtttatgctgttgagcttctctctgctgatggagttggatatcacaagtcttgcttcaaatgcactcactgcaaaagcaggcttcagctgagtagttactcatcaatggaaggtgttttgtactgtaagcctcattttgagcagctctttaaggagagtggtagtttcaacaagaactttcagtcacctgcaaaatcggctgacaaatcaactcctgagctgacaaggacgcctagccgagttgctggcaggttctctggtacacaagagaaatgcgccacttgtagtaaaactgtgtatcctattgaaaaggtaacagtcgagagccagacatatcacaagtcctgcttcaagtgctcacatggaggttgcccaatttcaccttccaactacgcagctcttgaaggaatcctgtactgcaagcaccatttcgctcagctcttaaggagaagggaagttacaaccacttaatcaaatccgcttccatcaaacgcttcgcagccgcagcagtcgccgccggtgtaccagcagcctccgttcctgaatcttaaaatccaataatttctcctctctagtctaaaatttgaagttaatgccaaactgattcagtttgattctctttgtgagagcgtgtgtgtaatctatgcttgatgttcttatttccattgatgtctcctaaaaatctatgtttgtgtggtgtttggttatctataaaaagtctgaaactttccttataaa

SEQ ID NO: 428 - protein, 172 aa, Arabidopsis thaliana
  G654
MSFTGTQQKCKACEKTVYAVELLSADGVGYHKSCFKCTHCKSRLQLSSYSSMEGVLYCKPHFEQLFKESGSFNKNFQSPAKSADKSTPELTRTPSRVAGRFSGTQEKCATCSKTVYPIEKVTVESQTYHKSCFKCSHGGCPISPSNYAALEGILYCKHHFAQLLRRREVTTT

SEQ ID NO: 429 - DNA, 888 bp, Arabidopsis thaliana
  G656
atggtgaggacaccatgttgcaaagaagaaggaataaagaaaggagcttggactcctgaggaagatcaaaagcttattgcttatcttcacctacatggtgaaggtggatggcgtactctccctgaaaaagctggattgaagagatgtggaaagagttgtagattgagatgggctaattacttaagacccgacattaagagaggagagtttagtcctgaagaagacgacactatcatcaagcttcatgctcttaagggtaacaagtgggccgcaatcgccactagcttggcgggacgaactgacaacgaaataaaaaactattggaacacaaatctcaagaagcggttgaagcaaaaaggcatcgatgcaatcactcacaaaccgatcaattcaaccggtcaaaccggtttcgaaccaaaagtaaataaaccggtatattcatccggttccgctaggcttcttaaccgcgtcgcaagcaaatacgcggttgaattaaaccgggacttactgaccgggatcatcagtggaaactccaccgtcgccgaagattcacaaaactccggcgacgttgattctccgacctccacattgctcaacaaaatggcggcaacatcagttttgatcaacactacgactacatattccggcttctccgacaactgttctttcactgatgaattcaacgaattctttaacaatgaagagatctccgatatttacacgactgtcgataattttgggtttatggaagagttaaagagtattttaagctacggcgatgccagcgccggagttattgaaaattcgccggaggtcaatgtagctgatgcaatggagttcattgattcctggaacgaagatgacaatatggttggagtctttgtctga

SEQ ID NO: 430 - protein, 295 aa, Arabidopsis thaliana
  G656
MVRTPCCKEEGIKKGAWTPEEDQKLIAYLHLHGEGGWRTLPEKAGLKRCGKSCRLRWANYLRPDIKRGEFSPEEDDTIIKLHALKGNKWAAIATSLAGRTDNEIKNYWNTNLKKRLKQKGIDAITHKPINSTGQTGFEPKVNKPVYSSGSARLLNRVASKYAVELNRDLLTGIISGNSTVAEDSQNSGDVDSPTSTLLNKMAATSVLINTTTTYSGFSDNCSFTDEFNEFFNNEEISDIYTTVDNFGFMEELKSILSYGDASAGVIENSPEVNVADAMEFIDSWNEDDNMVGVFV

SEQ ID NO: 431 - DNA, 984 bp, Arabidopsis thaliana
  G659
atggggaagggaagagcaccttgttgtgacaagaccaaagtgaagagaggtccatggagcccagaagaagacattaaactcatctctttcattcaaaagtttggtcatgagaactggagatctctccccaaacaatctggtatgtcattgcttttgtcatcacaatcaaagcaaaagcctcttcaattgttttttcttttctttatgattctgaatgtatatatatgcaaaaatgaagggctattgaggtgtgggaagagttgtcgtctaaggtggattaactatcttaggccagatctgaagcgtggcaacttcacttcagaggaggaagaaacaatcattaagcttcaccacaactatgggaacaagtggtcgaaaatcgcttctcaacttccaggtagaacagataacgagatcaagaatgtgtggcacactcatctaaagaaaagactggctcagagctcaggaactgcagatgaaccggcctcgccttgttcgagtgattctgtttctcgtgggaaagatgataagtcatctcacgtagaagattctttgaacagagagactaatcataggaatgagttgtctacatctatgtcttctgggggttccaaccaacaagatgatccaaagatagacgaactcaggtttgagtatatagaagaagcttatagcgagtttaacgacattattattcaagaggtagacaaacccgatctgctggagataccatttgattcagatcctgacatttggagtttcttagatacttcaaactcatttcaacaatccactgcaaatgagaacagctcaggctcaagagcaacaacagaagaagagtctgatgaggatgaggttaagaaatggttcaagcacctagaaagcgaactcgggttagaagaagacgataatcaacaacaatacaaagaagaagaatcatcatcatcatcactcttgaagaactacgagctcatgatacattga

SEQ ID NO: 432 - protein, 327 aa, Arabidopsis thaliana
  G659
MGKGRAPCCDKTKVKRGPWSPEEDIKLISFIQKFGHENWRSLPKQSGMSLLLSSQSKQKPLQLFFLFFMILNVYICKNEGLLRCGKSCRLRWINYLRPDLKRGNFTSEEEETIIKLHHNYGNKWSKIASQLPGRTDNEIKNVWHTHLKKRLAQSSGTADEPASPCSSDSVSRGKDDKSSHVEDSLNRETNHRNELSTSMSSGGSNQQDDPKIDELRFEYIEEAYSEFNDIIIQEVDKPDLLEIPFDSDPDIWSFLDTSNSFQQSTANENSSGSRATTEEESDEDEVKKWFKHLESELGLEEDDNQQQYKEEESSSSSLLKNYELMIH

SEQ ID NO: 433 - DNA, 1441 bp, Arabidopsis thaliana
  G661
ggaaagaagcacgtggtgaatggacatgaagagaaaaggatgctaggtttaatataaattggaataagaagcagttagtggttgtgaaggaaggaaggaggcaagcaaccaaatctcagagacaattataacagtatagagaaggaagaaagaaaagaaaaagaaaccgttgttgatttagatacagagaagagaagatcatctaacatgggaagatctcctatctctgatgactctggtctcaagaaaggtccttggactcctgatgaagatgagaaacttgtcaactatgttcaaaaacatggtcatagtagctggagagcccttcccaaactcgctggtcttaacaggtgtgggaagagttgcaggctaagatggacgaactacttgagaccagacatcaagagagggagattctctccggacgaggaacagactatcttgaatcttcattcagttcttggaaacaagtggtcaacgattgcgaatcagttaccagggagaacagataacgagatcaagaatttctggaacactcatttgaagaagaagctgattcagatgggttttgatccaatgactcaccgtccaagaaccgatatcttctccggcttatcccagctcatgtctttgtcttctaacctgagaggctttgttgatctgcaacaacagtttcctattgatcaagaacacactatactcaaactccaaaccgagatggccaaactccaattgttccaataccttcttcaaccgtcttccatgagtaacaatgttaaccctaatgactttgacactctcagtctccttaactctattgcctctttcaaagagaccagtaataataccaccagcaacaatctcgacctcggtttcctcggctcttatcttcaggacttccacagcttaccttccctgaaaaccctaaattccaacatggaaccatcatctgttttcccccagaatcttgatgacaatcacttcaaattctccactcaaagagaaaacctacccgtgtctccaatctggctctcggatccatccagcacaactcctgctcatgtgaatgatgatctgatttttaaccaatacggtattgaagatgtcaatagcaatatcacatcttcaagcggtcaagaatcaggagcttcagcttcagctgcatggcctgatcatctattggatgattctatattttccgacattccttagccttcttttgtctttactttcaggtatgtactttggaggaactcaaatcaaatttactcttggaattgtgcttgttggagatttttatttgcctatctatatatatataaatactgtagagacatcatatatttgtaactcatgttgtagaatgtacagtacagagatttcatactcatatgcatatgttgttgtcaatgttctttagcaaaaaaaaaaaaaaaaaaaa

SEQ ID NO: 434 - protein, 334 aa, Arabidopsis thaliana
  G661
MGRSPISDDSGLKKGPWTPDEDEKLVNYVQKHGHSSWRALPKLAGLNRCGKSCRLRWTNYLRPDIKRGRFSPDEEQTILNLHSVLGNKWSTIANQLPGRTDNEIKNFWNTHLKKKLIQMGFDPMTHRPRTDIFSGLSQLMSLSSNLRGFVDLQQQFPIDQEHTILKLQTEMAKLQLFQYLLQPSSMSNNVNPNDFDTLSLLNSIASFKETSNNTTSNNLDLGFLGSYLQDFHSLPSLKTLNSNMEPSSVFPQNLDDNHFKFSTQRENLPVSPIWLSDPSSTTPAHVNDDLIFNQYGIEDVNSNITSSSGQESGASASAAWPDHLLDDSIFSDIP

SEQ ID NO: 435 - DNA, 1033 bp, Arabidopsis thaliana
  G663
gtcgacccacgcgtccgtgggaagccacaataaccccctattcctcggccttttttaaaaaagttttagaataatccgataaaatacttttatattaatttttctttggtccatggagggttcgtccaaagggttgaggaaaggtgcatggactgctgaagaagatagtctcttgaggctatgtattgataagtatggagaaggcaaatggcatcaagttcctttgagagctgggctaaatcgatgcagaaagagttgtagactaagatggttgaactatttgaagccaagtatcaagagaggaagacttagcaatgatgaagttgatcttcttcttcgccttcataagcttctaggaaataggtggtccttgattgctggtcgattgcctggtcggaccgctaatgatgtcaaaaattactggaacacccatctgagtaaaaaacatgagtcttcgtgttgtaagtctaaaatgaaaaagaaaaacattatttcccctcctacaacaccggtccaaaaaatcggtgtttttaagcctcgacctcgatccttctctgttaacaatggttgcagccatctcaatggtctgccagaagttgatttaattccttcatgccttggactcaagaaaaataatgtttgtgaaaatagtatcacatgtaacaaagatgatgagaaagatgattttgtgaataatctaatgaatggagataatatgtggttggagaatttactgggggaaaaccaagaagctgatgcgattgttcctgaagcgacgacagctgaacatggggccactttggcgtttgacgttgagcaactttggagtctgtttgatggagagactgttgaacttgattagtgtttctcaccgtttgtttaagattgtgggtggcttttctttcgtattttagtaatgtatttttctgtatgaagtaaagaatttcagcattttaagaaaaatggttatgtttctacgtaataaaaaaaaacgttatttataaaaaaaaaaaaaaaaaaaaaaaaaaaaaaa

SEQ ID NO: 436 - protein, 249 aa, Arabidopsis thaliana
  G663
MEGSSKGLRKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHLSKKHESSCCKSKMKKKNIISPPTTPVQKIGVFKPRPRSFSVNNGCSHLNGLPEVDLIPSCLGLKKNNVCENSITCNKDDEKDDFVNNLMNGDNMWLENLLGENQEADAIVPEATTAEHGATLAFDVEQLWSLFDGETVELD

SEQ ID NO: 437 - DNA, 1087 bp, Arabidopsis thaliana
  G664
caatccctcaatataaaataacaagtagaattgatctgcctatatataagattttgagacgaaataagatctaaaccacaagaaagaaagtaaacataaaagtatgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaaatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatgttgatcgtcttcaagggcatggaaagtcaacaacgccacgttgtttcaagtgcagcttagggatgataaacggcatggagtgcagatgcggaagaatgagatgcgatgtagtcggaggtagcagcaaggggagtgacatgagcaatggatttgattttttagggttggcaaagaaagagaccacttctcttttgggctttcgaagcttggagatgaaataatattgtcaaattttaggcgtaactgtacaaaacttttgcctagataatttgaaagtatatcttcaacttgtatgagaaatttaactggtgaattataatatatagaatttgttttttaaaaaaaaaaaaaaaaaa

SEQ ID NO: 438 - protein, 282 aa, Arabidopsis thaliana
  G664
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 439 - DNA, 1158 bp, Arabidopsis thaliana
  G665
ccaacttggacaacatcatttaaattataaaaccctccaataaataaaacttggtttatccaatcatcttatttctctgtgctctccaccattttacataaaccccaaaatctctcttcatcatcatcattcatcaacatcatctctctttctctatctcgctgtccctccttctctttctcattcattgcaatgggcagaagatgctcacactgtggaaacgtaggacataactcaagaacatgttcttcttaccaaacaagagtagttaggctctttggtgttcatctagacaccacaagctcttctccgccgcctcctcctcctccctcgattttggccgctgcaataaagaaaagtttcagcatggattgcttgccggcatgttcctcctcttcctcttcctttgctggttatctctccgatggtctcgcccataaaacacctgaccgcaaaaaaggggttccatggacggcggaagagcaccggacgtttctaattggattagaaaagcttggaaaaggagattggagaggaatctctagaaacttcgtcgtcacaaaatccccgacacaagtggcaagtcatgctcaaaaatactttctccggcaaactaccactctccatcacaagagacgccgcaccagcctctttgatatggtttcggccggcaatgttgaagaaaatagtactactaagaggatatgtaatgatcatattgggtcgagctcaaaggttgtttggaaacaaggattactcaatcctcgtcttggatatccagatccgaaagtatcagtatccggctcgggtaactccggtggactcgatcttgagctgaagcttgcgtccattcaatctcctgaatcgaatattagacctattagcgttacgtgaatctatataacacgttatgatcagtttcattagaataattcaaatgtttacatatataatatcttatcgatcctatctaatttgattttgatttaacgttagttactttgataatttcgtcgatattgtttttttggttttttcattgtgagattttttgtcttggaagttggatccatacatatttctgtaaaactttatatttaaggtatatatatctagcgctcataaaagtttcaatattccaaaaaaaaaaaaaaaaaa

SEQ ID NO: 440 - protein, 233 aa, Arabidopsis thaliana
  G665
MGRRCSHCGNVGHNSRTCSSYQTRVVRLFGVHLDTTSSSPPPPPPPSILAAAIKKSFSMDCLPACSSSSSSFAGYLSDGLAHKTPDRKKGVPWTAEEHRTFLIGLEKLGKGDWRGISRNFVVTKSPTQVASHAQKYFLRQTTTLHHKRRRTSLFDMVSAGNVEENSTTKRICNDHIGSSSKVVWKQGLLNPRLGYPDPKVSVSGSGNSGGLDLELKLASIQSPESNIRPISVT

SEQ ID NO: 441 - DNA, 984 bp, Arabidopsis thaliana
  G667
atggggaggcaaccatgttgtgacaaagtagggttaaagaaagggccatggactattgaagaagacaagaagctcatcaacttcatcctcaccaatggccattgctgttggagagctcttcccaagctttctggactattgcggtgtggtaaaagctgcagattaagatggataaattatttaagacctgatttaaaaagaggtcttttatcagaatatgaagaacaaaaggtcattaatctccatgcgcaacttggcaatagatggtcaaagattgcctctcatctaccaggaagaactgataatgaaataaagaaccattggaacacacacataaagaaaaagctaaggaaaatgggtattgaccctttgacccataagcctctctctgaacaagaagcttcacaacaagctcaagggagaaagaaaagtttagtgcctcatgatgacaagaacccaaaacaagatcaacaaaccaaagacgaacaagaacaacatcaattagagcaagctttggagaagaacaacacatcagtgtctggtgatgggttttgcattgatgaagtcccattgctcaatccacatgagatcttgatcgacatctcttcttctcatcatcatcattctaatgatgataatgtcaatatcaacactagtaaatttacttctccttcttcctcttcctcttctacgtcgtcgtgtatatcatcagtagtaccgggtgatgagttctccaagttttttgatgaaatggagattcttgacctcaagtggctttcatccgatgattctttaggggacgatattagcaaagacggcaagttcaacaacagtactgttgatacgatgaacttgtgggacatcaatgatttgagcagcttggatatgtttatgaatgaacatgatgatggttttattggaaatggaaatggatgttcaagaatggttttagatcaagattcatggacatttgatctcctctag

SEQ ID NO: 442 - protein, 327 aa, Arabidopsis thaliana
  G667
MGRQPCCDKVGLKKGPWTIEEDKKLINFILTNGHCCWRALPKLSGLLRCGKSCRLRWINYLRPDLKRGLLSEYEEQKVINLHAQLGNRWSKIASHLPGRTDNEIKNHWNTHIKKKLRKMGIDPLTHKPLSEQEASQQAQGRKKSLVPHDDKNPKQDQQTKDEQEQHQLEQALEKNNTSVSGDGFCIDEVPLLNPHEILIDISSSHHHHSNDDNVNINTSKFTSPSSSSSSTSSCISSVVPGDEFSKFFDEMEILDLKWLSSDDSLGDDISKDGKFNNSTVDTMNLWDINDLSSLDMFMNEHDDGFIGNGNGCSRMVLDQDSWTFDLL

SEQ ID NO: 443 - DNA, 1056 bp, Arabidopsis thaliana
  G668
atgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctag

SEQ ID NO: 444 - protein, 351 aa, Arabidopsis thaliana
  G668
MGRPPCCEKIGVKKGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKLKKINESGEEDNDGVSSSNTSSQKNHQSTNKGQWERRLQTDINMAKQALCEALSLDKPSSTLSSSSSLPTPVITQQNIRNFSSALLDRCYDPSSSSSSTTTTTTSNTTNPYPSGVYASSAENIARLLQDFMKDTPKALTLSSSSPVSETGPLTAAVSEEGGEGFEQSFFSFNSMDETQNLTQETSFFHDQVIKPEITMDQDHGLISQGSLSLFEKWLFDEQSHEMVGMALAGQEGMF

SEQ ID NO: 445 - DNA, 777 bp, Arabidopsis thaliana
  G669
atgggaaagagagcaactactagtgtgaggagagaagagttaaacagaggagcttggactgatcatgaagacaagatccttagagattacatcaccactcacggcgaaggcaaatggagcactctccctaaccaagctggtctcaagaggtgtggcaaaagctgtagacttcggtggaagaactacctaagaccggggataaagcgcggtaacatctcatctgatgaagaagaactcataatccgtctccataatcttcttggaaacagatggtcgttgatagctgggaggcttccaggccgaacagacaatgaaataaagaatcattggaactcaaacctccgcaaaagacttcccaaaactcaaaccaagcaaccaaaacgtataaaacattcgacgaacaacgagaataatgtatgtgttatacgtacaaaggcgattaggtgctcaaagactcttctcttctcggatctctctcttcagaagaagagtagtactagtccactacctctgaaagaacaagagatggatcaaggtggatcttcgttgatgggagatctcgaattcgatttcgataggatccattcggagtttcacttcccggatttgatggattttgatggtttggactgtggaaacgttacatctcttgtttcatctaacgagattttgggagagttggttcctgctcaaggtaatctcgatctcaatagacctttcacttcttgtcatcatcgtggcgacgatgaagattggctccgagacttcacttgttga

SEQ ID NO: 446 - protein, 258 aa, Arabidopsis thaliana
  G669
MGKRATTSVRREELNRGAWTDHEDKILRDYITTHGEGKWSTLPNQAGLKRCGKSCRLRWKNYLRPGIKRGNISSDEEELIIRLHNLLGNRWSLIAGRLPGRTDNEIKNHWNSNLRKRLPKTQTKQPKRIKHSTNNENNVCVIRTKAIRCSKTLLFSDLSLQKKSSTSPLPLKEQEMDQGGSSLMGDLEFDFDRIHSEFHFPDLMDFDGLDCGNVTSLVSSNEILGELVPAQGNLDLNRPFTSCHHRGDDEDWLRDFTC

SEQ ID NO: 447 - DNA, 1307 bp, Arabidopsis thaliana
  G670
cacagcattgcagctgtgaataactaaatggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactcgagcagatctggtaccgccgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagtggagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctttagcttttttctttctttctttcttatttctaacagatgtagagaacataaagatatacaaatacatacaatgtcaatacgtacagtggatttaagtgttctgtatatttcatgggcgagctgtctttatttttatgtttaaaaaaaaaaaaaaaaaa

SEQ ID NO: 448 - protein, 374 aa, Arabidopsis thaliana
  G670
MGRHSCCYKQKLRKGLWSPEEDEKLLTHITNHGHGCWSSVPKLAGLQRCGKSCRLEQIWYRRLRWINYLRPDLKRGAFSPEEENLIVELHAVLGNRWSQIASRLPGRTDNEIKNLWNSSIKKKLKQRGIDPNTHKPISEVESFSDKDKPTTSNNKRSGNDHKSPSSSSATNQDFFLERPSDLSDYFGFQKLNFNSNLGLSVTTDSSLCSMIPPQFSPGNMVGSVLQTPVCVKPSISLPPDNNSSSPISGGDHVKLAAPNWEFQTNNNNTSNFFDNGGFSWSIPNSSTSSSQVKPNHNFEEIKWSEYLNTPFFIGSTVQSQTSQPIYIKSETDYLANVSNMTDPWSQNENLGTTETSDVFSKDLQRMAVSFGQSL

SEQ ID NO: 449 - DNA, 1384 bp, Arabidopsis thaliana
  G671
ttcacttgagaacaaccccctttgaactcgatcaagaaagctaagtttgaagaatcaagaatggtgcggacaccgtgttgcaaagccgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatgagtgaaactcataatcgatgaatcccacgtgaccatgtcaatatgatgtctatggatatgttaccttgatgatgttgatggtaataataataaataatagatggtgatgatgaccatgcatgaatcatgaatgtagttcgtgttgtcacatatgcttgtgtttttgtgttttttttttttggtctgaagtgtgttgtttcgttgtaaatggattataaatggtgatgtaataattataatgttaaaaaaaaaaaaaaaaaaaaaaa

SEQ ID NO: 450 - protein, 352 aa, Arabidopsis thaliana
  G671
MVRTPCCKAELGLKKGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKKRLIKKGIDPVTHKGITSGTDKSENLPEKQNVNLTTSDHDLDNDKAKKNNKNFGLSSASFLNKVANRFGKRINQSVLSEIIGSGGPLASTSHTTNTTTTSVSVDSESVKSTSSSFAPTSNLLCHGTVATTPVSSNFDVDGNVNLTCSSSTFSDSSVNNPLMYCDNFVGNNNVDDEDTIGFSTFLNDEDFMMLEESCVENTAFMKELTRFLHEDENDVVDVTPVYERQDLFDEIDNYFG

SEQ ID NO: 451 - DNA, 1386 bp, Arabidopsis thaliana
  G672
tttgtctctctatctctttctcacaattagattctgtgcttcttctgcgatcaactaagatccgatccgcgagcgtttcagacttcgatcagatccgattaagagaagcaaatcgggtcgggtatgactcgtcgatgttctcactgcaatcacaatggccacaactctcggacttgtcccaatcgcggcgtgaagctctttggtgttcggctcaccgaaggttcgatccggaaaagtgcaagtatgggtaatcttagccattacacgggttctggatcgggtgggcatggaaccgggtccaacactccgggttctccgggtgatgtccctgaccatgtcgctggtgatggttacgcttctgaggatttcgttgctggctcttcctctagccgcgagagaaagaaaggaactccatggacagaggaagaacacaggatgttcttattaggtttacagaagctgggtaaaggtgattggagaggtatctcaagaaactatgtgaccactaggacacctacacaagttgctagccatgctcagaagtatttcatcagacaatccaatgtctctcgtcgcaaaagacgttctagtctctttgatatggttcctgatgaggttggagatattcccatggatttgcaagaaccagaggaagataatattcctgtggaaactgaaatgcaaggtgctgactctattcatcagacacttgctcctagctcacttcacgcaccgtcaatcttggaaatcgaagaatgtgaatcaatggactccacaaactctaccaccggggaaccaaccgcaactgccgctgctgcttcttcttcttccagactagaagaaaccacacaactgcaatcacaactgcaaccgcagccgcaactacctggctcattccccatactatatccgacctacttttcaccatattacccgtttccattcccaatatggcctgctggttatgttcctgaaccacccaagaaagaggaaactcatgaaattctcagaccaactgctgtgcactcgaaagctcctatcaatgttgacgagcttcttggtatgtctaagctcagccttgcagagtccaacaaacatggagaatccgatcagtctctttcattgaagctaggtggcgggtcatcttcaagacaatcagcatttcacccgaatcctagctctgatagttcagacatcaaaagcgtgatacacgctttataaaagacctgaggaagtgatggtctaaaatgggatctggtttggggtttacaggttagttgttggtcacagtaacttaaataagtttttctttgttaggttgtttaacttgggtaggatgttttagttcagctttgatcgttagggaaaagaaaaaaaaaaaaaaaa

SEQ ID NO: 452 - protein, 365 aa, Arabidopsis thaliana
  G672
MTRRCSHCNHNGHNSRTCPNRGVKLFGVRLTEGSIRKSASMGNLSHYTGSGSGGHGTGSNTPGSPGDVPDHVAGDGYASEDFVAGSSSSRERKKGTPWTEEEHRMFLLGLQKLGKGDWRGISRNYVTTRTPTQVASHAQKYFIRQSNVSRRKRRSSLFDMVPDEVGDIPMDLQEPEEDNIPVETEMQGADSIHQTLAPSSLHAPSILEIEECESMDSTNSTTGEPTATAAAASSSSRLEETTQLQSQLQPQPQLPGSFPILYPTYFSPYYPFPFPIWPAGYVPEPPKKEETHEILRPTAVHSKAPINVDELLGMSKLSLAESNKHGESDQSLSLKLGGGSSSRQSAFHPNPSSDSSDIKSVIHAL

SEQ ID NO: 453 - DNA, 1237 bp, Arabidopsis thaliana
  G673
tctctctctaaccccttctctcttcagtctctctctctctagacgatctctatcttgaataaaataccgataatgacctcaaccaatccggtggtcgccgaagtaataccggcggaaacttctacagatgctacagagacgacgattgcaacgacggaagctggtgaagcaccggagaagaaggtgaggaaagcttatacaatcaccaagtctagagagagttggactgaaggagaacacgacaagtttctggaagctcttcaattgtttgatcgtgactggaaaaagatagaagattttgttggttcaaagacagttattcagatcaggagccatgcccaaaaatactttctaaaggtccaaaaaaatgggactttagcacatgttccaccccctaggcctaagcgcaaagctgctcatccatatcctcaaaaggcatcgaaaaatgctcaaatgtcgcttcacgtttccatgtcctttcctactcaaataaataacctgcctggatatactccatgggatgatgatacatctgcattgttaaacattgctgtaagtggggttattccaccagaagatgaacttgatactctttgtggagcagaagttgatgttggatcaaatgacatgataagtgaaactagtccttcagcatctggtatcggaagctcaagcagaacactatcagattctaagggtttgagactggcgaaacaagctccctcaatgcatggtcttcctgattttgctgaggtttataacttcattgggagtgtgttcgatcctgacagcaaaggccgcatgaaaaagctcaaggaaatggatcctataaatttcgaaactgttttgctgttgatgagaaacctcacagtgaacttgtcaaaccctgactttgaacctacttctgaatatgttgatgctgcagaggaaggtcatgaacacttaagctcttagctgtttgtgcactcaacaagttatatatcttcttgacgacttcttgctcgcaacaactctctaccagctatcaaatgcatcgtacggttgttgtctgaggagaacataactgagtcgtcgtcacaaacaagaggaacatatgcagtttcggtcagaaccagtcgtgtgaatggtagatatatgtatgtgtgtgtagaaaatggttaccaattgtatcttctttttgataattattttttcatgccttttgtaatatgtaagtttctttaaaaaaaaaaaaaaa

SEQ ID NO: 454 - protein, 293 aa, Arabidopsis thaliana
  G673
MTSTNPVVAEVIPAETSTDATETTIATTEAGEAPEKKVRKAYTITKSRESWTEGEHDKFLEALQLFDRDWKKIEDFVGSKTVIQIRSHAQKYFLKVQKNGTLAHVPPPRPKRKAAHPYPQKASKNAQMSLHVSMSFPTQINNLPGYTPWDDDTSALLNIAVSGVIPPEDELDTLCGAEVDVGSNDMISETSPSASGIGSSSRTLSDSKGLRLAKQAPSMHGLPDFAEVYNFIGSVFDPDSKGRMKKLKEMDPINFETVLLLMRNLTVNLSNPDFEPTSEYVDAAEEGHEHLSS

SEQ ID NO: 455 - DNA, 1292 bp, Arabidopsis thaliana
  G675
taatcagagagagatggggaggtcgccttgttgcgacgagaatggtctaaagaaagggccatggactcctgaagaagatcaaaagcttattgattacattcataaacatggtcatggaagctggagagctctccccaagctcgcagatttgaataggtgtggaaagagttgtagactgaggtggacaaattatttgagaccagacatcaaaagaggaaagttttcagccgaagaagagcaaacaatcctccatctccactccattctcgggaataaatggtcagctattgcgacgcatttgcaaggtcgtacagataatgagataaaaaacttttggaacacacatctaaagaagaaattgatccagatggggatcgatcctgtgactcatcagccaagaaccgacctcttcgcaagtttacctcagctcatagccttggcaaatctaaaagacctaatcgaacaaacatcacaattctcatccatgcaaggcgaagcagcccaactagccaatctacaatatctccaacgtatgtttaattcttcggcttcattaaccaacaacaacggcaacaattttagcccgagtagtattctcgatatcgatcagcaccatgccatgaacctcttaaactccatggtctcttggaacaaagatcaaaaccccgcttttgatccggttcttgaactcgaggctaacgatcaaaatcaagatttatttccactagggtttatcattgatcaacccacccaaccactccaacaacaaaaataccatttaaacaatagtcctagtgagctaccatcgcaaggtgacccacttcttgatcatgtccctttcagtctccaaacacctttgaatagtgaggatcactttatagataatttggtcaaacatccaactgatcatgagcatgaacatgatgacaatccatcttcatgggttctcccttctcttatagacaataaccctaaaactgtcacgtcttctcttccacacaacaatccggcggatgcaagtagcagctcaagctatggaggttgtgaagctgcgtcgttttattggcctgacatttgcttcgacgaaagcctcatgaacgttatatcttagttactcttggtttagtgttttttttttagatctctgttattttatacaagttttttatttggtgttggtgttttgtaagtagaaaaggtgcgaatgtgtgatccgtttatccctttatgtaattaaacaggagatctctgtgatccgttagtcttttgtttaaaaaaaaaaaaaaaaaaaa

SEQ ID NO: 456 - protein, 365 aa, Arabidopsis thaliana
  G675
MGRSPCCDENGLKKGPWTPEEDQKLIDYIHKHGHGSWRALPKLADLNRCGKSCRLRWTNYLRPDIKRGKFSAEEEQTILHLHSILGNKWSAIATHLQGRTDNEIKNFWNTHLKKKLIQMGIDPVTHQPRTDLFASLPQLIALANLKDLIEQTSQFSSMQGEAAQLANLQYLQRMFNSSASLTNNNGNNFSPSSILDIDQHHAMNLLNSMVSWNKDQNPAFDPVLELEANDQNQDLFPLGFIIDQPTQPLQQQKYHLNNSPSELPSQGDPLLDHVPFSLQTPLNSEDHFIDNLVKHPTDHEHEHDDNPSSWVLPSLIDNNPKTVTSSLPHNNPADASSSSSYGGCEAASFYWPDICFDESLMNVIS

SEQ ID NO: 457 - DNA, 612 bp, Arabidopsis thaliana
  G676
atgagaaagaaagtaagtagtagtggtgacgaaggaaacaatgagtacaagaaaggtttgtggacagtagaagaagacaaaatcctcatggattatgtcaaagctcatggcaaaggtcactggaatcgtattgccaaaaagactggtttaaagagatgtggaaagagttgtagattgaggtggatgaattatctcagccctaatgtgaaaagaggcaatttcaccgagcaagaagaggatcttatcattaggctccacaagttgcttggtaataggtggtctttaattgctaaaagagtgccgggtcgaacggataatcaagtgaagaactattggaacacgcatcttagtaagaaactcggaatcaaagatcagaaaaccaaacagagcaatggtgatattgtttatcaaatcaatctcccgaatcctaccgaaacatcagaagaaacgaaaatctcgaatattgtcgataacaataatatcctcggagatgaaattcaagaagatcatcaaggaagtaactacttgagttcactttgggttcatgaggatgagtttgagcttagcacactcaccaacatgatggactttatagatggacactgtttttga

SEQ ID NO: 458 - protein, 203 aa, Arabidopsis thaliana
  G676
MRKKVSSSGDEGNNEYKKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKKLGIKDQKTKQSNGDIVYQINLPNPTETSEETKISNIVDNNNILGDEIQEDHQGSNYLSSLWVHEDEFELSTLTNMMDFIDGHCF

SEQ ID NO: 459 - DNA, 1187 bp, Arabidopsis thaliana
  G677
cctacatccgtatgcctatatataggtggttgcaaggcttacccaaatctctcttcaacttgccataacatttactctctttggacaaagacacagacagagagatagataaaaacagagaattgtcatagaaccaattcagagagaacgagagagagagagagagaaatggggagacaaccatgctgtgacaaagtagggttgaagaaaggaccatggactgcagaagaggataggaagctcataaacttcatccttaccaatggacaatgttgttggagagctgttcctaagctttctggtcttcttaggtgtggcaagagttgcagacttcgttggactaactatcttagaccagaccttaagagaggtcttctctctgattacgaagagaagatggtcattgatctccattcccagcttggaaacaggtggtcaaagatagcttctcatttaccaggaagaacagacaacgaaatcaagaatcattggaacactcacatcaagaagaagttgaggaaaatggggattgatcctcttacacataaaccactctctatcgtcgaaaaagaagacgaagaacccttaaagaagctacagaataatacagttccttttcaagaaacaatggagcgtcctttagagaacaacatcaagaacatatcaagacttgaagagtctttaggtgatgatcaattcatggagataaatcttgagtatggtgtcgaagatgtccctcttattgaaacagagtctttagaccttatctgcagcaattcaacaatgtcttcatccacgtccacatcttcgcattcttctaatgattcgagtttcttgaaggatttgcagttcccggagttcgagtggtccgactatggtaatagtaataatgataataataatggtgtggacaacattatagagaacaatatgatgagcctgtgggaaattagtgactttagcagtttggatttgctgcttaatgatgagagttcttccacttttgggttgttttgaattcattcttaagaatatggtttcttttgtaaaagaatggaaactattggggtgggggaaacagaaaaacctaaatacccttcgttactctagtttttgagggatttgagagaacgtttttttacttgtgagaaatttagaaacaaaaataaagtttatttattttgtac

SEQ ID NO: 460 - protein, 282 aa, Arabidopsis thaliana
  G677
MGRQPCCDKVGLKKGPWTAEEDRKLINFILTNGQCCWRAVPKLSGLLRCGKSCRLRWTNYLRPDLKRGLLSDYEEKMVIDLHSQLGNRWSKIASHLPGRTDNEIKNHWNTHIKKKLRKMGIDPLTHKPLSIVEKEDEEPLKKLQNNTVPFQETMERPLENNIKNISRLEESLGDDQFMEINLEYGVEDVPLIETESLDLICSNSTMSSSTSTSSHSSNDSSFLKDLQFPEFEWSDYGNSNNDNNNGVDNIIENNMMSLWEISDFSSLDLLLNDESSSTFGLF

SEQ ID NO: 461 - DNA, 1043 bp, Arabidopsis thaliana
  misc_feature (1010)..(1010): n is a, c, g, or t
  misc_feature (1024)..(1024): n is a, c, g, or t
  misc_feature (1036)..(1036): n is a, c, g, or t
  G679
ctaatctgtacggttcttatttcgaaagggtaaaaaccaaaagcgacgcaaagggcaaaatcggaaaaagtgttttatttatggccgccgttagtagttcgtcggagaccggagactgcggcgttacgggaaagagagatgagatcatgttgttcggagttagagtcgtggttgatccgatgagaaagtgtgtgagtttgaacaatctctctgattatgaaaagtcttctccggaggatgagatccctaagatagtcaccgccggagctggagatggtgaagataagaacgaaacggatgcgacggtgattgtcgctgacggttacgcctccgccaatgacgctgtccagatttcgtcttcttccggcgggaggaaacgaggggttccatggacagagaacgagcataagaggttcttgattgggttgcagaaagtaggaaaaggagattggaaaggaatatcaagaaactttgtgaagagtaggactcctactcaagtagctagtcatgctcagaaatacttcctccgacgaaccaacctcaaccgtcgccgaagaagatctagcctttttgatatcactactgagacggttacagaaatggccatggagcaagatcctactcaggagaactcaccactacctgaaaccaacatcagctctggacagcaagcgatgcaagtttttactgacgtggccgacaaaaactgagaatgcaccagagacatttcatctcaacgatccatatctggttccagtaaccttccaagcaaagccaacattcaatctaaacacagatgctgctccactttctctcaacctttgtctggcatcctcatttaatcttaacgagcaacccaactcaagacactcggctttcacgatgatgccaagcttcagcgatggagatagcaatagcagcatcatcagagttgcttagagcttaaacccaaggggaatctacaagaacctggttctttctttgggtctctggtggtgggaggactaagnagtacctattaggngttaacagattngaaaaaa

SEQ ID NO: 462 - protein, 209 aa, Arabidopsis thaliana
  G679
MAAVSSSSETGDCGVTGKRDEIMLFGVRVVVDPMRKCVSLNNLSDYEKSSPEDEIPKIVTAGAGDGEDKNETDATVIVADGYASANDAVQISSSSGGRKRGVPWTENEHKRFLIGLQKVGKGDWKGISRNFVKSRTPTQVASHAQKYFLRRTNLNRRRRRSSLFDITTETVTEMAMEQDPTQENSPLPETNISSGQQAMQVFTDVADKN

SEQ ID NO: 463 - DNA, 2526 bp, Arabidopsis thaliana
  G680
cagttatcttcttccttcttctctctgttttttaaatttatttttagagaattttttttgttttgcttccgatttgattatttccgggaacgatgacttctccggggagttcccggtgagatgataagtcagattgcatacttgtctcctccatggctactctcaagggttttggctgcggtggattcgtttggtttctctagaatctaaagaggttatcacaacggctttgcaatttgaaaactttcatgtttggggagatcaaagatggtttcttttttatactttacttgttagagaggatttgaagcagcgaatagctgcaaccggtcctgttatggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaaacctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaccttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcgtgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatgacagacttggaggtaaaaaaaaaacatccacatttttatcaatatctttaaatctagtgttagtagtttgcttctccaatctttatgaaagagacttttaattttccttccgaacatttctttggtcatgtcaggttctgtaccatattaccccatgtcttgtctcttgtctctgtttgtgtatgctacttgtggtctatatgtcatctgctactactgttaattaaccattaagcaatggatttgtcttta

SEQ ID NO: 464 - protein, 645 aa, Arabidopsis thaliana
  G680
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQTLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 465 - DNA, 840 bp, Arabidopsis thaliana
  G681
atggggaggacgacatggttcgacgtcgacgggatgaagaaaggagagtggacggcagaggaagaccagaagctcggcgcttacatcaacgagcatggcgtttgtgattggcgttccctccccaaaagagctggtttgcagagatgtggaaagagctgcagattaaggtggcttaactatctaaagcctgggattagaagaggcaaattcactcctcaagaagaagaagaaatcatccaacttcatgctgttctcggaaacaggtgggcagccatggcgaagaagatgcagaatcgaacagacaatgatatcaagaaccattggaactcttgtctcaagaaaagactttcgagaaagggaatcgaccctatgacccacgagcccatcatcaaacacctcaccgtcaataccactaacgcagattgtggtaactcttccaccacgacgtccccgtcgacgacggaaagctctccttcctccggctcgtctcgtcttcttaacaaactcgccgcaggtatctcatctagacaacatagtctcgataggatcaagtacatcttgtcgaattcaataatcgaaagcagtgatcaagcaaaagaggaagaagaaaaagaagaagaagaagaagaaagagattcaatgatgggtcagaagattgacggtagtgaaggagaagatattcagatttggggcgaggaggaagttaggcgtttaatggagattgatgcaatggatatgtacgagatgacttcgtacgacgctgtcatgtacgagagtagtcacatacttgatcatctcttttgacttaatatagtgtgactgtgtgagtgcatgcatgtt

SEQ ID NO: 466 - protein, 267 aa, Arabidopsis thaliana
  G681
MGRTTWFDVDGMKKGEWTAEEDQKLGAYINEHGVCDWRSLPKRAGLQRCGKSCRLRWLNYLKPGIRRGKFTPQEEEEIIQLHAVLGNRWAAMAKKMQNRTDNDIKNHWNSCLKKRLSRKGIDPMTHEPIIKHLTVNTTNADCGNSSTTTSPSTTESSPSSGSSRLLNKLAAGISSRQHSLDRIKYILSNSIIESSDQAKEEEEKEEEEEERDSMMGQKIDGSEGEDIQIWGEEEVRRLMEIDAMDMYEMTSYDAVMYESSHILDHLF

SEQ ID NO: 467 - DNA, 228 bp, Arabidopsis thaliana
  G682
atggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattga

SEQ ID NO: 468 - protein, 75 aa, Arabidopsis thaliana
  G682
MDNHRRTKQPKTNSIVTSSSEEVSSLEWEVVNMSQEEEDLVSRMHKLVGDRWELIAGRIPGRTAGEIERFWVMKN

SEQ ID NO: 469 - DNA, 1157 bp, Arabidopsis thaliana
  G699
tcatgaagagactaagcagctcagattcaatgtgtggtctaatctccacttctacagatgaacagagtccaagagggtacggaagtaattaccaatctatgcttgaaggttacgatgaagatgctacactaatcgaggaatattccggcaaccaccaccacatgggtctatcggagaagaagagaagattaaaagttgaccaagtcaaagctcttgagaagaatttcgaacttgagaataaactcgaacctgagaggaaaactaaattagcacaagagcttggacttcaacctcgtcaagtagctgtttggtttcagaaccgtcgtgcacggtggaaaacaaaacagcttgaaaaagattacggtgttcttaagggtcaatacgattctctccgccacaatttcgattctctccgccgtgacaatgattcccttctccaagagattagtaaaatcaaagctaaggtaaacggtgaagaagataacaacaacaacaaagctattacggagggtgttaaggaagaggaagttcacaagacggattcgattccttcgtctcctctgcagtttctagaacattcctctggttttaactaccggcgaagcttcactgacctccgtgaccttctaccgaattccaccgttgtcgaggctggatcttccgatagttgcgattcaagcgccgttcttaacgacgaaacaagttctgataacggaagattgacgccgcctgtgacggttactggcgggagtttcttacagtttgtgaaaacagagcaaacagaggatcacgaggattttctaagcggtgaagaagcttgtggtttcttctccgatgaacagccgccgtcacttcattggtactctgcttcagatcattggacttgagaattgtttatcaaattggtgctctgtttagtctcaatgggaaaacagagaagagggcaaaggtggaataattgataaataaggattaaggatgaaggggattattaaattaaatccgcgggagaagttaattttgggtttaagattgtaatggctcttcatgtaattaacgatgtcgagaggggctttcacagaaataggaatcaatggggacactctgatatgaaaaaaaaaaaaaaaaaaaaaaaaaaaaaaaaaaaaaaaaaaaaa

SEQ ID NO: 470 - protein, 294 aa, Arabidopsis thaliana
  G699
MKRLSSSDSMCGLISTSTDEQSPRGYGSNYQSMLEGYDEDATLIEEYSGNHHHMGLSEKKRRLKVDQVKALEKNFELENKLEPERKTKLAQELGLQPRQVAVWFQNRRARWKTKQLEKDYGVLKGQYDSLRHNFDSLRRDNDSLLQEISKIKAKVNGEEDNNNNKAITEGVKEEEVHKTDSIPSSPLQFLEHSSGFNYRRSFTDLRDLLPNSTVVEAGSSDSCDSSAVLNDETSSDNGRLTPPVTVTGGSFLQFVKTEQTEDHEDFLSGEEACGFFSDEQPPSLHWYSASDHWT

SEQ ID NO: 471 - DNA, 965 bp, Arabidopsis thaliana
  G713
ggcacgagccttctctcttaatcaaaatcaagaaacttacaagatctggtgaaaaccatggaagaaggagattttttcaactgctgtttcagcgagattagtagtggcatgaccatgaataagaagaagatgaagaagagcaataaccaaaagaggtttaacgaggaacagatcaagtcacttgagcttatatttgagtctgagacgaggcttgagccgaggaagaaggttcaggtagctagagagctagggctgcaaccaagacaaatgactatatggtttcaaaacaagagggctcgatggaaaactaagcaacttgagaaagagtataacactcttagagccaattacaacaatttggcttcacaatttgaaatcatgaagaaagaaaagcaatctctggtctctgagctgcagagactaaacgaagagatgcaaaggcctaaagaagaaaagcatcatgagtgttgtggtgatcaaggactggctctaagcagcagcacagagtcgcataatggaaagagtgagccagaagggaggttagaccaagggagtgttctatgtaatgatggtgattacaacaacaacattaaaacagagtattttagggtccagggagagactgatcatgagctgatgaacattgtggagaaagctgatgatagttgcttgacatcttctgagaattggggaggtttcaattctgattctctcttagaccaatctagcagcaattaccctaactggtgggagttttggtcataaaagcatataagaaaaaaacagaacataagcgaagagaaagagtgtgaatagtttgtaaattatgtgttaagaaaataaatttagtttagtttaaatcttgtttcgatctatgtatctactatgttcaatactctttgtagctaattagtagcttataatgagactagaaaagttttgaagtcaaaaaaaaaaaaaaaaaa

SEQ ID NO: 472 - protein, 235 aa, Arabidopsis thaliana
  G713
MEEGDFFNCCFSEISSGMTMNKKKMKKSNNQKRFNEEQIKSLELIFESETRLEPRKKVQVARELGLQPRQMTIWFQNKRARWKTKQLEKEYNTLRANYNNLASQFEIMKKEKQSLVSELQRLNEEMQRPKEEKHHECCGDQGLALSSSTESHNGKSEPEGRLDQGSVLCNDGDYNNNIKTEYFRVQGETDHELMNIVEKADDSCLTSSENWGGFNSDSLLDQSSSNYPNWWEFWS

SEQ ID NO: 473 - DNA, 1530 bp, Arabidopsis thaliana
  G718
aagctttactctattgaagacgagatccttctctaatttacagattttggtggtcagtgtctgatggagtgtaatgcaaagccaccgtttcaatgggaattggaaaacttgatatcttttggcacttctacagctgaagttcctagaaagctaaaaccaatggagtgggaaattgatggatttgattgcacctctctgtattcttcaagctttgcctatgctggtagttcaggttctgatatagctcatgctttctctaaaagctcaaagtcaacttccattagctcttcatcagctgaagtaagaacacacaattttacatccgaaactggtgaaagtcttcctggagaatttgcaaaggggattgatacttctccaactcttgaactttcttttggctctggtgatccggttctcggtttaaagcttgctaaacgaacgtactttgaagacttttgggaagtggagaatgctaaaggtttgggacttcctgtgactctcgcttcatcttctgtttctcccgtgaagaaatcgaaatccattcctcagaccttacaaactcctcactgtcaagttgaaggctgtaatcttgatctttcatcagctaaagactatcatcggaaacataggatttgtgaaaaccattcaaagtttcctaaagtcgttgtgagtggcgtagagcgtcggttctgccaacaatgtagcaggttccactgtctctccgagtttgatgagaagaaacgtagctgtcgccgacctctctcagatcacaatgcaagacgtcgcaagccaaatcctggaaggacatatgatgggaaaccacaggtggattttgtatggaacagatttgcacttatccatccaagaagtgaggaaaagtttctatggcccagttcaaagcctgtaccatcaagagtcttaatgccgcagcctgcaaagaccgagatttccaataagctgttcaccgagcacagtagatttggattgttggaccccaaaacaaaatccgcaagagcggagttattcagtaaagaaaaggtcacaatctcttcacacatgggtgcttctcaagatcttgatggtgctctctctcttctgtcaaattcaacaacatgggtttcttcctctgaccaaccaagacgttttacccttgatcaccatccctcaagcaacctccaacccgtagctaaccggtctgcggctcaactcagttcagtgtccggctattggcagccggacccacccgcagttgaaggcccgaccgctctgcatagaaatggggcaggccagtttaatgaaaactacttcagcttgaaccagttttataactgaaagctgtatgcctttaaatcctatttaggatcaagcaagctagtgataagttaagataggagctgtgaaacttgcaagacaccaaatcctctcttatttctttgtccaaatattttcatgggttagagagctttgacaattgtctttaatatcaactttatcgtgttatacattaggattataaaaaaaaaaaaaaaa

SEQ ID NO: 474 - protein, 422 aa, Arabidopsis thaliana
  G718
MECNAKPPFQWELENLISFGTSTAEVPRKLKPMEWEIDGFDCTSLYSSSFAYAGSSGSDIAHAFSKSSKSTSISSSSAEVRTHNFTSETGESLPGEFAKGIDTSPTLELSFGSGDPVLGLKLAKRTYFEDFWEVENAKGLGLPVTLASSSVSPVKKSKSIPQTLQTPHCQVEGCNLDLSSAKDYHRKHRICENHSKFPKVVVSGVERRFCQQCSRFHCLSEFDEKKRSCRRPLSDHNARRRKPNPGRTYDGKPQVDFVWNRFALIHPRSEEKFLWPSSKPVPSRVLMPQPAKTEISNKLFTEHSRFGLLDPKTKSARAELFSKEKVTISSHMGASQDLDGALSLLSNSTTWVSSSDQPRRFTLDHHPSSNLQPVANRSAAQLSSVSGYWQPDPPAVEGPTALHRNGAGQFNENYFSLNQFYN

SEQ ID NO: 475 - DNA, 1882 bp, Arabidopsis thaliana
  G722
atacaactttttgtctctttctctactaataataataatccgaactttgtttgttcttctacttcaattcataatctttgacggcgatgactatggagcaagaaattgaagtcttggaccagtttccggttgggatgagagttcttgctgttgacgatgaccagacttgtctccgtattctccagactttgcttcagcgctgccaatatcacgttacaacaacgaatcaggcacagaccgcattggagttgttgagggagaacaagaataagtttgatcttgttattagcgatgtcgacatgccagacatggatggtttcaagctgcttgagcttgttggtcttgaaatggacttacctgtcataatgttatctgcgcatagcgatccaaagtatgtgatgaaaggagtcaagcacggtgcctgtgattatctgcttaaaccggttcgaattgaggagcttaagaacatatggcaacatgttgtgagaaagagcaaacttaagaagaataagagcaatgtgagtaatggttcaggaaactgtgataaagcaaacagaaaacgtaaagaacagtatgaagaggaggaagaggaagaaagagggaatgataatgatgatccaacggcgcagaagaagcctcgtgttctttggacgcatgagctgcacaataaattcctagcagctgttgatcatttaggcgttgagagagctgttccaaaaaagattctagatctgatgaatgttgacaaactcactagagagaatgttgcaagccaccttcagaaattccgcgttgctctgaagaaggtgtctgatgacgccattcaacaagctaacagggcggctattgactcacattttatgcaaatgaattctcagaaaggacttggtggcttctaccaccaccaccgcggaatacctgttggatccggtcagttccatggtggaaccacaatgatgaggcattactcttcaaataggaatcttggtcgtctgaattcccttggagcaggaatgttccaaccagtctcatcatcgtttcctcgtaaccataatgatggaggaaacatacttcagggtttgccgctagaagagcttcagatcaacaacaacatcaacagggcttttccaagctttacttcacaacaaaactctccaatggtagctcccagtaatctgttacttctcgagggtaacccgcagtcatcatctttaccctcaaacccgggtttttctcctcatttcgagatcagcaagcgtctagaacattggtcaaacgctgcattgtcaaccaacattccacagagtgatgttcattcaaaacctgacaccttggaatggaatgcgttctgcgactcagctagtccgctagtaaacccaaacctggatacaaatccggcatctctctgcagaaacacgggttttggatccacaaatgctgcacaaacagacttcttttatccattacagatgaatcagcagcctgcaaacaactcaggtccagtgacagaagctcaactgtttagaagtagcaatccaaacgaaggtttactcatgggacaacagaagcttcagagtggtttgatggcttctgatgctggttccttagatgatatagtcaattccttaatgacacaggaacagagccaatctgatttctcggaaggtgattgggatttggatggtttagctcactcggaacatgcatacgagaaactccattttcccttttctttgtcagcttgagaaacctgttttattcagacacaatcaattattattatcttttggttctgtctcttctctcttctctgtaatgaaagtgtaagctattgtttaccgctcccccactggtttgagcaacttaggaagatccaaatcca

SEQ ID NO: 476 - protein, 552 aa, Arabidopsis thaliana
  G722
MTMEQEIEVLDQFPVGMRVLAVDDDQTCLRILQTLLQRCQYHVTTTNQAQTALELLRENKNKFDLVISDVDMPDMDGFKLLELVGLEMDLPVIMLSAHSDPKYVMKGVKHGACDYLLKPVRIEELKNIWQHVVRKSKLKKNKSNVSNGSGNCDKANRKRKEQYEEEEEEERGNDNDDPTAQKKPRVLWTHELHNKFLAAVDHLGVERAVPKKILDLMNVDKLTRENVASHLQKFRVALKKVSDDAIQQANRAAIDSHFMQMNSQKGLGGFYHHHRGIPVGSGQFHGGTTMMRHYSSNRNLGRLNSLGAGMFQPVSSSFPRNHNDGGNILQGLPLEELQINNNINRAFPSFTSQQNSPMVAPSNLLLLEGNPQSSSLPSNPGFSPHFEISKRLEHWSNAALSTNIPQSDVHSKPDTLEWNAFCDSASPLVNPNLDTNPASLCRNTGFGSTNAAQTDFFYPLQMNQQPANNSGPVTEAQLFRSSNPNEGLLMGQQKLQSGLMASDAGSLDDIVNSLMTQEQSQSDFSEGDWDLDGLAHSEHAYEKLHFPFSLSA

SEQ ID NO: 477 - DNA, 1384 bp, Arabidopsis thaliana
  G723
atttttcaaaaaacctttagaattttcatttttttacgattccgatgttaactgtttctccggctccagtactcatcggaaacaactcaaaggatacttacatggcggcagatttcgcagattttacgacggaagacttgccggactttacgacggtcggggatttttccgatgatcttcttgatggaatcgattactacgacgatcttttcattggtttcgatggagacgatgttttgccggatttggagatagattcggagattcttggggaatattccggtagcggaagagatgaggaacaagaaatggagggtaacacttcgacggcatcggagacatcggagagagacgttggtgtgtgtaagcaagagggtggtggtggtggtgacggtggttttagggacaaaacggtgcgtcgaggcaaacgtaaagggaagaaaagtaaagattgtttatccgatgagaacgatattaagaaaaaacctaaggtggattggacgccggagttacaccggaaatttgtacaagcggtggagcaattaggggtagacaaggcggtgccgtctcgaatcttggaaattatgaacgttaaatctctcactcgtcacaacgttgctagccatcttcagaaatataggtcacatcggaaacatctactagcgcgtgaagcagaagctgccagctggaatctccggagacatgccacggtggcagtgcccggagtaggaggaggagggaagaagccgtggacagctcctgccttaggctatcctccacacgtggcaccaatgcatcatggtcacttcaggcctttgcacgtatggggtcatcctacgtggccaaaacacaagcctaatactccggcgtctgctcatcggacgtatccaatgccggccattgcggcggctccggcatcttggccaggtcatccaccgtactggcatcagcaaccactctatccacagggatatggtatggcatcatcgaatcattcaagcatcggtgttcccacaagacaattaggacccactaatcctcccatcgacattcatccctcgaatgagagcatagatgcagctattggggacgttatatcaaagccgtggctgccgcttcctttgggactgaaaccgccgtcggttgacggtgttatgacggagttacaacgtcaaggagtttctaatgttcctcctcttccttgagaaagatctccaaaatttgtcgaaatctcaaacttttaacttcatttttttggtatcttctatgtatttttgcaagggaaagacgataaatccttgttgcttgatcatatgtatttctctatatgagtgcatgtatcgaagttaagcaactttaatatatcgttataatcttcgataaa

SEQ ID NO: 478 - protein, 386 aa, Arabidopsis thaliana
  G723
MLTVSPAPVLIGNNSKDTYMAADFADFTTEDLPDFTTVGDFSDDLLDGIDYYDDLFIGFDGDDVLPDLEIDSEILGEYSGSGRDEEQEMEGNTSTASETSERDVGVCKQEGGGGGDGGFRDKTVRRGKRKGKKSKDCLSDENDIKKKPKVDWTPELHRKFVQAVEQLGVDKAVPSRILEIMNVKSLTRHNVASHLQKYRSHRKHLLAREAEAASWNLRRHATVAVPGVGGGGKKPWTAPALGYPPHVAPMHHGHFRPLHVWGHPTWPKHKPNTPASAHRTYPMPAIAAAPASWPGHPPYWHQQPLYPQGYGMASSNHSSIGVPTRQLGPTNPPIDIHPSNESIDAAIGDVISKPWLPLPLGLKPPSVDGVMTELQRQGVSNVPPLP

SEQ ID NO: 479 - DNA, 1239 bp, Arabidopsis thaliana
  G726
gaagactggaatttttttgaggaggactctgctccatcgccgcccgccctgtaacccaccggactcagtaaactagtctgtaacacaatatcttctatttcagataagatttagcttggagaagagcaagttccgaaaatggaggggcgtcgtgtatagatccaccacccacagccctgatggaagcagacaacggaggccccaattctagtcatgcatccaaacaacgtctgcgttggacgcatgagctacatgaacgcttcgttgatgccgttgctcaacttggtggccctgatagagctacacccaaaggcgttcttagagtgatgggtgtacaaggcttaactatatatcatgtcaagagtcacttacagaaatatcgacttgcaaagtatcttccagattcgtcttctgaagggaaaaaaactgataagaaagaatctggagatatgctctctgggttggacggctcgtcgggaatgcagataactgaagccctcaagttgcagatggaagttcagaaacgattgcacgagcaactagaagtgcaaagacagctgcaactacggatagaagcacaaggaaagtacttgaagaagataattgaagagcaacaacgactcagtggagtactcggcgaaccctcagccccagtaacgggcgattcagatcctgcaacccctgccccaacatctgagtctcctcttcaagacaagtctggcaaggactgtggaccagacaaaagtctctcagttgacgagtctctctcatcttaccgggagcctttaacaccagactcagggtgtaacattgggtctccagatgagagcacaggagaggagagattatcaaagaagcctcgattggtgagaggtgcagctggttatacacctgatattgtagtgggtcacccaatactagaatcaggcttgaacacttcttaccatcagtcagaccatgtcctcgcctttgaccagccatctacatcactgcttggggccgaagaacagttggataaggtttcaggagataatctttgagttgttgagtgtaccacatgtagtgttgtttatcctaatccttattagttaggagtttcctctaataatgtgatcacaagtcgttaattctctaggcactatcacgagcatgaagaatgaatatgtctgtgttgtgctgtaatttggtagacacaaaacaaaattactcttattcccaaaaaaaaaaaaaaaaaaaaaa

SEQ ID NO: 480 - protein, 286 aa, Arabidopsis thaliana
  G726
MEADNGGPNSSHASKQRLRWTHELHERFVDAVAQLGGPDRATPKGVLRVMGVQGLTIYHVKSHLQKYRLAKYLPDSSSEGKKTDKKESGDMLSGLDGSSGMQITEALKLQMEVQKRLHEQLEVQRQLQLRIEAQGKYLKKIIEEQQRLSGVLGEPSAPVTGDSDPATPAPTSESPLQDKSGKDCGPDKSLSVDESLSSYREPLTPDSGCNIGSPDESTGEERLSKKPRLVRGAAGYTPDIVVGHPILESGLNTSYHQSDHVLAFDQPSTSLLGAEEQLDKVSGDNL

SEQ ID NO: 481 - DNA, 1760 bp, Arabidopsis thaliana
  G729
aaaaaaaacaaaagaatagtcatcatcatcatcaccatcatcatccttatcatcatcaacaacttcagtggcagcaatagcaagagaaaggtttctttaattatgtctatggaaggtgtttttctagagaaaaccaaaacaaacacaacaactactctccctgatctatctctccacatcagtctcccagatattcatcaataccatcacaatgaatcttctaaagaatcttcaagaagatcctcccaactcgaaaacaacaaccgatcgtccaactttgaactctctttatctcatcataaccatccaacagcaagaatcttccattgtcctgatcgaagaacccttaatcttcctcatcagcagcattacaacaaccctatcatcaatggtgttcatcaaagggtcgatgaatccgagattagtaatctccaccgtccaattagaggcatcccggtctatcacaaccgttcattccctttccaccaacaaaactcttcattaccttctcttggaggaggagacatggatcaaatctcaatcttaaactcatcttccggctacaacaacgcttaccgatcattacaatcttccccgaggcttaaaggtgttcctttgcatcatcatcatcatcataatcagtatggagtcgttggatcttcagattcgtcttctcctcatcaccataaccatcatcatcatgggatgatcagatcaagattcttgcctaagatgccgacaaagcgaagcatgagagctccaaggatgcgttggactagtagcctccacgcgcggtttgttcacgctgttgagcttctaggcggccatgaaagagcaactccaaagtcggttcttgagctcatggatgtaaaagacttaactttagcacatgtgaagagccatttgcagatgtatcgaactgttaagaccactaacaagcctgctgcttcatcagatgggtcaggagaagaagaaatgggcataaatggaaacgaagttcatcatcaatcatcgacggatcaaagggcacaatctgatgatacttctcttcatcaagaaactgacatttcttccacacaacctcgttggagtaactcttcacgagagacatggccattaagtaataactgctcaagcgacatagatacaatgatcagaacttcatcaacatcaatgatctctcattatcaaagatccagcattcaaaatcaggagcaaaggtcgaatgatcaagcaaagaggtgtggaaatcttagttgtgaaaatccaagtttggagtttacattaggcagaccagattggcacgagaaatgactttcttgatcaatttggatttttatatatattggattttttatttttttgtttcatctttctctctctatatatactcagaaacatgtatgcagtatatatctttgtgacgatgaaattctcagcgtaaaagaaggagaacacgtagagagccaagctgctcaagagtgttgatttttgcacagagagagagaatatcactaccaaaatgaagaaatttggaggttcctcttctcaagttccattgatgatttgattataaagtggatgatcaatgtatgagtttttgtttttgggttttcgggtttttagttttttgaggttgatctggtggtgtgatcataagttatataattggaagatcatcaaaatgtggtgaaagtttggatatttttttgaaagcctcttggttggctagagggtttcaagttttttttttttttttt

SEQ ID NO: 482 - protein, 403 aa, Arabidopsis thaliana
  G729
MSMEGVFLEKTKTNTTTTLPDLSLHISLPDIHQYHHNESSKESSRRSSQLENNNRSSNFELSLSHHNHPTARIFHCPDRRTLNLPHQQHYNNPIINGVHQRVDESEISNLHRPIRGIPVYHNRSFPFHQQNSSLPSLGGGDMDQISILNSSSGYNNAYRSLQSSPRLKGVPLHHHHHHNQYGVVGSSDSSSPHHHNHHHHGMIRSRFLPKMPTKRSMRAPRMRWTSSLHARFVHAVELLGGHERATPKSVLELMDVKDLTLAHVKSHLQMYRTVKTTNKPAASSDGSGEEEMGINGNEVHHQSSTDQRAQSDDTSLHQETDISSTQPRWSNSSRETWPLSNNCSSDIDTMIRTSSTSMISHYQRSSIQNQEQRSNDQAKRCGNLSCENPSLEFTLGRPDWHEK

SEQ ID NO: 483 - DNA, 834 bp, Arabidopsis thaliana
  G732
aaaaaaaccaaacataaaacataaaactctgtcctttttttgtcttcttgtaacttttcttgttaaaaatcaatggcgtcatctagcagcacataccggagctcaagctcttccgacggtggtaataataacccgtcggactccgtcgtcaccgtcgacgaacgaaaacgtaaaagaatgttatcgaacagagaatctgcacgtaggtcaaggatgcgtaaacagaaacacgttgatgatctaacggctcagatcaatcagctatcaaacgacaaccgtcagatcttgaacagcctcaccgtaacatctcagctttacatgaagatccaagccgagaactctgttctcaccgctcagatggaggagcttagcaccagactccaatctctcaacgagatcgttgatcttgttcaatccaacggtgcaggatttggtgttgaccagatcgacggctgtggttttgatgatcgtacggttgggatcgacggatattacgatgatatgaatatgatgagtaatgttaatcattggggtggttcggtttacactaaccaacccattatggctaatgatatcaatatgtattgattaataaaattaattaaaataattagatgccccttttttgtctttttattttaaaatttagcccattttggtgtttttgggttggtgtgatgatgtaattatagtacatgcatctttgattggttggaaggataaatataaactttatatatatattggggcatatatatatgagttgtactttgcatgtattggtgtgtgttttgttataattatatgattatatatgtttatgttaaaaaaaaa

SEQ ID NO: 484 - protein, 171 aa, Arabidopsis thaliana
  G732
MASSSSTYRSSSSSDGGNNNPSDSVVTVDERKRKRMLSNRESARRSRMRKQKHVDDLTAQINQLSNDNRQILNSLTVTSQLYMKIQAENSVLTAQMEELSTRLQSLNEIVDLVQSNGAGFGVDQIDGCGFDDRTVGIDGYYDDMNMMSNVNHWGGSVYTNQPIMANDINMY

SEQ ID NO: 485 - DNA, 1060 bp, Arabidopsis thaliana
  G735
acaaattacaaaagagaaaagatggaaaaagttttctccgacgaagaaatctccggtaaccatcactggtcggttaatggaatgacgtcgttgaatcgcagtgcttccgaatgggcattcaatcgtttcatacaagaatcctccgccgctgcagacgacggagaatctacgacggcgtgtggtgtttccgtctcctctcctcctaatgttcctgtagattcagaggaatacagagcatttctcaagagtaaacttaatcttgcttgtgctgctgtcgccatgaaaaggggaactttcatcaaacctcaggatacttctggtagatctgacaatggtggagccaatgaatcagaacaagcctctcttgcttcttccaaagctacaccaatgatgagcagtgctataacaagtggatctgagctctctggtgatgaagaagaagctgatggtgaaactaatatgaaccctactaatgttaaacgcgttaaaaggatgctctctaatagagaatcagctagacggtccagaagaagaaagcaagcacacttgagtgagctagagacacaagtttcacagcttcgtgtagagaattcaaaactcatgaagggtctcactgatgtaactcaaacattcaatgatgcatctgtagaaaacagagttttaaaagccaatattgagacactacgagcaaaggtgaaaatggctgaagagacagtgaagagactcactggctttaacccaatgttccacaatatgcctcagattgtttcaactgtctctcttccttcagagacatcaaattctccagacactacaagcagccaagtgactacaccagagatcattagctcggggaacaaaggcaaggccttgatagggtgcaagatgaacagaacagcttcgatgcgtagtgttgagagcttggaacatctgcagaaacgtattcgaagcgttggggatcagtagctgttaaagaagaatcttgatttgtaacattaatcttaagacatatgttaaagacaaaatgttgtatgtttttggcggccgcgaattcctgcag

SEQ ID NO: 486 - protein, 314 aa, Arabidopsis thaliana
  G735
MEKVFSDEEISGNHHWSVNGMTSLNRSASEWAFNRFIQESSAAADDGESTTACGVSVSSPPNVPVDSEEYRAFLKSKLNLACAAVAMKRGTFIKPQDTSGRSDNGGANESEQASLASSKATPMMSSAITSGSELSGDEEEADGETNMNPTNVKRVKRMLSNRESARRSRRRKQAHLSELETQVSQLRVENSKLMKGLTDVTQTFNDASVENRVLKANIETLRAKVKMAEETVKRLTGFNPMFHNMPQIVSTVSLPSETSNSPDTTSSQVTTPEIISSGNKGKALIGCKMNRTASMRSVESLEHLQKRIRSVGDQ

SEQ ID NO: 487 - DNA, 513 bp, Arabidopsis thaliana
  G736
atggcgactcaagattctcaagggattaaactctttggcaaaactattgcatttaacactcgaacaataaaaaatgaagaagagacacacccgccggagcaagaagccacaatagccgttagatcatcatcatcatcggatctgacggccgagaagcgtccggataagatcatagcatgtccaagatgcaagagcatggagacaaagttctgttacttcaacaactacaacggtaatcagcctcgacacttttgtaaaggctgccaccgttactggaccgccggtggtgcactccggaacgttcccgtcggcgccggtcgtcggaagtccaaaccacctggtcgtgtcgtggttggtatgcttggagatggaaatggtgttcgccaagtcgagcttataaatggcttgctcgttgaggagtggcagcatgccgcagccgcagctcacggtagtttccggcatgattttcccatgaagcggctccggtgttactccgacggtcaatcgtgctga

SEQ ID NO: 488 - protein, 170 aa, Arabidopsis thaliana
  G736
MATQDSQGIKLFGKTIAFNTRTIKNEEETHPPEQEATIAVRSSSSSDLTAEKRPDKIIACPRCKSMETKFCYFNNYNGNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 489 - DNA, 885 bp, Arabidopsis thaliana
  G738
atggaccatcatcagtatcatcatcatgatcaataccaacatcagatgatgactagtactaacaataattcctataacaccatcgtcacaacacaaccaccaccaacaacaacaacaatggattcaacaacagcaacaactatgataatggatgacgagaagaagttgatgacgacaatgagcactaggccgcaagaaccaagaaactgtccaagatgcaactcaagcaacaccaagttttgttattacaacaactacagcttagcacagcctaggtacttgtgtaagtcttgtcggagatattggactgaaggtggctctctccgtaacgtccccgtaggcggaggttctagaaagaacaagaagcttccatttcctaattcctctacttcttcttccaccaagaacctcccggatctcaaccctcctttcgtcttcacatcatcagcttcatcatcaaaccctagcaagacgcatcaaaacaataatgacctcagcctatccttctcctcccctatgcaagacaagcgagctcaagggcattacggtcatttcagtgagcaagttgtgacaggagggcagaactgtcttttccaagctcctatgggaatgattcagtttcgtcaagagtatgatcatgagcaccccaaaaagaatcttgggttttcattagacaggaacgaggaagagattggtaatcatgataacttcgttgttaatgaggaaggaagtaagatgatgtatccttatggagatcatgaagaccgtcaacaacatcaccatgtgagacacgatgatggtaataagaagagagaaggtggttcaagcaatgagctatggagcggaatcatcctaggtggtgatagtggtggaccaacatggtga

SEQ ID NO: 490 - protein, 294 aa, Arabidopsis thaliana
  G738
MDHHQYHHHDQYQHQMMTSTNNNSYNTIVTTQPPPTTTTMDSTTATTMIMDDEKKLMTTMSTRPQEPRNCPRCNSSNTKFCYYNNYSLAQPRYLCKSCRRYWTEGGSLRNVPVGGGSRKNKKLPFPNSSTSSSTKNLPDLNPPFVFTSSASSSNPSKTHQNNNDLSLSFSSPMQDKRAQGHYGHFSEQVVTGGQNCLFQAPMGMIQFRQEYDHEHPKKNLGFSLDRNEEEIGNHDNFVVNEEGSKMMYPYGDHEDRQQHHHVRHDDGNKKREGGSSNELWSGIILGGDSGGPTW

SEQ ID NO: 491 - DNA, 1212 bp, Arabidopsis thaliana
  G740
cttcttcaacttttttttttaacgatggcttcagaggatcaatcggcggcgagatctaccgggaaggtgaactggttcaacgcttctaaaggctatggtttcattactcctgacgatggcagcgtagagcttttcgttcatcaatcttcaattgtctccgaaggttaccggagtttaaccgtcggcgatgcggttgagttcgctattactcagggaagcgacggtaagactaaagccgtcaatgttactgctcctggtggtggttctctcaagaaggagaataactctcgtggtaacggtgctaggcgcggcggcggtggaagcggttgctacaattgcggtgagttaggtcatatctctaaagattgtggtattggtggcggcggcggaggtggtgaacgtagatctagaggaggagaaggttgttacaattgtggtgatactggtcacttcgctagggattgtacttcagctggaaacggtgaccaacgtggagccaccaaaggtggaaacgatggttgctacacttgcggtgatgttggtcacgtggctagggattgtactcagaaatcagttggaaacggagaccaacgtggagcggtcaaaggtggaaacgatggttgctacacttgtggtgatgttggtcactttgctagggattgtactcagaaggttgctgccggaaacgtcagaagcggtggtggtggtagtggaacttgttattcatgcggtggagttggtcacattgcaagagattgtgcgactaagagacagccttctcgtgggtgttaccagtgtggtggttctggtcacttggctcgtgattgtgaccagagaggaagcggtggaggaggtaatgataatgcgtgctacaagtgtggtaaggaaggtcactttgcaagggaatgttcttctgtagcttaatcgatttcctaatcaacaaaacaaaaaaacaagaatgaaattgaatcgagttatatagtttggtatatattactcttcgttttcatttatctttttttttgttgttgatgggaatgaaattgcctggtccttttggtgtgtttttgagcttttattattatacagagtgatcccttttttgttataactattacaagtttttagctttatttgatatggatgctctctccttttcttctatctgtttctggaaattttgacctcatcatattacttatgtcatccaaa

SEQ ID NO: 492 - protein, 299 aa, Arabidopsis thaliana
  G740
MASEDQSAARSTGKVNWFNASKGYGFITPDDGSVELFVHQSSIVSEGYRSLTVGDAVEFAITQGSDGKTKAVNVTAPGGGSLKKENNSRGNGARRGGGGSGCYNCGELGHISKDCGIGGGGGGGERRSRGGEGCYNCGDTGHFARDCTSAGNGDQRGATKGGNDGCYTCGDVGHVARDCTQKSVGNGDQRGAVKGGNDGCYTCGDVGHFARDCTQKVAAGNVRSGGGGSGTCYSCGGVGHIARDCATKRQPSRGCYQCGGSGHLARDCDQRGSGGGGNDNACYKCGKEGHFARECSSVA

SEQ ID NO: 493 - DNA, 782 bp, Arabidopsis thaliana
  G743
tcagctcctcctacacagtttcttctctgaatctacttaggaagctaaaatgggtagatgtccgactagaaaagtgaagaagaggagattatctcacaaaacagctcgccgtgacaaattcgaagtcaaaggcgatgacttggtttacacagagttgcgtaaaccggagacggagattaagccgttacagcttgacgaggatttgcctggaatgggtcaattctactgcttacactgcgatcgatacttctccaacgcatcagtgagggatgatcatttcaagactaagaaacacaagaagcgtgtgaatatgatgatgggacaagcgccacactcgcaactcgatgcagatttagccgggggaatggggatgccggacaatggcccaaagctgatgtctaatttggtattcacagagttgcgtaaaccagagacggaggatttacctggaatgggtcaattcaactgcttactctgccatcggaacttctccaatgcatcagtgatggattatcatttcaagactaagaaacacaaaaagcgtgtgaagaagatagagggaccagcgccacactcgcaactcgatgcagatttagctggtggaatgggaatgccagagctgatgtctgcctgagttttacagttattttccttatttagttaatggaacccggaattttgttgtaaaactataatctcctaaattaatgatacaggttttttgtctgttgccaagtatctatcatgcagttactggtttagcttcaaaaaaaaaaaaaaaa

SEQ ID NO: 494 - protein, 194 aa, Arabidopsis thaliana
  G743
MGRCPTRKVKKRRLSHKTARRDKFEVKGDDLVYTELRKPETEIKPLQLDEDLPGMGQFYCLHCDRYFSNASVRDDHFKTKKHKKRVNMMMGQAPHSQLDADLAGGMGMPDNGPKLMSNLVFTELRKPETEDLPGMGQFNCLLCHRNFSNASVMDYHFKTKKHKKRVKKIEGPAPHSQLDADLAGGMGMPELMSA

SEQ ID NO: 495 - DNA, 1311 bp, Arabidopsis thaliana
  G746
atgggtgaggagttagctgacacaatgaacctggatttgaatcttgggcctggtcctgagtctgatctccaacctgcaccaaacgagactgtgaatttggctgattggactaatgacccgcctgagagatcttctgaagctgtgacaaggatcaggactcggcataggacacggttcagacagcttaatctcccgatcccggttctatctgaaacccataccatggctatagagctcaaccagttgatgggaaattctgtaaatagagctgctatgcagactggtgagggtagtgaaagaggcaatgaggatttgaaaatgtgtgagaatggcgatggagcccttggggacggtgtattggataagaaagcggatgtcgagaaaagcagtggcagcgacggtaactttttcgattgtaatatatgtttggatttgtcgaaggagccggttctcacctgttgtggtcatctttactgttggccttgtctgtaccaatggttacaaatttcggatgcaaaggaatgtcctgtttgtaaaggagaggtgacctccaaaaccgtgacaccgatctatggacgtggaaaccacaagagagaaattgaagagagtttagatactaaggtccccatgagaccacacgcgagacgcattgagagcttgaggaatacaattcaaaggtcgccttttacaataccaatggaagaaatgattagacgtatacagaataggtttgacagggattcaaccccagtccctgattttagtaaccgagaggcatcagaaagagtcaacgatcgagccaattcgatccttaaccggttgatgacatctaggggagttagatcagagcagaaccaggctagtgctgcagcagcagccattgtcgcagcatcagaggatattgatctaaatccaaacattgctcctgatcttgaaggagaaagcaacacgagattccatcctctcttgatcaggagacagttacagtcgcaccgagttgcaaggatctcgactttcacttctgcgttgagttcagctgagaggcttgtggatgcgtattttaggactcatccgttggggaggaaccaccaagagcaaaaccatcatgctcctgttgtggttgatgatagagactcattctcaagcattgcagctgttataaactctgagagtcaagtggatactgcagttgagatcgattctatggctctttcgacatcgtcctcgaggagaaggaatgagaatggttcgagggtttctgatgtagacagtgcagattctcgtccgcctaggagaaggagatttacttga

SEQ ID NO: 496 - protein, 436 aa, Arabidopsis thaliana
  G746
MGEELADTMNLDLNLGPGPESDLQPAPNETVNLADWTNDPPERSSEAVTRIRTRHRTRFRQLNLPIPVLSETHTMAIELNQLMGNSVNRAAMQTGEGSERGNEDLKMCENGDGALGDGVLDKKADVEKSSGSDGNFFDCNICLDLSKEPVLTCCGHLYCWPCLYQWLQISDAKECPVCKGEVTSKTVTPIYGRGNHKREIEESLDTKVPMRPHARRIESLRNTIQRSPFTIPMEEMIRRIQNRFDRDSTPVPDFSNREASERVNDRANSILNRLMTSRGVRSEQNQASAAAAAIVAASEDIDLNPNIAPDLEGESNTRFHPLLIRRQLQSHRVARISTFTSALSSAERLVDAYFRTHPLGRNHQEQNHHAPVVVDDRDSFSSIAAVINSESQVDTAVEIDSMALSTSSSRRRNENGSRVSDVDSADSRPPRRRRFT

SEQ ID NO: 497 - DNA, 1707 bp, Arabidopsis thaliana
  G748
ccacgcgtccgcactctcccaaatctctcttctttaacaacaaaaaaaaaatcacagagacatagagagaagaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttgttgcgttggcatttcaaaaaaaaaaaaaaaa

SEQ ID NO: 498 - protein, 448 aa, Arabidopsis thaliana
  G748
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 499 - DNA, 1423 bp, Arabidopsis thaliana
  G749
aaaaaaagaactctttcgtcgactaatgtgatttattgttcaccggagtattaaagaagatgatgatcggagaaactcgcaggacttatcccactgttgaaatacctccatggccggtacttgaagagcttacaacgtcggagtttttttctccggtgatgaatagtccagattgtagcatgcttgaagctttggcggggttgcagcgttatttgccgtctaacgaaccggatccggagtcatacccggatctattgggtccggattcaccaatcgatgcttactcatgcgaccatttccgtatgtacgatttcaaagtcaggaggtgtgctcgtggccggagtcatgattggacggagtgtccgtacgctcatcccggagaaaaagctcgccggagagatccgaggaagtaccattactctggtacggcttgtcctgattttcgtaaaggtggctgcaagaaaggtgactcttgtgagtttgctcatggtgttttcgagtgttggcttcatccagctcgttaccgtactcagccgtgtaaagacggtggtaactgtctccggaaaatttgtttctttgctcattcaccggatcagcttaggtttttacatactcggagccctgacagagttgattcttttgacgtttcgtctccgattcgtgctagagcatttcagctgtcgatttctccggtttctggttcgccaccgatgagtccaagagctgactcggagtcttctccgatgactcagtcactgagtcgatctctcgggtcttgttcgataaacgacgtcgttccttcgtttaggaatttacagtttaattcggtaaaatcatttcctcgtaacaatcctttattcggattcgggtcgccccgtggatcgatcttgggtcctgggtttcagtctctgcctacaacaccgacccgaccagggaatctggatatttgggagtatggtttggaggaagaacccgtaatggagcgtgtcgttgagtcgggtcgtgagctacgagaaaagatgcgcgagaaactgcacaaggagaattgcatggatcgagttgcccaggatccggatcagaatttgggtgaggctcctgatgtcgggtgggtatctgacctgctcatgtaaagaaaaaaatctgaccgtatttcgaagtctcattggcttttttggatatcttccaaggaaaagaggaagggatcttagtgtgttcatattattttatttactaatctcgtattttatctgctaataagaattaattatggattttggggcctgatttttctaagatgatcgttgtatagatgtgccttagggttttaattatgaaatagtattaatataatcgtgttttataagactataatgttagattgtaaccacttggtactaatctatgaatgaatgcaaattattat

SEQ ID NO: 500 - protein, 356 aa, Arabidopsis thaliana
  G749
MMIGETRRTYPTVEIPPWPVLEELTTSEFFSPVMNSPDCSMLEALAGLQRYLPSNEPDPESYPDLLGPDSPIDAYSCDHFRMYDFKVRRCARGRSHDWTECPYAHPGEKARRRDPRKYHYSGTACPDFRKGGCKKGDSCEFAHGVFECWLHPARYRTQPCKDGGNCLRKICFFAHSPDQLRFLHTRSPDRVDSFDVSSPIRARAFQLSISPVSGSPPMSPRADSESSPMTQSLSRSLGSCSINDVVPSFRNLQFNSVKSFPRNNPLFGFGSPRGSILGPGFQSLPTTPTRPGNLDIWEYGLEEEPVMERVVESGRELREKMREKLHKENCMDRVAQDPDQNLGEAPDVGWVSDLLM

SEQ ID NO: 501 - DNA, 1299 bp, Arabidopsis thaliana
  G751
tcttgccaaaataaaaaataaaaaaggagtttgttgtgaagccaatgaacgagatcgtgacaaacacatgcctaaaacaacagtcgaatcctccttctcctgctactcctgtggaaaggaaggcaagaccggagaaagaccaggctttgaactgtccaagatgcaactccttaaacaccaagttctgttactacaacaactacagcctgacgcagcccaggtacttttgtaaagactgcaggaggtattggaccgcaggtggttccctcaggaacatccccgtcggtggcggcgtccgcaagaacaagagatcttcttccaattcctcttcctcttcaccctcttcgtcttcttcttcaaagaaacctctttttgccaacaacaacacgcctacgcctcctcttcctcatcttaaccctaagattggtgaagcagccgctactaaagttcaagacttgacgttttctcaagggtttgggaacgcccacgaggttaaagatctcaacttggcgttttctcaagggtttgggatcggtcacaatcatcacagtagtatcccagagtttctgcaagtagtacccagcagcagtatgaagaacaacccactggtctcaacttcctcgtctttggagcttttagggatctctagttcctctgcttcctctaactcacgccctgctttcatgtcttatccaaatgttcatgattcatcggtctacacagcatccgggtttggtctgagttacccacagtttcaagagttcatgagaccagctttgggattctctcttgatggtggggatcctctacgtcaagaagaggggtccagtggcactaataatggaaggccgttgctgccatttgagagcctcctcaaacttccagtttcatcatcaagcaccaatagtggtgggaatggcaatctgaaagagaataatgatgagcatagtgatcatgaacatgagaaagaagaaggagaagctgaccaatctgttgggttttggagtggcatgttaagtgctggtgcttctgctgctgcatctggtggttcatggcaataattttagtcatggaccccatcccatgagagtttttagaagaaatgattacatttttcacccatgttttaaaaagatgagagggttaactatataatctgggtgcttactattttagtccttttcctttggtttccttctccttttctaaaaattattattaactttgttgggttggggatggatactgtatgtatttagactctcttttaaatcaatctcagttgttagttacctaaaa

SEQ ID NO: 502 - protein, 338 aa, Arabidopsis thaliana
  G751
MNEIVTNTCLKQQSNPPSPATPVERKARPEKDQALNCPRCNSLNTKFCYYNNYSLTQPRYFCKDCRRYWTAGGSLRNIPVGGGVRKNKRSSSNSSSSSPSSSSSSKKPLFANNNTPTPPLPHLNPKIGEAAATKVQDLTFSQGFGNAHEVKDLNLAFSQGFGIGHNHHSSIPEFLQVVPSSSMKNNPLVSTSSSLELLGISSSSASSNSRPAFMSYPNVHDSSVYTASGFGLSYPQFQEFMRPALGFSLDGGDPLRQEEGSSGTNNGRPLLPFESLLKLPVSSSSTNSGGNGNLKENNDEHSDHEHEKEEGEADQSVGFWSGMLSAGASAAASGGSWQ

SEQ ID NO: 503 - DNA, 1806 bp, Arabidopsis thaliana
  G752
cacactatccttcgcgagacccttcctctatatagggaagttcatttcatttggagaggacacgctgacaagctgactctagcagatctggtaccgtcgtatcacgagtttgcacaaaaaagcaggctccgcgggcgcccccttcaccggaacaagattggacgaaagctaaaggtattgcatccatttaaaaagttcatggataggtggtccagtaaaagagccatggaggcgagacctgactctaagaagaagggtggtgttgtttttagagatagatttaacagcaatagttgcaaggttcctatttgtagtgatgagaaaaaatcaatgaactttactaggtttgttggctcttcagataagaaagagaaatcagtgttgtctacataccgctcttcgccaaacgggaaggaagtaattggaacttcctctaagatttgtatctctagctcctcttctgtgaaaagtggtgagaagcaaccgttttctcagatagccattgattcatcagagagcagcagaggtagtgaagacgaggtagagtcagaaatcttgcaagttcctcttggaagagataaaagaagaatgaacaataaacttatttatggaaaagttataacacctgaagcggaatgctcaaagttgccatcaagctcaagaatcaagagaggttttaggcagagatttgggttgagcaagcaagagtttcatcctggtccatctggccagtcaacatctgctaaccggggatgcagcccgttgttgtcaggtgtcattccaagtggttttggattggacaaaagattaagtcggaaggcagatacaatcagtaagacaaaagtttacggagaaagcagttctagctcctcagctagggggaagaatgtaacagaacctccaccagttgaagtgagacgtcgtagttttaatccgagaggttctgtttctgatagtagacgggctagacactgcattttggatgatgacaacgatgttgcttcagttgggagtcagagattggcaaatagaaataatagtcgcattagagggagtggtagagacggtttatcctctgtcacggcagcagagatgtctcagactgaaacatcaaacaatctcaattctcctgtctctttggagctgttctctggttttccagaatttggcctctctggttccttattgagtcatgacagttttcgcagttataatttagatgggatctccgagattctgccagaacttgataggatcgaacaagatatcgaacttaattatgaggatctgcttatcatggaaacaggtttacttctcggtggactaagcttccatgaccaacaccgagacatgaggctagacatcgataacatgtcatatgaggaactattagctctagaagagaggattggtacagtaagcactgctttgacagaagaagcaatatcaaagtgcttgaaaacaagtatctatcagatgaaacctttgagttatgggtctatcaccaaaagtcctagtgataacaaggaagatgccaaatgcagcatctgccaggaagaatatacgattggagatgaagttgggaggctacactgtgagcacacataccatgtgaagtgtgtgcaagagtggttgcggataaagagttggtgcccaatctgcaaagccacagccgaaacctcctctaaataaccgtcttcttcttcttcctcgttcgtaagggtgggcgcgccgacccagctttcttgtacaaagtggtgattgccgctctaggcaggcctcgtaccggatcctctagctagagct

SEQ ID NO: 504 - protein, 497 aa, Arabidopsis thaliana
  G752
MDRWSSKRAMEARPDSKKKGGVVFRDRFNSNSCKVPICSDEKKSMNFTRFVGSSDKKEKSVLSTYRSSPNGKEVIGTSSKICISSSSSVKSGEKQPFSQIAIDSSESSRGSEDEVESEILQVPLGRDKRRMNNKLIYGKVITPEAECSKLPSSSRIKRGFRQRFGLSKQEFHPGPSGQSTSANRGCSPLLSGVIPSGFGLDKRLSRKADTISKTKVYGESSSSSSARGKNVTEPPPVEVRRRSFNPRGSVSDSRRARHCILDDDNDVASVGSQRLANRNNSRIRGSGRDGLSSVTAAEMSQTETSNNLNSPVSLELFSGFPEFGLSGSLLSHDSFRSYNLDGISEILPELDRIEQDIELNYEDLLIMETGLLLGGLSFHDQHRDMRLDIDNMSYEELLALEERIGTVSTALTEEAISKCLKTSIYQMKPLSYGSITKSPSDNKEDAKCSICQEEYTIGDEVGRLHCEHTYHVKCVQEWLRIKSWCPICKATAETSSK

SEQ ID NO: 505 - DNA, 1212 bp, Arabidopsis thaliana
  G759
aaaaaatatgggtatccaagaaactgacccgttaacgcaattgagtttaccaccgggtttccgattttacccgaccgatgaagagcttatggttcaatatctctgtagaaaagcagctggttacgatttctctcttcagctcatcgccgaaatagatctttacaaattcgatccatgggttttaccaaataaagcattatttggagaaaaagaatggtatttttttagtcctagggatagaaaatatccaaacgggtcaagacctaaccgggttgccggatcgggttattggaaagctacgggtacggataaaataatctcgacggaaggacaaagagttggtattaaaaaagctttggtgttttacatcggaaaagctcctaaaggtactaaaaccaattggatcatgcatgagtatcgtctcattgaaccttctcgtagaaacggaagcactaagttggatgattgggttctatgtcgaatatacaagaagcaatcaagtgcacaaaaacaagtttacgataatggaatcgcgaatgctagagaattcagcaacaacggtacttcgtccacgacgtcgtcttcttctcactttgaagacgttcttgattcgtttcatcaagagatcgacaacagaaatttccagttttctaacccaaaccgcatctcgtcgctcagaccggacttaaccgaacagaaaaccgggttccacggtcttgcggatacttctaacttcgattgggctagttttgccggtaatgttgagcataataactcggtaccggaactcggaatgagtcatgttgttcctaatctcgagtacaactgtggctacctgaagacggaggaggaagtcgagagcagtcacgggtttaataactcgggcgagttagctcaaaagggttatggtgttgactcgtttgggtattcggggcaagttggtgggtttgggtttatgtgatgatgaaatgctgacgcaataaaaataagtcgttaatttttgtcccgtggcaaatcttatatgtatttgaatttcaattcttttgggttaagagggagactcatagatttagatgtagatttgtaatctttcatgcatagaaaatttgacgaatagatttcgtaactttattttgttgctgtttggttatctttgtattggtataaatttagtggattgaaattgcatattgaaaaaaaaaaaaaaaaaaa

SEQ ID NO: 506 - protein, 317 aa, Arabidopsis thaliana
  G759
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 507 - DNA, 2001 bp, Arabidopsis thaliana
  G760
tgcttaattccaatgccatcgtgatcgattcatctctctctctctcttccaattttcccaattcttttttaaaaccctaatttttcagatatctgattatctcttgtatttcttctactcgatttgctcccataaaaacccttactttcttcaagttctggttttcaccgattgatgggtcgtggctcagtgacgtcgcttgctcctgggttccgttttcacccgacggatgaggaacttgttcgctactaccttaagcgtaaggtctgcaacaaaccctttaagttcgatgctatttccgtcaccgacatatacaagtctgagccttgggatctaccagataagtcgaagctgaaaagtagagacttggaatggtacttctttagtatgctggataagaagtacagtaatggttccaagacgaatcgtgctacggagaaagggtattggaagacgactgggaaagatcgggagattcgtaatggttcaagagtcgttgggatgaagaagacacttgtttatcacaagggtcgagctcctcgtggtgaaaggaccaattgggttatgcatgagtatcggctttctgatgaggacttgaagaaagctggtgtgccacaagaagcatatgtgttatgtaggatattccagaaaagtggtacgggtcctaagaatggggagcagtatggtgctccttatcttgaggaggagtgggaagaagatggaatgacttatgtacctgctcaagatgctttcagtgaaggattggctttgaatgatgatgtttatgtcgatattgatgacattgacgagaagcccgaaaatctggtggtctatgatgccgttcctattctacctaactattgtcatggggaatcaagtaacaatgttgaatcaggcaattactcagactctggaaattacattcaaccaggaaacaatgttgtcgactctggtgggtactttgaacaaccaattgaaacttttgaggaagatcggaagcctattatacgggagggtagcattcagccttgttctctgtttccagaggaacaaattggctgtggtgtgcaagacgaaaatgtggtgaatctggaatcttccaacaataatgtgtttgtagctgatacatgctacagtgacattcctattgatcataactatttacccgatgagccattcatggatcctaataacaatcttccactcaacgatggtctgtacctggaaacgaatgatctcagctgtgctcaacaagatgattttaacttcgaagattatctcagcttctttgatgatgagggtttgacttttgacgattctctattaatgggacctgaagattttcttcccaaccaagaagcccttgaccagaaacctgcccctaaagaattggagaaggaggtcgcaggaggcaaagaggcagtggaggaaaaggaaagtggcgaaggatcttcttcaaaacaagatacagatttcaaggactttgattcagctccgaagtacccatttctcaaaaagacgagccacatgcttggagccattcctactccatcttcatttgcttcacagttccaaacaaaggacgcaatgcgtctacacgcagcacaatcttctggttcagttcacgtgactgcaggtatgatgagaatatcaaacatgactctagcagcggacagcggtatgggctggtcatatgacaagaacggtaacctcaacgtagtcctttcattcggggtagtccaacaggatgatgcgatgactgcctcgggaagcaagacaggaattacggcgacaagagctatgttagtcttcatgtgtttatgggttctcctactctctgttagcttcaaaatagtaaccatggtgtctgctcggtaataggatcaaagttgaatcgtctcaaagactttttttggtgtttgtacctctccaatcatatagcctttaactttggcagtgctttgctgctcaatatttaaattttaaaaaaaaaaaaaaaaa

SEQ ID NO: 508 - protein, 567 aa, Arabidopsis thaliana
  G760
MGRGSVTSLAPGFRFHPTDEELVRYYLKRKVCNKPFKFDAISVTDIYKSEPWDLPDKSKLKSRDLEWYFFSMLDKKYSNGSKTNRATEKGYWKTTGKDREIRNGSRVVGMKKTLVYHKGRAPRGERTNWVMHEYRLSDEDLKKAGVPQEAYVLCRIFQKSGTGPKNGEQYGAPYLEEEWEEDGMTYVPAQDAFSEGLALNDDVYVDIDDIDEKPENLVVYDAVPILPNYCHGESSNNVESGNYSDSGNYIQPGNNVVDSGGYFEQPIETFEEDRKPIIREGSIQPCSLFPEEQIGCGVQDENVVNLESSNNNVFVADTCYSDIPIDHNYLPDEPFMDPNNNLPLNDGLYLETNDLSCAQQDDFNFEDYLSFFDDEGLTFDDSLLMGPEDFLPNQEALDQKPAPKELEKEVAGGKEAVEEKESGEGSSSKQDTDFKDFDSAPKYPFLKKTSHMLGAIPTPSSFASQFQTKDAMRLHAAQSSGSVHVTAGMMRISNMTLAADSGMGWSYDKNGNLNVVLSFGVVQQDDAMTASGSKTGITATRAMLVFMCLWVLLLSVSFKIVTMVSAR

SEQ ID NO: 509 - DNA, 885 bp, Arabidopsis thaliana
  G763
tctctctctttgtttggaaccaccatggataatgtcaaacttgttaagaatggtgttttgagattgccacctggattcagattccatcctactgatgaagaacttgtggttcaataccttaagaggaaagtttgttcttctcctttgccagcttcaatcatccctgagtttgatgtttgcagagctgatccttgggatttacctcgcaatttggagaaagagaggtacttctttagcacaagggaagctaaatacccaaatgggaaccggtctaaccgggcaactgggtctggttattggaaagctaccggtattgataaacgggttgtgacctctagaggaaatcaaatcgttggtttgaagaaaactcttgtcttctacaaaggcaaaccacctcatggctcaagaaccgattggatcatgcacgaatatcgcctctcttcttctcctccgagttctatgggtcccactcagaactgggtactctgtcgtatcttcttgaagaaaagagccggtaacaagaacgacgacgacgacggagatagccgtaatcttagacataataataataacaattcgagtgaccaaattgagataattacaacagaccaaacagatgataaaacaaaaccaatcttctttgatttcatgagaaaagaaagaacaacagatttgaaccttttgccgagctctccttcttccgatcatgcttcaagtggagtcacgacggagatcttctcttcttccgatgaagagaccagtagttgcaatagtttcagatgaaatctttaatttaattttaatgttgactatcttaataagttattatagttttatattaatacgactctctttcctttttattccatttttacttgaaaacga

SEQ ID NO: 510 - protein, 252 aa, Arabidopsis thaliana
  G763
MDNVKLVKNGVLRLPPGFRFHPTDEELVVQYLKRKVCSSPLPASIIPEFDVCRADPWDLPRNLEKERYFFSTREAKYPNGNRSNRATGSGYWKATGIDKRVVTSRGNQIVGLKKTLVFYKGKPPHGSRTDWIMHEYRLSSSPPSSMGPTQNWVLCRIFLKKRAGNKNDDDDGDSRNLRHNNNNNSSDQIEIITTDQTDDKTKPIFFDFMRKERTTDLNLLPSSPSSDHASSGVTTEIFSSSDEETSSCNSFR

SEQ ID NO: 511 - DNA, 1198 bp, Arabidopsis thaliana
  G764
atcgaattcgcggccgctcgatatctttacaaccattaaacaaaaaatttggccactacaagttgaaaaagttttgattatatctaatcgctgaaatggattacaaggtatcaagaagtggggagatagtagaaggagaagtagaagattcagaaaagattgatttaccacctggtttcagatttcacccaactgatgaagaacttataacacactatctaagaccaaaggttgtaaactcttttttctctgctatagctattggtgaagttgatctcaacaaagtcgagccttgggacttgccttggaaggctaagcttggggaaaaagagtggtacttcttttgcgtaagagaccgaaaatacccgactggtttaagaacgaatcgtgctactaaagccggttattggaaagctacagggaaagataaagagatcttcaaagggaaatctcttgttggtatgaagaaaacattggttttctacaaaggaagagctcctaaaggagtaaaaacaaattgggtcatgcatgagtatcgattagaaggcaaattcgctatcgataatctctctaaaaccgctaagaacgaatgtgttattagtcgtgtttttcatacacggactgatggtacgaaggagcatatgtccgttggtttacctccgctgatggattcttctccatatctaaagagtagaggacaagactctttagccgggaccacccttggtgggttgttgtctcacgttacctacttctccgaccaaacaaccgatgacaagagtcttgtggccgattttaaaactaccatgtttggttccggatcgactaactttttaccaaacataggttctctactagacttcgatcctctgtttctacaaaacaattcttcagtactgaagatgttgcttgacaatgaagaaacccaatttaagaagaatcttcacaattcaggttcatcagagagtgaactaacagcgagttcttggcaaggtcacaattcttatggttccactggtccagtgaatcttgattgcgtttggaaattctgaatttggaaaatcgaaaatttggatgttaactagggggtatatagggtttttaaaaacagtgtatatatgcgttatgtgttagctttagattctaggatatacaaagatgacactaatagattcttataacattttgtaaaaaaaaa

SEQ ID NO: 512 - protein, 318 aa, Arabidopsis thaliana
  G764
MDYKVSRSGEIVEGEVEDSEKIDLPPGFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRLEGKFAIDNLSKTAKNECVISRVFHTRTDGTKEHMSVGLPPLMDSSPYLKSRGQDSLAGTTLGGLLSHVTYFSDQTTDDKSLVADFKTTMFGSGSTNFLPNIGSLLDFDPLFLQNNSSVLKMLLDNEETQFKKNLHNSGSSESELTASSWQGHNSYGSTGPVNLDCVWKF

SEQ ID NO: 513 - DNA, 1017 bp, Arabidopsis thaliana
  G765
atggtggaagaaggcggcgtagttgtgaatcaaggaggagatcaggaggtggtggatttgcctccggggtttcggtttcaccctactgatgaagagataataactcactacctcaaagagaaggtcttcaacatccgatttaccgcggcagcgattggtcaagccgacctcaacaagaacgagccatgggatctaccaaagattgcaaagatgggggagaaggagttttactttttctgccagagggatcggaagtatccgaccgggatgaggacgaaccgtgcgaccgtgtctggttattggaaggcgaccgggaaggacaaggagatctttagaggcaaaggttgtcttgttgggatgaagaaaacacttgttttctatacaggaagagctcctaaaggtgaaaagaccaattgggttatgcatgaatatcgtcttgatggaaaatattcttatcataacctccccaaaaccgcaagggatgaatgggtggtgtgtagggtttttcacaagaacgctcctagtactacaatcactactacaaaacaactctcaaggattgattctcttgataacattgatcatctcttagacttctcatctctccctcctctcatagatccgggtttcttgggtcaacccggcccaagcttctccggtgcccgtcaacaacacgatctcaaacctgttctccaccatcctacaaccgcaccagtcgacaacacttaccttcctacccaagctctcaatttcccttaccactcggtccataattccggatctgatttcggctacggggcaggttcaggcaataataacaaaggtatgatcaagttggagcattctcttgtgagtgtgtctcaagaaaccggtttgagttccgatgtgaacacaaccgcaacgccagagatatcttcttatccaatgatgatgaatccggcaatgatggatggtagcaagtcagcgtgtgatggtcttgatgacttgatcttctgggaagatttatatactagctaa

SEQ ID NO: 514 - protein, 338 aa, Arabidopsis thaliana
  G765
MVEEGGVVVNQGGDQEVVDLPPGFRFHPTDEEIITHYLKEKVFNIRFTAAAIGQADLNKNEPWDLPKIAKMGEKEFYFFCQRDRKYPTGMRTNRATVSGYWKATGKDKEIFRGKGCLVGMKKTLVFYTGRAPKGEKTNWVMHEYRLDGKYSYHNLPKTARDEWVVCRVFHKNAPSTTITTTKQLSRIDSLDNIDHLLDFSSLPPLIDPGFLGQPGPSFSGARQQHDLKPVLHHPTTAPVDNTYLPTQALNFPYHSVHNSGSDFGYGAGSGNNNKGMIKLEHSLVSVSQETGLSSDVNTTATPEISSYPMMMNPAMMDGSKSACDGLDDLIFWEDLYTS

SEQ ID NO: 515 - DNA, 905 bp, Arabidopsis thaliana
  G767
cgaagtttcaactttcaaacatatctttacagttctttcttgctaaacaacaataaaggggaaaataggttaattatgatgaaatctggggctgatttgcaatttccaccaggatttagatttcatcctacggatgaggagctagtcctcatgtatctctgtcgtaaatgcgcgtcgcagccgatccctgctccgattatcaccgaactcgatttgtaccgatatgatccttgggaccttcccgacatggctttgtacggtgaaaaggagtggtattttttctcaccaagagatcgaaagtatccaaacggttcaagacccaaccgtgcagctggtactggatattggaaagctaccggagctgataaaccaataggtcgtcctaaaccggttggtattaagaaggctctagtgttttactcgggaaaacctccaaatggagagaaaaccaattggattatgcacgaataccggctcgctgacgttgaccggtcggttcgtaagaaaaacagtctaagattggacgattgggtattgtgtcgtatatataacaagaaaggtgtcatcgagaagcgacgaagcgatatcgaggacgggttaaagcctgtgactgacacgtgtccaccggaatctgtggcgagattgatctccggctcggagcaagcggtgtcaccggaattcacgtgtagcaacggtcggttgagtaatgcccttgattttccgtttaattacgtagatgccatcgccgataacgagattgtgtcacggctattgggcgggaatcagatgtggtcgacgacgcttgatccacttgtggttaggcagggaactttctgagttgtcacgtgcgattagagttagtggaaagtggaaactatcactgtctgttttcgcacgtgtcgggc

SEQ ID NO: 516 - protein, 253 aa, Arabidopsis thaliana
  G767
MMKSGADLQFPPGFRFHPTDEELVLMYLCRKCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVRKKNSLRLDDWVLCRIYNKKGVIEKRRSDIEDGLKPVTDTCPPESVARLISGSEQAVSPEFTCSNGRLSNALDFPFNYVDAIADNEIVSRLLGGNQMWSTTLDPLVVRQGTF

SEQ ID NO: 517 - DNA, 1324 bp, Arabidopsis thaliana
  G773
tccgggcaggtcttcaatctcagaaggcaaaaaagaaaatcaaagaagatagttttgtgattgttttctataaaaagtgcagatattttctttgtcctagagaaagaggtgataggaaaaatgggtctccaagagcttgacccgttagcccaattgagcttaccgccgggttttcggttttatccgactgacgaagagctgatggttgaatatctctgtagaaaagccgccggtcacgacttctctctccagctcatagctgaaatcgatctctacaagtttgatccatgggttttaccaagtaaggcgttattcggtgaaaaagaatggtattttttcagcccgagggataggaagtatccaaacgggtcaagacctaatcgggttgccgggtcgggttattggaaagccaccggtacggataaagttatctcgacggagggaagaagagttggtatcaagaaagctttggtgttttacattggaaaagctccaaaaggaaccaaaaccaattggattatgcatgagtaccgtctcatcgaaccctctcgtcgaaatggaagcaccaagcttgatgattgggttttatgtcgaatatacaaaaagcaaacaagcgcacaaaaacaagcttacaataatctaatgacgagtggtcgtgaatacagcaacaatggttcgtcgacatcttcttcgtctcatcaatacgacgacgttctcgagtcgttgcatgagattgacaacagaagtttggggtttgccgccggttcatcaaacgcgctgcctcatagtcatagaccggttttaaccaatcataaaaccgggtttcagggtttagccagggagccaagttttgattgggcgaatttgattggacagaactcggtcccggaactcggactgagtcataacgttccgagtattcgttacggtgacggtggaacgcagcaacaaactgaggggattcctcggtttaataataactcggacgtctcggctaatcagggttttagtgttgacccggttaacggatttgggtactcgggtcaacaatctagtgggttcgggtttatttgattgtgtaatggtaacgtaataagaaaaacatatttttattttttgtccgtgtcagattagttaattaatatagcgtagaattcgaactctagggttagatttaggttctacgacttgtattgtatattcgtcgtcatttgtcctgacatttacatttttgtaaacttttatagctggaacttttgtattgatcaattatttattagaaaaacagatattgcattggatctataaaaaaaaaaaaaaaaaa

SEQ ID NO: 518 - protein, 317 aa, Arabidopsis thaliana
  G773
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 519 - DNA, 1640 bp, Arabidopsis thaliana
  G776
tgcaattgaaggtgaggtttggtgaaagggaaattgagaaaaccctagaacaagtacggtctctattttgctttaatgggtcgcgaatctgtggctgttgtgactgcgccgccctcggcgactgctccgggtactgcttcggtggcgacctcgcttgctcctggcttccgatttcatccgactgatgaggaactcgtgagctattacttgaagaggaaggttctgggccaacctgtacgcttcgatgcgattggagaggtcgatatatacaagcatgagccctgggatttagcagtgttttcgagattgaagacaagggaccaagaatggtacttctacagtgcattagataagaagtatggaaacggtgctaggatgaaccgagcaactaacagagggtactggaaagctactggaaaagacagagaaatccgccgtgacattctgcttctcggtatgaaaaagacacttgttttccacagtgggcgtgcaccagacgggcttcggactaattgggttatgcatgagtatcgccttgtggaatatgaaaccgagaaaaacggaaacctggtgcaagatgcatatgtgttgtgtagagtcttccacaagaataacattgggccaccaagtgggaacagatatgctccgttcatggaagaggaatgggctgatgatgaaggagctctgattccaggaatagacgttaagctcaggctagagccgccgccagtagccaatggaaacgaccagatggaccaggaaatccagtcagccagcaagagtctcatcaacatcaatgagccaccgagagagacagctccactggatatcgaatcggaccaacagaatcatcatgagaatgacctcaagccggaggagcataacaacaataataattatgatgaaaacgaggaaacactcaaacgcgagcagatggaagaagaggagcgtcctcctcgacctgtatgcgttctcaacaaagaagctccattacctcttctgcaatacaaacgtagacgccaaagcgagtccaacaacaactcaagcaggaacacacaggaccattgttcgtccacaacaacaactgtcgacaatacaaccactttaatctcatcatctgccgctgccaccaacactgccatctctgcattgcttgagttctcactcatgggtatctccgacaagaaagaaaagccgcagcaaccgctacgtcctcacaaggaacctttgcctcctcaaactccacttgcatctcctgaagagaaggttaatgatctccagaaggagattcaccagatgtctgttgaaagagaaactttcaagcttgaaatgatgagtgcagaagctatgatcagtattctccagtcaaggatcgatgcgctgcgtcaggagaacgaggaactcaagaagaacaatgctaatggacaataaaggctctaaaaacatctctccaggttacttcttattgcccttcgccttttatttagctttaatctccctaatactatgacccatctacatagctcctctagacagattgcgaactgtgtgaatctctgttgtaacataggataaaacggattcgagcccctgagctgagtgttttatccttcttcttttaaaaaaaaaaaaaaaaaaaa

SEQ ID NO: 520 - protein, 451 aa, Arabidopsis thaliana
  G776
MGRESVAVVTAPPSATAPGTASVATSLAPGFRFHPTDEELVSYYLKRKVLGQPVRFDAIGEVDIYKHEPWDLAVFSRLKTRDQEWYFYSALDKKYGNGARMNRATNRGYWKATGKDREIRRDILLLGMKKTLVFHSGRAPDGLRTNWVMHEYRLVEYETEKNGNLVQDAYVLCRVFHKNNIGPPSGNRYAPFMEEEWADDEGALIPGIDVKLRLEPPPVANGNDQMDQEIQSASKSLININEPPRETAPLDIESDQQNHHENDLKPEEHNNNNNYDENEETLKREQMEEEERPPRPVCVLNKEAPLPLLQYKRRRQSESNNNSSRNTQDHCSSTTTTVDNTTTLISSSAAATNTAISALLEFSLMGISDKKEKPQQPLRPHKEPLPPQTPLASPEEKVNDLQKEIHQMSVERETFKLEMMSAEAMISILQSRIDALRQENEELKKNNANGQ

SEQ ID NO: 521 - DNA, 1057 bp, Arabidopsis thaliana
  G777
gtggctctctctttatctttcttggagtttagttagagattttaacgttgcaaatggatcaaccaatgaaaccaaaaacttgctctgaatctgattttgctgatgattcctctgcttcttcttcttcttcttcgggacaaaatctcagaggagctgagatggtggtggaagtgaagaaggaagcagtttgttcccagaaagcagagcgagagaagcttcgtagagataagcttaaggaacagtttcttgagcttggaaatgcacttgatccgaataggcctaagagtgacaaagcctcagttctcactgatacaatacaaatgctcaaggatgtaatgaaccaagttgatagactaaaagctgagtatgaaacactatctcaagagtctcgtgagctaattcaagagaagagtgagctgagagaggagaaagcgactttaaagtctgatatcgagattcttaatgctcaatatcagcatagaatcaaaaccatggttccatgggtacctcattacagttatcatatccccttcgtagccataactcagggtcagtccagttttataccttattcagcctctgtcaatcctctaaccgaacaacaagcatcggttcagcagcattcttcttcttctgccgatgcttcaatgaaacaagattccaaaatcaagccgttagatttggatctgatgatgaacagtaaccattcaggtcaaggaaatgatcaaaaagatgatgttcgtttaaagctcgagcttaaaatccatgcctcttctttagctcaacaggatgtttctggaaaagagaagaaagtaagcttgacaaccactgcaagctcatcgaatagttactcattatctcaagctgttcaagatagttcccccggtaccgtaaatgacatgttgaagccataaaccaataaacatattcccctgaacttgtgtttaataccgtgattgagaaggtaccatgattaaacttgttgtagattatccacatgattaacgatgtattcttatcacaagcaaataaaacacaaaagcatttgcttaaaaaa

SEQ ID NO: 522 - protein, 286 aa, Arabidopsis thaliana
  G777
MDQPMKPKTCSESDFADDSSASSSSSSGQNLRGAEMVVEVKKEAVCSQKAEREKLRRDKLKEQFLELGNALDPNRPKSDKASVLTDTIQMLKDVMNQVDRLKAEYETLSQESRELIQEKSELREEKATLKSDIEILNAQYQHRIKTMVPWVPHYSYHIPFVAITQGQSSFIPYSASVNPLTEQQASVQQHSSSSADASMKQDSKIKPLDLDLMMNSNHSGQGNDQKDDVRLKLELKIHASSLAQQDVSGKEKKVSLTTTASSSNSYSLSQAVQDSSPGTVNDMLKP

SEQ ID NO: 523 - DNA, 1389 bp, Arabidopsis thaliana
  G778
tctcaataacacaaaaccttttaaactagtaaaatacacagattttaggatgagccaatgtgttccaaactgtcacatcgatgatactccggcagcagccaccaccaccgtccgctccaccacagccgcagacatccccatattagactacgaggtagccgagctgacgtgggagaacgggcaactaggcttgcacggcttaggtccaccgcgagtgacggcttcgtcgaccaagtactccacaggcgccggtggaacgttggagtcgatagtggaccaagctactcgcctccctaaccctaagcccacggatgagctcgtcccgtggttccatcatcgctcctccagggccgcgatggcaatggacgcgcttgtcccttgctccaacctagtacacgagcagcagagcaagcctggtggcgttggctccacccgggtggggtcatgtagcgatggtcgtaccatgggcggtggaaaacgagcaagagtggcaccggagtggagcggcggcgggagtcagcggctgaccatggacacttacgacgtaggtttcacctcaacatcaatgggctcgcacgataacacaatcgacgatcatgactccgtctgccacagccgcccacagatggaggacgaagaagagaagaaagccggaggaaaatcatcagtttcaaccaagagaagcagagctgctgctattcataaccaatccgaacgtaagaggagagataaaatcaatcaaaggatgaagactttgcaaaaactggttcccaattccagcaagacggataaagcatctatgttggatgaagtgatagagtatttgaagcaacttcaagcacaagtgagcatgatgagcagaatgaatatgccttctatgatgcttcctatggccatgcagcaacaacaacaactacaaatgtctctcatgtccaatcccatgggtttagggatgggcatggggatgcccggtctcggtctcctcgaccttaattctatgaaccgagctgctgcaagcgctcctaatatccatgccaacatgatgccaaacccatttttgcccatgaattgtccatcgtgggatgcttcttccaatgactctcgatttcagtctcctctcatccccgatcctatgtctgcctttcttgcatgctctactcagccaacgacgatggaagcgtatagcaggatggctacattatatcagcaaatgcaacaacaacttcctcctccttcgaatccaaaatgattattactcaaacacctctatatagtttacgtctatatatgtgttagtcacatacatacatatatatattccatcataattatttatttatatgtataggcttctcatgaattatgatattatacgtattacgtaaaaaa

SEQ ID NO: 524 - protein, 399 aa, Arabidopsis thaliana
  G778
MSQCVPNCHIDDTPAAATTTVRSTTAADIPILDYEVAELTWENGQLGLHGLGPPRVTASSTKYSTGAGGTLESIVDQATRLPNPKPTDELVPWFHHRSSRAAMAMDALVPCSNLVHEQQSKPGGVGSTRVGSCSDGRTMGGGKRARVAPEWSGGGSQRLTMDTYDVGFTSTSMGSHDNTIDDHDSVCHSRPQMEDEEEKKAGGKSSVSTKRSRAAAIHNQSERKRRDKINQRMKTLQKLVPNSSKTDKASMLDEVIEYLKQLQAQVSMMSRMNMPSMMLPMAMQQQQQLQMSLMSNPMGLGMGMGMPGLGLLDLNSMNRAAASAPNIHANMMPNPFLPMNCPSWDASSNDSRFQSPLIPDPMSAFLACSTQPTTMEAYSRMATLYQQMQQQLPPPSNPK

SEQ ID NO: 525 - DNA, 766 bp, Arabidopsis thaliana
  G779
gacatgcatgtaagcattcggttaattaatcgagtcaaagatatatatcagtaaatacatatgtgtatatttctggaaaaagaatatatatattgagaaataagaaaagatgaaaatggaaaatggtatgtataaaaagaaaggagtgtgcgactcttgtgtctcgtccaaaagcagatccaaccacagccccaaaagaagcatgatggagcctcagcctcaccatctcctcatggattggaacaaagctaatgatcttctcacacaagaacacgcagcttttctcaatgatcctcaccatctcatgttagatccacctcccgaaaccctaattcacttggacgaagacgaagagtacgatgaagacatggatgcgatgaaggagatgcagtacatgatcgccgtcatgcagcccgtagacatcgaccctgccacggtccctaagccgaaccgccgtaacgtaaggataagcgacgatcctcagacggtggttgctcgtcggcgtcgggaaaggatcagcgagaagatccgaattctcaagaggatcgtgcctggtggtgcgaagatggacacagcttccatgctcgacgaagccatacgttacaccaagttcttgaaacggcaggtgaggattcttcagcctcactctcagattggagctcctatggctaacccctcttacctttgttattaccacaactcccaaccctgatgaactacacagaagctcgctagctagacatttggtgtcatcctctcaaccttt

SEQ ID NO: 526 - protein, 200 aa, Arabidopsis thaliana
  G779
MKMENGMYKKKGVCDSCVSSKSRSNHSPKRSMMEPQPHHLLMDWNKANDLLTQEHAAFLNDPHHLMLDPPPETLIHLDEDEEYDEDMDAMKEMQYMIAVMQPVDIDPATVPKPNRRNVRISDDPQTVVARRRRERISEKIRILKRIVPGGAKMDTASMLDEAIRYTKFLKRQVRILQPHSQIGAPMANPSYLCYYHNSQP

SEQ ID NO: 527 - DNA, 2146 bp, Arabidopsis thaliana
  G780
agaaaataggggcaagatctgagatctctgggtgttccatgcaaaactgttatactccgccgtatatttgcatctgggtcacacttctaaaccctatcatttgacttaagaatcgatttctgaagatctgggtttcttaaaagtctttcctttttgttgggatccaaacaacaaaagaaaagaaagcagagatgaatattggtcgcctagtgtggaacgaggacgataaagcgattgttgcgtcattactgggcaaacgagctctcgattacttgctttccaactctgtttccaatgctaatctcttgatgactctaggaagcgacgagaatctgcagaacaagctctcggatctcgtcgagagacccaacgcttctaatttctcttggaactacgccattttctggcagatttccaggtcaaaggccggagatttggttctctgttggggcgatggatattgcagagagcctaaagaaggagagaaatcagagatcgttaggattctaagtatgggaagagaagaagaaacgcatcagactatgagaaagagagtattgcaaaagcttcatgatttgtttggtggctcagaagaagagaactgtgctttaggactagatagagttactgacactgagatgtttcttctttcttctatgtatttctcattccctcgaggtgaaggtggtccaggcaagtgttttgcctctgctaaacctgtttggttatccgatgtcgtcaattcgggttctgattattgcgttagatcgtttcttgctaaatctgctggcattcagactgttgttttggttcctactgatcttggtgttgttgagttaggctcaacttcatgtttgcctgaaagtgaagactcaatcttgtctataagatcattgtttaccagtagtttgcctccggttagagctgttgctttacctgttactgtagctgaaaagattgatgataacagaacgaagatattcggcaaggatttgcacaattcagggtttcttcaacatcatcagcatcaccaacaacaacaacaacaaccaccgcaacagcaacagcatagacagtttagagagaaactcacggttagaaaaatggatgatagagctcccaagagattagatgcttatccgaataatgggaacaggtttatgttttcgaacccaggcaccaacaacaacactcttctgagtcctacttgggttcaacctgagaactacacgaggccaatcaacgtgaaggaagttccaagcacggatgagttcaagtttttacctttgcagcaatcatcgcagaggctgcttcctcctgctcaaatgcagatagatttctctgctgcgagttcaagggcttcagagaataattcagatggagaaggaggaggggaatgggcagatgcagtgggtgctgatgaatctggtaacaacagaccaagaaaacgcggaaggagacctgccaacggaagagcggaagctttgaaccatgtagaagcagagaggcagaggcgtgagaagcttaaccagaggttttacgctctgagatccgttgttcccaacatatccaagatggacaaagcgtccttgttgggagacgcggtttcttatataaacgagcttcacgcgaagctaaaggtcatggaagcagagagagagaggttagggtatagctcaaatccacctatcagcttggattcagatataaatgttcaaacctcaggtgaagatgtcacagtgaggataaactgtccgttggagtctcatccggcttccagaatcttccatgcgtttgaagagagtaaagtagaagtgataaactcgaacctggaagtttctcaggacacagtgttgcatacgtttgtagtcaaatctgaagaattaacgaaagagaagctgatatcggccttgtctagagagcaaacaaattcagttcagtcaagaacatcatcaggtagatagccttttgagagacagaagaaggtggaagtaagtttgtaatcaagaaccggttttgaatggttcttttttttcttctaggtatcttttgtttttacctttttttggttatatacctgtaagaatcctccaaactaggattttagaagttttattgacaaaagtagacattatcatttagaaaa

SEQ ID NO: 528 - protein, 590 aa, Arabidopsis thaliana
  G780
MNIGRLVWNEDDKAIVASLLGKRALDYLLSNSVSNANLLMTLGSDENLQNKLSDLVERPNASNFSWNYAIFWQISRSKAGDLVLCWGDGYCREPKEGEKSEIVRILSMGREEETHQTMRKRVLQKLHDLFGGSEEENCALGLDRVTDTEMFLLSSMYFSFPRGEGGPGKCFASAKPVWLSDVVNSGSDYCVRSFLAKSAGIQTVVLVPTDLGVVELGSTSCLPESEDSILSIRSLFTSSLPPVRAVALPVTVAEKIDDNRTKIFGKDLHNSGFLQHHQHHQQQQQQPPQQQQHRQFREKLTVRKMDDRAPKRLDAYPNNGNRFMFSNPGTNNNTLLSPTWVQPENYTRPINVKEVPSTDEFKFLPLQQSSQRLLPPAQMQIDFSAASSRASENNSDGEGGGEWADAVGADESGNNRPRKRGRRPANGRAEALNHVEAERQRREKLNQRFYALRSVVPNISKMDKASLLGDAVSYINELHAKLKVMEAERERLGYSSNPPISLDSDINVQTSGEDVTVRINCPLESHPASRIFHAFEESKVEVINSNLEVSQDTVLHTFVVKSEELTKEKLISALSREQTNSVQSRTSSGR

SEQ ID NO: 529 - DNA, 1283 bp, Arabidopsis thaliana
  G782
cgaggaggctagagaatcgagaatcgatcttcgccgaaccaccttgtcttctcttagctcatcgaatctctccgtcgccgtcgattcttcccgccggtgaatctctgccttattgttttcttcaatttgatcgtcctgaattcatcgtcctatttagggtttcgatcacaatctgaagaggaggtcatggacgtttctgctagaaagtcacaaaaagctgggcgcgaaaagttgaggagggaaaaactgaatgagcattttgttgaactgggaaatgtactcgatccagagagacccaagaatgacaaagccacgattctgactgatactgttcagttgttgaaagagctcacatctgaagtcaacaaactgaaatctgagtacaccgcattgacagatgagtcccgcgagttgacacaggagaaaaacgacctgagagaagaaaagacatcgctgaaatcagatatagagaatctcaatcttcaataccagcagagattaaggtcaatgtctccatggggagctgcgatggatcacacagtcatgatggctccaccaccctcctttccataccctatgcctattgctatgcctcccgggtcaatcccaatgcatccatcaatgccatcttacacatactttgggaaccagaaccctagcatgatcccagctccatgtcctacatacatgccctacatgcctcctaatacagtcgttgagcaacaatccgtgcacattccacagaaccccggtaaccgttctcgggaacctagagcaaaggtttcaagagagagcagatctgagaaagcagaggactccaacgaagttgcaacacaactcgaattaaaaacccctggatctacttctgataaggatacattgcaaaggccagagaagacaaagagatgtaagagaaacaacaacaacaactcaatagaagaaagctctcattctagcaagtgttcatcttctccgagcgtacgagaccacagttcttccagtagcgtagctggtggccaaaaacctgatgatgcaaaatgattcgaaagaatctgatgttgatcatctcaagtatccaagtatcgtttcgatgagtactgtatatagtgcgagtacaaaatgcacttagctgtttaaagcagtgttttgatgcaccgtggcattcgttttcctcggatagtcatttctcagatgattttcatccttaataggtctgctttagttctaaaactcggatgatttgtaatttccagtgtccaaatctactaattttattaaaaaaa

SEQ ID NO: 530 - protein, 284 aa, Arabidopsis thaliana
  G782
MDVSARKSQKAGREKLRREKLNEHFVELGNVLDPERPKNDKATILTDTVQLLKELTSEVNKLKSEYTALTDESRELTQEKNDLREEKTSLKSDIENLNLQYQQRLRSMSPWGAAMDHTVMMAPPPSFPYPMPIAMPPGSIPMHPSMPSYTYFGNQNPSMIPAPCPTYMPYMPPNTVVEQQSVHIPQNPGNRSREPRAKVSRESRSEKAEDSNEVATQLELKTPGSTSDKDTLQRPEKTKRCKRNNNNNSIEESSHSSKCSSSPSVRDHSSSSSVAGGQKPDDAK

SEQ ID NO: 531 - DNA, 1027 bp, Arabidopsis thaliana
  G783
gtctacagtttccgacgagattctcaccggagaaagaaaggtgacttgacagagaatcttgttctgtaataaaagcaaagatggtatcgaaaactccttctacatcgtctgatgaagcaaatgctactgcagatgaaagatgtagaaaaggtaaagtaccgaaaaggatcaacaaggccgttcgtgagaggcttaagcgtgagcatttgaatgagcttttcattgaattagccgatactcttgaactgaatcaacagaacagtgggaaagcttctatactatgcgaagctactcgattcttgaaggacgtgtttggtcaaattgagtctcttagaaaggagcatgcttctctcctatctgaatctagctatgtaaccacagagaagaatgagctcaaggaagaaacatcagtgcttgagactgagatttcgaaactacaaaacgagattgaagctagagcgaatcagtcgaaacctgacttgaacacctctcctgcacccgagtaccatcatcatcattatcaacaacaacatcctgaacgtgtatctcagttcccaggacttcccattttccaaggccccggctttcaacaatctgctacaactcttcatcctcctgcaacagttcttgtccttccaatacaacctgatccccagacacaagatatctcagaaatgactcaagcgcagcagcctttgatgtttaatagctcaaatgtgagtaacccatgtccaaggtatgctagcgcggctgactcgtggtcttctcggctacttggagagcggctgaaagccagtgaatgaggtcttgaacggctccacatggagtagcaacgcaagttataagacatggcaacttatgaaggactctggttttgtattttttaatacatcgttctgatgtccttgtgggtttggccttggctatttcttgtttttgatggttgttcataggatcaggaagttatggccttgatgggtcgtttgagataaataagtaaattagctcaaaaaaaaaaaaaaaaaaa

SEQ ID NO: 532 - protein, 240 aa, Arabidopsis thaliana
  G783
MVSKTPSTSSDEANATADERCRKGKVPKRINKAVRERLKREHLNELFIELADTLELNQQNSGKASILCEATRFLKDVFGQIESLRKEHASLLSESSYVTTEKNELKEETSVLETEISKLQNEIEARANQSKPDLNTSPAPEYHHHHYQQQHPERVSQFPGLPIFQGPGFQQSATTLHPPATVLVLPIQPDPQTQDISEMTQAQQPLMFNSSNVSNPCPRYASAADSWSSRLLGERLKASE

SEQ ID NO: 533 - DNA, 1201 bp, Arabidopsis thaliana
  G784
ctcggacaaagctgaaatccctaaagaaaaaacacttctccaaacttttcatctccgatatctctttaactaacatgtcgaataatcaagctttcatggaattgggatggagaaacgacgtcggatcacttgctgtgaaagatcagggcatgatgtcagaaagagcaagaagtgatgaagatcgtctaatcaacggtctaaaatggggctacggctactttgatcatgatcaaactgataattatcttcagattgttccagagattcataaagaagtagaaaatgcgaaggaggatttattggttgttgtccctgatgaacattctgaaactgatgatcatcatcatattaaagatttttcagagagatcagatcatcgattttatctgagaaacaaacatgagaaccccaaaaaacgtcgtatccaggtcttaagtagtgatgatgaatcggaggagtttacaagagaagttccttcagttactcgaaaaggttccaagagaagaagaagagacgagaagatgagtaataagatgcgtaagctacagcaactcgtacctaattgtcacaagacggacaaggtttcggttctcgacaagaccatagagtatatgaaaaaccttcaacttcaacttcagatgatgtcaacagtgggggtgaatccttattttcttccggcgacattaggatttggaatgcacaaccacatgctgacggcaatggcttcggctcacggcctaaatccggcgaatcacatgatgccatcgccgctaattccggcgttaaattggccattaccaccgtttactaatatttcattcccacattcatctagtcaatctctatttcttacaacatcatcaccagcttcttctcctcagtctcttcacggtttggttccttatttcccaagtttcttggatttttcttcccatgcgatgagaagactatgataagtaagtagctcgataaaagtttatgtgaaatgatcgttgactaattaagagagaaaagagttccaaattaggacagtttgtgtgaaccatttgtgtcatatacttttttttccgggtggttttgtatattaataataatcaataagttaaaactttttgtataaattcttgcatgtaacaatttttttcatttatctgatattttgtaaaatatattgagacatgcttataagagcaaaaaaaaa

SEQ ID NO: 534 - protein, 292 aa, Arabidopsis thaliana
  G784
MSNNQAFMELGWRNDVGSLAVKDQGMMSERARSDEDRLINGLKWGYGYFDHDQTDNYLQIVPEIHKEVENAKEDLLVVVPDEHSETDDHHHIKDFSERSDHRFYLRNKHENPKKRRIQVLSSDDESEEFTREVPSVTRKGSKRRRRDEKMSNKMRKLQQLVPNCHKTDKVSVLDKTIEYMKNLQLQLQMMSTVGVNPYFLPATLGFGMHNHMLTAMASAHGLNPANHMMPSPLIPALNWPLPPFTNISFPHSSSQSLFLTTSSPASSPQSLHGLVPYFPSFLDFSSHAMRRL

SEQ ID NO: 535 - DNA, 1515 bp, Arabidopsis thaliana
  G786
tttcattgctaattaccaatccgttcaagtttgccaggctgaatatttcagacagttgcttaagcctgtaacgtagtctagcgtctggagttttcggaaattggggttttgagcggctatctacttttgatttcgaaaaaatttactgtgagttgttaaagagtctggtattctgaagagctgtctgtgggggagcttctggtttggggggtaagggctctggtggaaactcgtgatatctttagtatgatggccataacttgatatagcatttggttccgtgtgtcaacttagtgtagtagtaactgagcagctggaagcttacaaaggcgacaaatcggtagtagaaaatattcaagcagcttgcagtttgaggtgtacaacttgtttttctctttgcgtttccttttttacgtttgcacgggttttctgatgcagaacaatcagtttcctcacttctcagatgaagtgggtgacagaaatatgcacaacccgtatgcatcagggtcatcctatgatgctttgttcccaccatgtgcaaagttgccataccatggtgttgaacttcaaccgtctgcggtctgtccaaagaactttgtcatcttcgatcaaacatatgaccgcagccaagtgatgtaccatcctgagctgactcataagctcatgaataccccttcgttgaacaatttagcttcgacgtttcagaacgagtatgttgggggaagttatggtaactatggtaactatgagcaagaagtatcctcttcttatcaagaagatccaaatgagatcgatgctctcttgagcgcagatgaagattatgaagagaatgatgataatgaaggtgaagaggatggtggtgattcagaagaagtcagcactgctcgtacttcttccagggattatggaaacaccacagcagaatcttgttgttccagttatggttacaacaacaacaacaacaacaactcaaggaagcagagtttatcgggcagtgctagtagtagtaacaatgatgggaaaggacgtaaaaagatgaagaagatgatgggagtattgaggagaattgtccctggaggagaacagatgaatacagcttgcgttcttgatgaagctgttcagtatctcaagtcacttaaaatcgaagctcagaaacttggcgttggacatttctcaaaccaatcttgaatgctaccgatatttggttcttccatcactattgtttctcgggaggtaaatcatcggtctagcgctatctggacctttctctttattttcctccctctatactcacttccttttgttggcaggatggtatctattttatgtttgaatctctctatgtattttgctttttgtgtgttactgcttcgatgaagaagcaaggtttgaacaagtacttgtggatttgatttgagattttaatttgtatggttttactttcactgtaatcatttgactatgaactacaattatcattatgtatttgcttctacatagttttaaaaaaaaaaa

SEQ ID NO: 536 - protein, 251 aa, Arabidopsis thaliana
  G786
MQNNQFPHFSDEVGDRNMHNPYASGSSYDALFPPCAKLPYHGVELQPSAVCPKNFVIFDQTYDRSQVMYHPELTHKLMNTPSLNNLASTFQNEYVGGSYGNYGNYEQEVSSSYQEDPNEIDALLSADEDYEENDDNEGEEDGGDSEEVSTARTSSRDYGNTTAESCCSSYGYNNNNNNNSRKQSLSGSASSSNNDGKGRKKMKKMMGVLRRIVPGGEQMNTACVLDEAVQYLKSLKIEAQKLGVGHFSNQS

SEQ ID NO: 537 - DNA, 952 bp, Arabidopsis thaliana
  G787
ccccattcgcgttcttatataaagctcacagttcgagagagacaagagaccaacgaaacgaactagagacagtttgattcgaaaatcttgtcggaaaatggaggatatcgtcgaccaagaattaagcaattactgggaacctagctccttcctccaaaacgaagacttcgaatacgacagaagctggcctttggaagaagccatttctgggtcgtatgattcgagttcgccggatggagctgcttcgtcgccggcttctaagaatattgtgtcggagagaaacagaagacagaaacttaaccagagactcttcgctcttcgatcagttgttcccaatatcactaagatggataaagcctcaataatcaaagatgctattagttacatagaaggattacaatatgaagaaaagaagctcgaagctgagatcagagaacttgaatctacaccaaagagtagccttagtttcagcaaagattttgatcgtgatttacttgttcctgtcacatccaagaagatgaagcagcttgattctggttcttccacttctctcatcgaagttctcgaattgaaggtaacattcatgggagagaggacaatggtggtgagtgtaacatgtaataagaggacagatacaatggtgaaactgtgtgaagtctttgagtcattgaatctcaaaatcctcacttccaatctcacctctttctctggcatgatcttccacactgtctttattgaggcggatgaagaagaacaagaggtgttgcggttaaaaatagaaacaggaataggagcttataatgaaactcaaagccctactttgagcatcgactctctttactaataatactttttttcttccttttttggttcattttggcttctctctttacaataatgtatgtctctcttttcatttttatgatctcctacgtttgtttgtcccacccaa

SEQ ID NO: 538 - protein, 248 aa, Arabidopsis thaliana
  G787
MEDIVDQELSNYWEPSSFLQNEDFEYDRSWPLEEAISGSYDSSSPDGAASSPASKNIVSERNRRQKLNQRLFALRSVVPNITKMDKASIIKDAISYIEGLQYEEKKLEAEIRELESTPKSSLSFSKDFDRDLLVPVTSKKMKQLDSGSSTSLIEVLELKVTFMGERTMVVSVTCNKRTDTMVKLCEVFESLNLKILTSNLTSFSGMIFHTVFIEADEEEQEVLRLKIETGIGAYNETQSPTLSIDSLY

SEQ ID NO: 539 - DNA, 1913 bp, Arabidopsis thaliana
  G789
ggcaagaagaaccttagcctctctttcttctttctctctctctctctctgtggtactgttctgtttcaactttactccctcagtttcagaacaattccctatctagaagagagataaaaccgagaaggttttggagatagaatcttttgttcttcttttgtccctccttgctcgatttttgttacgtgtgaagcaataaaaaaaaactgatatagctaaatcttccatccattcagaggcttctaaatctgatctgacatggaacaagtgtttgctgattggaattttgaagataattttcacatgtccactaataaaagatcaatcagaccagaagatgaattagtggagctattgtggagagatggtcaagtggttttacaaagccaagctcgtagagaaccgtcagtccaagtccaaacccacaaacaagaaaccctaagaaaacccaacaatatttttcttgacaaccaagaaacagtacaaaagcctaactacgctgctctagatgatcaagaaaccgtctcctggatacaataccctccggatgacgtcatcgaccctttcgaatccgagttctcctctcatttcttctcttcgatcgatcacctcggaggtcctgagaagccacgaacgatcgaagagacagttaagcatgaggctcaagccatggctcctcctaagtttagatcctcggttataacagtcggaccgagtcattgcggcagcaaccagtcaacaaatattcatcaggccactacacttccggtttctatgagtgatagaagcaagaacgtcgaagaaagacttgacacttcgtcaggtggctcctccggttgcagctatggaaggaacaacaaagaaaccgttagtggaacaagtgtaaccattgaccgtaaaagaaaacatgttatggatgctgatcaagaatctgtgtctcaatcagatataggtttgacctcaaccgatgatcaaaccatgggtaacaaatcgagccaacggtcaggatctactcgaagaagccgtgcagctgaagttcataatctctcagaaaggaggaggagagatcggatcaatgaaagaatgaaagctcttcaagaactcatacctcactgcagcagaacagataaagcttcgatattggatgaagcaattgattacttaaaatcacttcaaatgcaactccaagtgatgtggatgggaagtggaatggcggcggcggcagcagcagcagcaagtccgatgatgtttcccggggtacaatcatctccatacattaatcagatggctatgcaaagtcagatgcaattgtctcaattcccggttatgaaccggtccgctccgcagaaccatcccggtttagtatgtcaaaacccggtacagttgcagctccaagcacagaaccaaatcttatcggagcagctcgctaggtacatgggcgggattccccagatgccgccggcgggaaatcagatgcagaccgtgcaacaacaaccagcggacatgttgggatttggatctccggcgggaccgcaaagtcaactgtcggcaccggcgaccaccgacagtcttcatatgggtaaaataggctgacttggcatatagttttcctccgaaattattcttcttacagttggtgattgttatttatttttggtcgcctaagcaagcataaaagctaagtcaaatgtattatagagatctaataagttagtctcatacttataacttatttttaaacagttgaattatagtatcaatcaagtgttgggaacctaaagatcatacatgtgtcaatacttttatatttgttctcaaggttcatcagaaaaacaaaataaaaaggatagactaggcctgcatttgacattatcatgggcttttttgggtctatgaatatgaacattaacccc

SEQ ID NO: 540 - protein, 444 aa, Arabidopsis thaliana
  G789
MEQVFADWNFEDNFHMSTNKRSIRPEDELVELLWRDGQVVLQSQARREPSVQVQTHKQETLRKPNNIFLDNQETVQKPNYAALDDQETVSWIQYPPDDVIDPFESEFSSHFFSSIDHLGGPEKPRTIEETVKHEAQAMAPPKFRSSVITVGPSHCGSNQSTNIHQATTLPVSMSDRSKNVEERLDTSSGGSSGCSYGRNNKETVSGTSVTIDRKRKHVMDADQESVSQSDIGLTSTDDQTMGNKSSQRSGSTRRSRAAEVHNLSERRRRDRINERMKALQELIPHCSRTDKASILDEAIDYLKSLQMQLQVMWMGSGMAAAAAAAASPMMFPGVQSSPYINQMAMQSQMQLSQFPVMNRSAPQNHPGLVCQNPVQLQLQAQNQILSEQLARYMGGIPQMPPAGNQMQTVQQQPADMLGFGSPAGPQSQLSAPATTDSLHMGKIG

SEQ ID NO: 541 - DNA, 1107 bp, Arabidopsis thaliana
  G791
ttttctttgggtgttccttccaccaacggcagaaatcgattcggcttaaatctccccctcctttcgatctctctgatcgccgccgggaacattcaatttcccgggagttcaacaaaaaaaaaactctccgtttttatttttccccctttttcaccggtggaagtttccggagatggtgtcacccgaaaacgctaattggatttgtgacttgatcgatgctgattacggaagtttcacaatccaaggtcctggtttctcttggcctgttcagcaacctattggtgtttcttctaactccagtgctggagttgatggctcggctggaaactcagaagctagcaaagaacctggatccaaaaagagggggagatgtgaatcatcctctgccactagctcgaaagcatgtagagagaagcagcgacgggacaggttgaatgacaagtttatggaattgggtgcaattttggagcctggaaatcctcccaaaacagacaaggctgctatcttggttgatgctgtccgcatggtgacacagctacggggcgaggcccagaagctgaaggactccaattcaagtcttcaggacaaaatcaaagagttaaagactgagaaaaacgagctgcgagatgagaaacagaggctgaagacagagaaagaaaagctggagcagcagctgaaagccatgaatgctcctcaaccaagttttttcccagccccacctatgatgcctactgcttttgcttcagcgcaaggccaagctcctggaaacaagatggtgccaatcatcagttacccaggagttgccatgtggcagttcatgcctcctgcttcagtcgatacttctcaggatcatgtccttcgtcctcctgttgcttaatcaagaaaaatcatcaaccggtttgcttcttgcttccgcttaaaagaaaagtctccatttgttttgctctcctctctttctcggctttcttagtcttatccttttgctttgtcgtgttatcatcgtaactgttatctgttgaacaatgatatgacattgtaaactccaattgcttcgcgcaatgttatctattcacatgtaaatttaagtagagtttggcaaaaaaaaaa

SEQ ID NO: 542 - protein, 234 aa, Arabidopsis thaliana
  G791
MVSPENANWICDLIDADYGSFTIQGPGFSWPVQQPIGVSSNSSAGVDGSAGNSEASKEPGSKKRGRCESSSATSSKACREKQRRDRLNDKFMELGAILEPGNPPKTDKAAILVDAVRMVTQLRGEAQKLKDSNSSLQDKIKELKTEKNELRDEKQRLKTEKEKLEQQLKAMNAPQPSFFPAPPMMPTAFASAQGQAPGNKMVPIISYPGVAMWQFMPPASVDTSQDHVLRPPVA

SEQ ID NO: 543 - DNA, 1008 bp, Arabidopsis thaliana
  misc_feature (993)..(993): n is a, c, g, or t
  misc_feature (995)..(995): n is a, c, g, or t
  misc_feature (1007)..(1007): n is a, c, g, or t
  G792
tcttttttcttccgtttttccacacattgtctctacctttccctttttcagatttgaccctttgttttcaaaagaaacgatttttagtagccgccggggaatcaggagaatggtgtctccggagaatacgaactggcttagtgattaccctttgattgaaggtgctttctctgatcagaaccccactttcccttggcagatagatggctcagctactgtcagtgttgaagtggatggcttcctttgtgatgcagatgtgatcaaagaaccaagttcaaggaagaggatcaaaactgaatcttgcactggttctaactcgaaagcttgtagggagaaacaaagacgtgatagactaaatgacaagtttacggagttgagttccgtattggaacctgggagaactccaaaaacagacaaggttgctattatcaatgatgcaattcgcatggtgaatcaagcaagagatgaagcgcagaaactaaaggacttgaactcaagcctccaggagaaaatcaaggagttgaaggatgagaagaacgagctgcgtgatgagaaacagaagcttaaggtcgagaaggagagaatcgatcagcaactgaaagctattaagacacagcctcagcctcaaccttgtttcttaccaaatccgcaaacactctctcaagctcaagctcctggaagcaagcttgtccctttcacaacttatcccggctttgcaatgtggcaattcatgcctcctgctgctgttgatacctcacaggaccatgtccttcgtcctccagttgcttaaagctgctgcttctctctactactattaacggttctgtaagattacttcttacgcgcttttttctgatgtaatgattctcacattctgtgattggtgacatagtccactgcaacttaaaatgtaaaattgaaataagcttgcactaaaaatcaaatctcattgtgcaaaaagttggataatttggaaatcattgttttacaaananaaaaccccccgng

SEQ ID NO: 544 - protein, 226 aa, Arabidopsis thaliana
  G792
MVSPENTNWLSDYPLIEGAFSDQNPTFPWQIDGSATVSVEVDGFLCDADVIKEPSSRKRIKTESCTGSNSKACREKQRRDRLNDKFTELSSVLEPGRTPKTDKVAIINDAIRMVNQARDEAQKLKDLNSSLQEKIKELKDEKNELRDEKQKLKVEKERIDQQLKAIKTQPQPQPCFLPNPQTLSQAQAPGSKLVPFTTYPGFAMWQFMPPAAVDTSQDHVLRPPVA

SEQ ID NO: 545 - DNA, 1420 bp, Arabidopsis thaliana
  G793
cattctctcacctaacaactccacacaagattcttcgcatggaaagttgttcttcgacttctcttctctaactcgctatcttttaactcacccagctccactgagtcgaaaatttcaaacctttactcgtttccttcatggctaataacaacaacatcccacatgatagcatctccgatccatctcctaccgacgatttcttcgagcagatcctcgggctttccaacttctccggttcttcaggttctggtctctctggaatcggcggcgtgggtccacctccgatgatgcttcagcttggttcaggcaacgaagggaatcataatcatatgggtgccattggaggaggtggacctgtagggtttcataatcagatgtttccgttgggattaagtctcgatcaagggaaaggacatggctttcttaaacctgatgaaactggtaaacgtttccaagacgatgttcttgataatcgatgttcctctatgaaacctattttccatgggcagccaatgtcacagccagctccaccaatgccgcatcaacagtctactattcggcctagagttagggctaggcgaggtcaagctaccgatccacatagcatcgctgagaggctccgaagggaaagaatagcagaacggatcaggtcgttgcaggaacttgtacctaccgttaacaagacagatagggctgctatgatcgacgagattgtcgattatgtaaagtttctcaggctccaagttaaggtcctgagcatgagccgtcttggtggagccggtgctgtcgcaccactagtcactgaaatgccattatcttcatcagttgaggatgagacgcaggccgtgtgggagaaatggtcaaacgatgggacagagaggcaagtggctaagctgatggaagaaaacgttggagcagcgatgcaacttttgcaatcaaaggctctttgcataatgccgatctcattggcaatggcgatttaccattctcagccaccagacacatcttcttcaatcgtcaaaccagagatgaatcctccaccgtagatttttgttcatccaacggtccccagctgatgattgacattttgctctgtttcccactactagacttttgtgactcatgaaaggtaagtaaaaaggcattggagatggaatctaagtaggatttgtgcagtaaagaagtaaaacgggatctgtcaaaagaaggaaaaagctctcgcttgcttggctagtatttatcattttgatgaaagtaactcttttttgttcaaagactttagtgtgattttcaggaccaagggctttgagggtagtgctagctgtagtaatagtaatgaaggtgtgggatcgtgtttttgaattatgtaaaaaaggaagaaaaaacaaatgttggtattatattatggttttgcctgaaa

SEQ ID NO: 546 - protein, 302 aa, Arabidopsis thaliana
  G793
MANNNNIPHDSISDPSPTDDFFEQILGLSNFSGSSGSGLSGIGGVGPPPMMLQLGSGNEGNHNHMGAIGGGGPVGFHNQMFPLGLSLDQGKGHGFLKPDETGKRFQDDVLDNRCSSMKPIFHGQPMSQPAPPMPHQQSTIRPRVRARRGQATDPHSIAERLRRERIAERIRSLQELVPTVNKTDRAAMIDEIVDYVKFLRLQVKVLSMSRLGGAGAVAPLVTEMPLSSSVEDETQAVWEKWSNDGTERQVAKLMEENVGAAMQLLQSKALCIMPISLAMAIYHSQPPDTSSSIVKPEMNPPP

SEQ ID NO: 547 - DNA, 1410 bp, Arabidopsis thaliana
  G795
cgaaaaaataaaagaggaatcaattttttcatatatagccaaagtcacatagtgattcttctccaatcaaatctctatcaacaatgacaagcttgcacaaaaccctcttcacacaaaatcccactactttagatcaactcatgatgtgccacacgggaagagacaattcatggaaaaaactagaaaacatagacgaagaaggtccatcgacggtggcacgtgaagtgaggacggcgttaccaccggagacgccaacggagatgatggagttcttggggagatcatggagcatttccgccgtcgaactcacgagagcttttttcaacaattccactgccgacactaactcttttcttctatctactatcgttaacaccaacaaagaagacagagaagatgaagaagattctacttccatggcttcttctcgtgaccttctgctgccacatgtgggaaataagaccagccctccaataactccaagaaccggtagagaaatgaagcatttgtacaagagcatgataagaggaagaacaatgggaagaagattaaaggatcagaaggagaagaagaaacaagagaccagaactcgcaacgctgagattcacgccgcggtctctgtcgcaggagtagctgcagttgttgccgcaaccgcagcatctaacgctattgcggccgcagaagatgcggttgaatcaacaaccgttgcagctgcaatggcatctgcagctgctctcatcgcttcacattgcatcgagatagcgggagagattggggcgggttataaccagattgccacggctgttagctccgcgaccaatgctaggactaacggagacattatggctttaacggcaagtgctgcaacagcgttgcgaggagctgcgattctaaggtcacgaatggaaaggaacaacgagaacaaagcaatgctatatgcaacaaaggagcacgtcgtagaaatggaagagagaaatgtatttggagcgatgactttcgtctctagaggagaagagcttctcaaacgcacccgcaaaggggatcttcattggaagcaagtatcttttaacatcaattccaattggcaagtggttcttaaaatgaagagcaaacatgtgggtggaactttcacgaagacgaagaaatgcgttgtcaatggagtgtgccgagatatacccgaatgggcacatagaggacgagcagataaaatggtagagcgaagagcctactttggggtgaaaacagtggaaagggtgattgaattcgaatgtggaaacaaaagagagaagcaaatgtggatagaggggattcaacagttgcttaactcactcgaaatcggttctagtgttcaatggaaacattagagttaggatcaaattaaaacactatttcacatttgaacatcatgta

SEQ ID NO: 548 - protein, 426 aa, Arabidopsis thaliana
  G795
MTSLHKTLFTQNPTTLDQLMMCHTGRDNSWKKLENIDEEGPSTVAREVRTALPPETPTEMMEFLGRSWSISAVELTRAFFNNSTADTNSFLLSTIVNTNKEDREDEEDSTSMASSRDLLLPHVGNKTSPPITPRTGREMKHLYKSMIRGRTMGRRLKDQKEKKKQETRTRNAEIHAAVSVAGVAAVVAATAASNAIAAAEDAVESTTVAAAMASAAALIASHCIEIAGEIGAGYNQIATAVSSATNARTNGDIMALTASAATALRGAAILRSRMERNNENKAMLYATKEHVVEMEERNVFGAMTFVSRGEELLKRTRKGDLHWKQVSFNINSNWQVVLKMKSKHVGGTFTKTKKCVVNGVCRDIPEWAHRGRADKMVERRAYFGVKTVERVIEFECGNKREKQMWIEGIQQLLNSLEIGSSVQWKH

SEQ ID NO: 549 - DNA, 1009 bp, Arabidopsis thaliana
  G801
gatagtgataacgaaatcctaattccatggccgacaacgacggagcagtgagtaacggcatcatagtcgagcagacgtcaaacaaaggacctcttaacgccgttaagaaaccaccgtctaaagatcgacacagcaaagttgacggaagaggaagaaggattcgtatgccaatcatttgcgcagctcgagtttttcaattgaccagagagttaggtcacaagtccgatggtcaaaccatagagtggcttctccgtcaagctgagccttctatcatagccgccactggaactggcactactccggcgagtttctccactgcttctctctccacttcttctccgtttactctcgggaaacgtgtcgtcagagcggaggaaggagaatccggcggcggaggaggaggagggttaacagtgggacacacaatggggacttcgttaatgggtggtggtggttctggtgggttttgggctgttccggcgaggccggatttcggacaagtctggagctttgcaaccggagctccaccggaaatggtttttgcgcagcagcagcaaccagctacactcttcgtccgccaccagcagcaacagcaagcttccgccgccgcagcagctgcaatgggtgaggcttcagcagctagagttgggaattatcttccgggtcatcatctcaatttgcttgcttctttgtctggtggagctaacgggtcgggtcggagggaagacgaccacgaaccacgttgagaaatggtattgtctttttggtaatgtatagaaaaattcctatgttttatgtcatcgaaagtgtttagaaagtacctctaatttgcggtttcttttgctccttttttacttaatttaagcttattgcttgtttgattagggttttagggtttaagaatatttggtctcgttaatttgtttcggagagtgatagaaagagagagagattgattgattgttgtacctaaaacgctataaaagctctgtttttactagcgaaaaaa

SEQ ID NO: 550 - protein, 239 aa, Arabidopsis thaliana
  G801
MADNDGAVSNGIIVEQTSNKGPLNAVKKPPSKDRHSKVDGRGRRIRMPIICAARVFQLTRELGHKSDGQTIEWLLRQAEPSIIAATGTGTTPASFSTASLSTSSPFTLGKRVVRAEEGESGGGGGGGLTVGHTMGTSLMGGGGSGGFWAVPARPDFGQVWSFATGAPPEMVFAQQQQPATLFVRHQQQQQASAAAAAAMGEASAARVGNYLPGHHLNLLASLSGGANGSGRREDDHEPR

SEQ ID NO: 551 - DNA, 1604 bp, Arabidopsis thaliana
  G802
gctctctctctcttctcgagacaaagaagaagacaagagtcaaacttgaaggcgacaatcggagcttccatggccgtttcttcctctttcaccaaaccctaatttcaatttcatcttcttttcccttctttctcaccggaaaatggatctctccgacatccgaaacaacaacaacgacaccgccgccgtcgccaccggaggaggagcaagacagctagttgacgcatctctctcaatcgttcccagatctacacctcccgaagactcaacactcgcaacaacctcatctacggcaacggcgactacaacgaagcggtcgactaaagaccgtcacacgaaagtcgacggaagaggacgtcggattcgtatgccggcgctatgtgcagctagagtttttcagttaacgagagagttaggtcataaatccgatggtgaaactattgaatggcttcttcaacaagctgagccagctattgttgctgctacaggtacaggaactattccggcgaacttctctactttaagtgtttcgttacgaagtagtggatcgactctctctgctccgccgtcgaaatcggtgccgctttacggtgctcttggattgactcatcatcagtatgatgaacaaggaggcggcggtgtgtttgctgctcatacgtcgccgcttttagggtttcatcatcagcttcaacaccaccagaaccagaatcagaatcaagatccggtggaaactattcctgaaggtgagaatttctctaggaaacggtatagatcggttgatttgtctaaagaaaacgatgatcggaaacagaacgagaataaatctttgaaagaaagtgaaacgtcgggtcctacggcggcgccgatgtgggcggttgcgccgccgagtaggtctggtgctgggaacactttttggatgcttccggtaccgacaacggccggtaatcaaatggagagtagtagcaacaataacaccgccgcaggccaccgtgctcctcctatgtggccatttgtgaactctgctggaggaggagcgggaggtggaggcggagcagcgactcactttatggcgggaacggggtttagttttccgatggatcagtacagaggaagtccacttcagttaggttcttttttagctcagccgcagccgactcagaacttaggactaagtatgccggactcgaatctcgggatgttagccgctttgaactcggcttattcaagaggcggaaacgcaaacgcgaatgcggaacaagcgaacaatgcggtggagcatcaagagaagcagcaacagagtgatcatgatgatgatagtagagaggagaactcaaatagctctgagtgagtgatgtaaactaatcttgtgaaatcattgaatgtggtaagaaattgatttaaagcgtttgtagcggtttggttgattgttttattgtgagattttgtgtgttgttgtttagtagtgtttagacaagaacaatttatgtgtgaaggaattgttaggtttgggtccaaatggactctcatgggtagagaatgttttcaatgtatagaaggaatgatagtcttttcgatttttcagttttcaaaaaaaaaaaaaaaaa

SEQ ID NO: 552 - protein, 401 aa, Arabidopsis thaliana
  G802
MDLSDIRNNNNDTAAVATGGGARQLVDASLSIVPRSTPPEDSTLATTSSTATATTTKRSTKDRHTKVDGRGRRIRMPALCAARVFQLTRELGHKSDGETIEWLLQQAEPAIVAATGTGTIPANFSTLSVSLRSSGSTLSAPPSKSVPLYGALGLTHHQYDEQGGGGVFAAHTSPLLGFHHQLQHHQNQNQNQDPVETIPEGENFSRKRYRSVDLSKENDDRKQNENKSLKESETSGPTAAPMWAVAPPSRSGAGNTFWMLPVPTTAGNQMESSSNNNTAAGHRAPPMWPFVNSAGGGAGGGGGAATHFMAGTGFSFPMDQYRGSPLQLGSFLAQPQPTQNLGLSMPDSNLGMLAALNSAYSRGGNANANAEQANNAVEHQEKQQQSDHDDDSREENSNSSE

SEQ ID NO: 553 - DNA, 1231 bp, Arabidopsis thaliana
  G805
tatagagagaggaaaaaactatggctcacataaagatctaacagagacagtagtatagtcccacttcccccccaccaaagcttcgatcatcatcatcatcatcatcatggatccggatccggatcataaccatcgacccaacttccctctccagcttcttgattcttctacctcctcctcttccacttccttagccatcatctctactacttccgaacctaactccgaacctaagaagcctcctcctaaacgaacctctactaaagaccgacacaccaaagtcgaaggccgaggccgtcggatccgtatgcctgccatgtgtgctgcacgtgtctttcagctcacacgtgagcttggtcacaaatccgacggtgaaactattgagtggctactccaacaagcagaaccagcggttatagccgctacagggactggaaccattccggctaacttcacttctttaaacatctcacttcgtagctcaagatcttctctctctgctgctcatcttcgtacaactcctagtagctattactttcattcaccacatcagtccatgactcatcatcttcaacatcagcatcaggttcgtcccaagaacgagtcacattcttcgtcttcttcttcttcacagcttttagatcacaaccaaatgggtaactatctagtacaatcaactgctggatctttacctacgagtcagagtcctgcaacggcaccgttttggagtagtggtgacaacacacagaatctttgggcttttaatattaatcctcatcattccggtgttgtcgccggagatgtttacaaccccaacagtggtggtagtggcggcggtagtggagttcatttgatgaattttgcagctcctattgctttgttttctggacagcctttggcttctggttatggaggaggaggaggtggcggtggagaacatagccattatggagttttagcggcgttgaatgctgcttaccgaccggtggcggagacggggaaccataacaacaaccagcaaaaccgtgacggagatcatcatcacaaccatcaagaagatggaagcaccagtcatcattcctaggcaaacatacacaaacaaatatattctgtgagatttatttttctttttttgtcctttcgtttgtttgtttgttcttaacaagcgtgttttttttgcattgcttctttttcatatatttttatttatttctaaattctaataaaaaaa

SEQ ID NO: 554 - protein, 325 aa, Arabidopsis thaliana
  G805
MDPDPDHNHRPNFPLQLLDSSTSSSSTSLAIISTTSEPNSEPKKPPPKRTSTKDRHTKVEGRGRRIRMPAMCAARVFQLTRELGHKSDGETIEWLLQQAEPAVIAATGTGTIPANFTSLNISLRSSRSSLSAAHLRTTPSSYYFHSPHQSMTHHLQHQHQVRPKNESHSSSSSSSQLLDHNQMGNYLVQSTAGSLPTSQSPATAPFWSSGDNTQNLWAFNINPHHSGVVAGDVYNPNSGGSGGGSGVHLMNFAAPIALFSGQPLASGYGGGGGGGGEHSHYGVLAALNAAYRPVAETGNHNNNQQNRDGDHHHNHQEDGSTSHHS

SEQ ID NO: 555 - DNA, 2307 bp, Arabidopsis thaliana
  G820
gggaaagaaagaaacttgactgctaattgctaaaggtaatgcttctgagaattggaagctaatgaagctcttcctcaatagcaatctgctcagaaactctattttcttcaagatctccgcctttgttttgatctccgttgcttgtttcttcctcggtaagcattggtctgaggatggcttccgccgtctcatcttcttctccgccgagccttcccgatctcccattgtcgcactctcacctgatttcggaaaaacctataacatctctggtttgatctatgagagtcacccgattttgcctccgtctttgtcaccaccgccgccgccagattctgttgagttgaaggtgtttggaatcgttaatgagaacggaacaatgtctgatgagtttcagattggtgattacgacgttgagtcggcggagacgttggggaatcagacggaattcgagagtagcgacgacgatgatattaaatccaccacagctagagttagtgtgaggaaatttgagatttgttcggagaatatgactgagtacattccttgtttggataatgtagaagccatcaaaaggcttaattcaacggcgcgtggtgagcgattcgaacggaattgtcctaacgatggaatgggattgaattgcaccgttccgattcctcaaggataccgtagtccgattccgtggccgagaagccgtgatgaggtgtggttcaacaatgttccacatactaaacttgttgaagacaaaggtggtcaaaattggatttataaagagaatgacaaatttaagtttcctggtggtggtactcagtttatacacggagctgatcagtacttggatcagatctctcagatgattcctgatattagctttggtaaccatacacgagttgttcttgacattggatgtggtgtggcaagttttggtgcctacttaatgtcacgaaatgtcttgactatgtctatagctccaaaagatgttcacgagaaccagatacagtttgctcttgagcgtggtgttcctgcaatggtggcagcattcacaacacggagattgttgtatccaagccaagcttttgatttggtacattgttcaagatgtagaatcaactggactcgtgatgatgggatcctgctccttgaagttaataggatgcttcgtgccggaggatattttgtttgggcagcacaacctgtatataagcatgaaaaggccttggaagaacagtgggaagagatgctaaacctgaccactaggctgtgctgggttcttgtaaagaaggaaggatatatagctatctggcagaagcctgtaaataacacttgttacctaagtcgtggtgctggagtcagtcctcctttgtgcaattctgaagatgacccagataatgtttggtacgtggatctgaaggcatgcatcactagaattgaagaaaatggatatggagcaaatcttgctccttggccagctcgtttactgaccccaccggataggctgcagacaatacaaattgattcatacatagcccgaaaagagctatttgtagccgaatcaaagtactggaaagaaataatatcaaactatgtaaatgccctacactggaagcagataggactcagaaatgtcttggacatgagagctggatttggcggatttgcagctgcattagctgagctaaaggttgactgctgggttcttaacgtcatcccagtgagtggtcccaacacattgcctgttatatatgaccgtggactgcttggagttatgcacgattggtgtgaaccttttgatacttacccaagaacctacgatttgctgcatgctgcgggtctgttttccattgaaagaaaaagatgcaacatgacaacaatgatgctagagatggaccggattttaagacctggaggacgtgtatacatacgggacacaatcaatgtaacgagtgagcttcaagagattggaaacgcaatgaggtggcacacgagcttacgtgaaactgctgaaggacctcactcaagttacagggttctcttatgtgagaagcggtttgaatcgtctgagaagcgtcgtaccaagaagaggaggaagactaaaggaaaaagagcttgacattttcatagaatacaagtgctgggctagaattttctggggatctttggatcaatggacaatggttagtttagttgggaggctttttggaattttagaaaaattagggacctgaaacagtgaaactgtttgtgaggttttggcgtttaaccctctttaaagttgattgaaaccggattaaactcacttaacccaaa

SEQ ID NO: 556 - protein, 682 aa, Arabidopsis thaliana
  G820
MKLFLNSNLLRNSIFFKISAFVLISVACFFLGKHWSEDGFRRLIFFSAEPSRSPIVALSPDFGKTYNISGLIYESHPILPPSLSPPPPPDSVELKVFGIVNENGTMSDEFQIGDYDVESAETLGNQTEFESSDDDDIKSTTARVSVRKFEICSENMTEYIPCLDNVEAIKRLNSTARGERFERNCPNDGMGLNCTVPIPQGYRSPIPWPRSRDEVWFNNVPHTKLVEDKGGQNWIYKENDKFKFPGGGTQFIHGADQYLDQISQMIPDISFGNHTRVVLDIGCGVASFGAYLMSRNVLTMSIAPKDVHENQIQFALERGVPAMVAAFTTRRLLYPSQAFDLVHCSRCRINWTRDDGILLLEVNRMLRAGGYFVWAAQPVYKHEKALEEQWEEMLNLTTRLCWVLVKKEGYIAIWQKPVNNTCYLSRGAGVSPPLCNSEDDPDNVWYVDLKACITRIEENGYGANLAPWPARLLTPPDRLQTIQIDSYIARKELFVAESKYWKEIISNYVNALHWKQIGLRNVLDMRAGFGGFAAALAELKVDCWVLNVIPVSGPNTLPVIYDRGLLGVMHDWCEPFDTYPRTYDLLHAAGLFSIERKRCNMTTMMLEMDRILRPGGRVYIRDTINVTSELQEIGNAMRWHTSLRETAEGPHSSYRVLLCEKRFESSEKRRTKKRRKTKGKRA

SEQ ID NO: 557 - DNA, 2079 bp, Arabidopsis thaliana
  G831
ttctttcatcgttgtgtctattataaatatatgtcaatttggtttctaaaaaattctaccattgattgattgatttttttttctttaagagatgaatttatttacaagaatctcatctcggactaagaaggccaatctttactacgtaaccctagttgctcttctctgcatcgctagctaccttctcggtatttggcaaaacacggcggttaatccacgcgccgccttcgatgattcagacggtacaccgtgcgagggattcaccagacctaattctacgaaagatctcgacttcgacgcgcatcacaacattcaagatccacctccggtgacggaaaccgccgttagtttcccgtcgtgtgccgccgcgttgagcgagcacacgccatgcgaagacgcgaagcgatcgttgaaattctcgagggagagattggagtataggcaaaggcattgtcccgagagagaagaaatcttgaagtgcagaattccggcgccgtacggttacaaaacgccgttccgatggccggcgagtcgtgacgtggcgtggttcgctaatgtgcctcacacggagcttacggttgagaaaaagaatcagaattgggtccggtacgagaatgatcggttttggttccctggtggaggtacgatgtttccacgtggcgctgatgcttacattgatgatatcggacggttgattgatctcagcgacggctctatccgtacagccatcgataccggttgcggggtggctagcttcggtgcatatcttttatcaagaaacattacaacgatgtcatttgcaccaagagacacacacgaagctcaagtccagttcgcactcgagcgtggtgtgccggcgatgatcggaatcatggctacaatccgcctaccgtacccttctagagcctttgatttagcacattgctctcgttgccttattccgtggggccaaaacgatggggcttacttgatggaggtggatagggttttaagaccaggagggtactggatactttctggaccgccgattaattggcagaaacggtggaaagggtgggaacggaccatggatgatttgaatgcagagcagactcagatcgagcaggtcgcgagaagcttgtgttggaagaaagttgttcaaagagatgatcttgctatttggcaaaaaccctttaaccacattgactgtaagaaaaccagagaggttttgaaaaatccggagttttgtcgtcatgatcaagatcccgacatggcctggtatacgaagatggattcttgtttgacaccattacctgaagttgatgacgctgaggatctaaagacggtggccggagggaaggtagaaaagtggccggctagattaaacgcgattcctccgagagtaaacaaaggcgctctcgaggaaatcacacctgaagctttcttggagaacacgaaactgtggaaacagagagtttcttattacaagaagttagattaccagttgggtgaaaccgggagatacagaaacttagtcgacatgaacgcttacctcggtggattcgcggcggctctagcggatgatccggtctgggtcatgaacgttgtcccggtcgaggctaagctcaatacgctcggtgtcatctacgagcgtggtctaatcggaacgtatcaaaactggtgtgaagccatgtcgacgtatccaagaacgtatgattttatccatgctgactcggttttcacattgtaccaaggtcaatgtgaaccggaggagatattgttggagatggaccgaattcttagaccgggtggtggtgtgattataagagatgacgtggacgttttgatcaaggttaaggaattaaccaaaggattagaatgggaaggtagaattgctgaccacgagaagggtcctcatgaaagagagaagatttactatgcggtgaaacagtattggaccgttcctgcgcctgatgaagataaaaacaacactagtgctctctcctgatttttgagttttttttttcttacaatgttttttttttttttttttcaattttttatacaacaataaattctcaataattgttgtcgcggccg

SEQ ID NO: 558 - protein, 631 aa, Arabidopsis thaliana
  G831
MNLFTRISSRTKKANLYYVTLVALLCIASYLLGIWQNTAVNPRAAFDDSDGTPCEGFTRPNSTKDLDFDAHHNIQDPPPVTETAVSFPSCAAALSEHTPCEDAKRSLKFSRERLEYRQRHCPEREEILKCRIPAPYGYKTPFRWPASRDVAWFANVPHTELTVEKKNQNWVRYENDRFWFPGGGTMFPRGADAYIDDIGRLIDLSDGSIRTAIDTGCGVASFGAYLLSRNITTMSFAPRDTHEAQVQFALERGVPAMIGIMATIRLPYPSRAFDLAHCSRCLIPWGQNDGAYLMEVDRVLRPGGYWILSGPPINWQKRWKGWERTMDDLNAEQTQIEQVARSLCWKKVVQRDDLAIWQKPFNHIDCKKTREVLKNPEFCRHDQDPDMAWYTKMDSCLTPLPEVDDAEDLKTVAGGKVEKWPARLNAIPPRVNKGALEEITPEAFLENTKLWKQRVSYYKKLDYQLGETGRYRNLVDMNAYLGGFAAALADDPVWVMNVVPVEAKLNTLGVIYERGLIGTYQNWCEAMSTYPRTYDFIHADSVFTLYQGQCEPEEILLEMDRILRPGGGVIIRDDVDVLIKVKELTKGLEWEGRIADHEKGPHEREKIYYAVKQYWTVPAPDEDKNNTSALS

SEQ ID NO: 559 - DNA, 1836 bp, Arabidopsis thaliana
  G832
atgaatccatcacaacaacacttaccaaagctatgtcctaagcgcctattcctcttcttcactccattcttattgttctctctctattacatcctcaccactatcaaaaccatcaccatctcttcccaagatcgtcaccatcctccacagcttcatgtaccttccatttcccattactactcccttccagaaacttcagaaaaccgatcgtcaccacctccactactactaccaccaccaccatcatcctcatcatcgttatcttcttactttccactctgtcccaagaacttcaccaactacttgccttgccacgatccatcaacagcacgacagtacagcattgagagacactatcggagagagaggcactgtcctgacatagcccaagagaagttcaggtgtttggtcccaaagcccactggctacaaaacgccttttccatggcctgagagtagaaaatatgcttggtttaggaacgtaccattcaagaggctagctgagttgaaaaagactcagaattgggttagacttgaaggagaccgttttgttttcccaggaggcgggacttctttccccggtggtgtgaaggactatgttgatgtgattctgagtgttttgcctttggcttctgggagtatcaggactgttctcgatattggatgtggagtagcgagttttggagcctttttgctgaactataagattttgacaatgtccattgcaccgagggatatacatgaggctcaagttcagttcgcattagaacgtggactccctgctatgctcggtgttttaagcacttataagctgccttacccgtcgaggtcttttgacatggtccattgttctagatgccttgtcaattggacttcctatgatgggctttacttgatggaggtggatcgtgttttacgtcctgagggatactgggtgttgtctggaccccctgtagcatcaagggttaaatttaagaaccagaagagagattccaaggagttgcagaaccagatggagaaactaaatgatgtttttagaagactttgttgggagaagattgctgaaagttacccggttgtcatctggagaaagccttctaatcatttgcagtgtaggaaaagactaaaagctcttaagtttcctggattatgctcttctagtgaccctgacgctgcgtggtataaagagatggagccgtgcatcactcctcttccagatgttaacgacacaaacaagaccgttctcaaaaactggcctgagagactaaaccatgtgcctcgaatgaaaaccgggtcgatacagggaacaactattgccggcttcaaagctgacacgaacctgtggcaaagaagagttttgtactatgacaccaagtttaagtttctcagcaatggaaaatacagaaacgtcattgatatgaacgcaggattaggtggttttgctgcagctttgatcaaatatccaatgtgggttatgaatgtggttccatttgatcttaaaccgaacacactcggtgttgtgtatgatcgcggtctcattggaacttacatgaactggtgtgaagctttatctacataccctcgaacctatgacctgattcatgccaatggtgtattcagtttgtacttggacaaatgtgacattgttgatatactcttggagatgcagaggattcttagaccagaaggagcagttataatacgagaccgttttgatgttcttgtcaaagtgaaagccataaccaatcaaatgagatggaatgggacaatgtatccagaagataatagtgttttcgatcatggaacaatactaatcgtagataactcaattaaataa

SEQ ID NO: 560 - protein, 611 aa, Arabidopsis thaliana
  G832
MNPSQQHLPKLCPKRLFLFFTPFLLFSLYYILTTIKTITISSQDRHHPPQLHVPSISHYYSLPETSENRSSPPPLLLPPPPSSSSSLSSYFPLCPKNFTNYLPCHDPSTARQYSIERHYRRERHCPDIAQEKFRCLVPKPTGYKTPFPWPESRKYAWFRNVPFKRLAELKKTQNWVRLEGDRFVFPGGGTSFPGGVKDYVDVILSVLPLASGSIRTVLDIGCGVASFGAFLLNYKILTMSIAPRDIHEAQVQFALERGLPAMLGVLSTYKLPYPSRSFDMVHCSRCLVNWTSYDGLYLMEVDRVLRPEGYWVLSGPPVASRVKFKNQKRDSKELQNQMEKLNDVFRRLCWEKIAESYPVVIWRKPSNHLQCRKRLKALKFPGLCSSSDPDAAWYKEMEPCITPLPDVNDTNKTVLKNWPERLNHVPRMKTGSIQGTTIAGFKADTNLWQRRVLYYDTKFKFLSNGKYRNVIDMNAGLGGFAAALIKYPMWVMNVVPFDLKPNTLGVVYDRGLIGTYMNWCEALSTYPRTYDLIHANGVFSLYLDKCDIVDILLEMQRILRPEGAVIIRDRFDVLVKVKAITNQMRWNGTMYPEDNSVFDHGTILIVDNSIK

SEQ ID NO: 561 - DNA, 2579 bp, Arabidopsis thaliana
  G837
ggttctttctactagatccggatctggaactttctctactctctgctcataaagtttcattctttggggagatctgaggcaaccctttttctctggtgcatgtgactagggattgtgccgtgggtttaggatcatggcaatggggaagtattctcgtgtagacgggaagaagtcatcgggatatggcttaaccattaccatcgttttaattgtttctctatgtttggttggggcgtggatgttcatgtcttcatggtctgctccaactgagtctattgacttctctgcaaacgagaggacaaaagatgtagatactactaagagtgatttcaaaagtgaagaggttgatcgaggttccaagagttttccggatgaaaagaatgaggagacggaggttgtgacagagaccaacgaagagaagactgatcctgagaaatctggtgaggagaactctggtgagaaaacggagtcggctgaggaaagaaaggagtttgatgacaaaaatggtgatggggatagaaaaaatggagacggtgagaaagacacggaatcagaaagtgatgaaaccaagcaaaaagagaaaacacaactggaagagagctcagaagaaaacaaatctgaggatagtaatggaaccgaagagaatgctggtgaatctgaagaaaacaccgagaagaagtcagaagaaaacgctggtgaaactgaagagagcactgagaagagtaaggatgttttcccagctggtgaccaggctgaaatcacaaaggagtcaagcactggaagtggggcttggtctacccaattggtggaatcccagaacgagaagaaagcacaagtgtcctcaattaaatggaaagtctgcaatgtgacagctggaccagactacatcccttgccttgacaattggcaagctatcagaaagcttcattcgacaaagcattatgaacatcgtgagaggcattgtcccgaggagtctccacgctgccttgtttctcttcccgaagggtataagcgatccatcaagtggcctaagagcagagaaaagatctggtacaccaatattccacacaccaagcttgcagaagtcaagggacatcaaaactgggtgaagatgagtggtgaatacttaacattccctggtggaggtactcaattcaagaatggtgctcttcactacattgatttcctccaagagtcatatcctgatattgcttggggaaataggactcgtgttatattggatgttgggtgtggggttgctagctttgggggatatctttttgacagagatgtactcgctttgtcatttgcacccaaagacgaacacgaggcacaggtgcaatttgctctggaacgtggtattcctgcaatgtcaaatgttatgggaaccaagagattaccttttccaggatctgtttttgaccttatccattgtgctcgttgtagagttccttggcatatcgaaggtggtaaactacttttggagttgaaccgtgcattgaggccgggtggtttctttgtctggtcagcgactccagtctataggaagactgaggaagatgttggcatatggaaagctatgtcgaagctaacaaaggcaatgtgctgggaactgatgacgattaagaaagatgaactgaatgaagttggtgctgccatttaccagaagccaatgtcgaataaatgctacaatgaaagatctcaaaatgagccacctctctgcaaagactctgatgatcaaaatgccgcctggaatgttccacttgaggcatgtattcacaaagtaacagaagattcatcaaaacgcggagcagtttggcctgaaagttggccggaaagagtggagacggttcctcagtggttagattctcaggaaggagtatatggaaaacctgcacaagaggatttcacagcagaccatgaacgctggaagactattgtttcaaagtcatacctcaacggtatgggaatcgattggtcttatgttagaaatgtgatggacatgagagcagtctatggaggttttgctgctgcattgaaggatctgaaactgtgggtgatgaatgtagttcctatcgactcacctgatacccttccgattatatacgaacgtggtttgtttggaatctatcatgattggtgtgaatcattcagcacttaccctcggacttacgacctccttcacgctgatcatcttttctcttcactgaaaaagaggtgcaacttggtgggcgtgatggctgaagtagaccggattcttagaccacaaggaactttcatagtaagagatgacatggaaacgataggagaaattgagaagatggtgaaatcgatgaaatggaatgtaagaatgacacattccaaagatggagaaggattgctctctgttcagaagtcatggtggcgtcctacagaggccgagaccattcagtcggcaatagcttgagatcaaggaaacgaagaagagtgtgggttaatatagtcgacagttgttccttttacgatccaattgattgtttcttacatgtattagtcgaatatttgtatcccttttttgcattgaagaaagttgtatacaa

SEQ ID NO: 562 - protein, 770 aa, Arabidopsis thaliana
  G837
MAMGKYSRVDGKKSSGYGLTITIVLIVSLCLVGAWMFMSSWSAPTESIDFSANERTKDVDTTKSDFKSEEVDRGSKSFPDEKNEETEVVTETNEEKTDPEKSGEENSGEKTESAEERKEFDDKNGDGDRKNGDGEKDTESESDETKQKEKTQLEESSEENKSEDSNGTEENAGESEENTEKKSEENAGETEESTEKSKDVFPAGDQAEITKESSTGSGAWSTQLVESQNEKKAQVSSIKWKVCNVTAGPDYIPCLDNWQAIRKLHSTKHYEHRERHCPEESPRCLVSLPEGYKRSIKWPKSREKIWYTNIPHTKLAEVKGHQNWVKMSGEYLTFPGGGTQFKNGALHYIDFLQESYPDIAWGNRTRVILDVGCGVASFGGYLFDRDVLALSFAPKDEHEAQVQFALERGIPAMSNVMGTKRLPFPGSVFDLIHCARCRVPWHIEGGKLLLELNRALRPGGFFVWSATPVYRKTEEDVGIWKAMSKLTKAMCWELMTIKKDELNEVGAAIYQKPMSNKCYNERSQNEPPLCKDSDDQNAAWNVPLEACIHKVTEDSSKRGAVWPESWPERVETVPQWLDSQEGVYGKPAQEDFTADHERWKTIVSKSYLNGMGIDWSYVRNVMDMRAVYGGFAAALKDLKLWVMNVVPIDSPDTLPIIYERGLFGIYHDWCESFSTYPRTYDLLHADHLFSSLKKRCNLVGVMAEVDRILRPQGTFIVRDDMETIGEIEKMVKSMKWNVRMTHSKDGEGLLSVQKSWWRPTEAETIQSAIA

SEQ ID NO: 563 - DNA, 2756 bp, Arabidopsis thaliana
  G838
aaagccaacggaagtgtttcttaattcattttttgtttgttttggtttaaataattcagtgtctcacgagctgtgtcgagattggatccatacaaaatctgcacgacgcctgcttcttcactctctcccactgttccagcttcaactctcttgatatacagagagagatagagataaagagagagagagtgagagtgatagctctcggagaaattgaagaagacacaatctgattagtattctccaatattccatcaactttttgctgagggaaatctccagatttataatcgtttgtatatatatatatacagagcagcgtagaaaaggatcttagatttatagcagcaacaaaaaaatgtcaatgccactacaacgtggcatctctggagtacgagtttctgatagcagtgatgatttgagagactctcaaatgaaagacaaaactgaaagagctcgttctactgagaacaacaacttaaccttaaggtttccttttggtttcctctttagtaatcaatcttcttccaaacacggtggtggtggcgaaaacggtttttctgctgatccatatagtgcaagaagcaggcatagattgatgttgttgtttctcaagatcagtttggttcttattgtggttattgctcttgctggttctttctggtggactatttccatttcgacttcttccagaggtcatgtatatcacaattataggaggttacaggagcagcttgtttcagacttatgggatattggggagatttctcttggtcctaataggtggaaggagcttgaatattgtaatatagaatctgagaattttgtcccttgctttaatgtttctgagaatcttgctctgggttactccaatggtgatgaaaatgatcggttttgtgggcctggatcaaagcaagaatgtttagagttgccaccggtgaaatatcgagtccctcttaggtggccgactggtaaagatataatctggcattctaatgttaagattactgctcaagaagttgtgtcttctggtagcataaccaagaggatgatgatgatggaagatgatcagatatctttcaggtcagcatctcctatgtctgatgaggttgaagactattcccatcagatcgctgaaatgatcgggattaagaaggataacttcatagaagctggtgtgagaactatcttggatattggatgtggttatggtagctttggggcacatctattgtccaaacagattttaactatgtgcatagcaaactacgaagcttcgggtagccaagttcagctaacactcgaaaggggtcttcctgcaatgattggctcttttatatcaaagcaattgccatatccttctctttcctttgatatgttgcattgcttaagatgtggcattgattgggaccagaaagatgggcttctccttgtagaaattgacagggttctcaagcccggtggttactttgtatggacatctccgctcacaaaccctcgtaacaaggatcatcttaaaagatggaactttgttcatgattttgctgaaagcatctgttggactcttttaaatcagcaagatgagacagttgtctggaaaaagactatcaacaccaaatgttatagttcccggaaacctggagtgggcccttctgtgtgtaccaaagggcacgatgttgagtctccttattacaggccgcttcagatgtgtataggtggaacacgtagccggaggtggattcccattgaaggcaggacaagatggcctagccggtctaacatgaacaagactgaactttcattatatggtcttcaccccgaggtgcttggagaggatgctgagaactggaagataacagtgagagaatactggtctctcttgtctcctctgatattctctgatcatccaaaaagacccggcgatgaagatccatcaccgccttataacatgctcagaaacgtactggatatgaatgctcaattcggtggtctcaattccgccttgttggaagcaagaaaatcagtctgggtcatgaatgtggtccctacagctggacctaaccacctccccatgatacttgaccgtggctttgtcggagttttgcacaactggtgtgaaccattcccgacttacccgagaacatatgacctggtacatgcagacaatctcttgtcgcttcagacaagtcagccccgaaaaacatgtctacttattgatatattcacagagattgaccgattgcttcgtccagagggatgggtgataatccgtgacacggcacagctggtggaaaaggcgagagagacgataacgcagttgaagtgggaagctcgagtaatagaggttgaaagcagcagtgaacaaagacttctcatctgccgaaaaccattcaccaagcgacaatcaatctgaagaagaagaagaacatagacacaggtttttctccacttttttaatttttttgttccaatgcctcacattttggaatcaaatcatccaacttgtgttggcgatacggggaagaaaggaggaagagatgaaatatatatcccgccggggacgtaagaccgccggtgaaatttctttatctggttccgtgagttcccattttacagaatctagattttttttttctttacaactttggttctataacaactcttattatacagcgaaaaaagaatatgattcaatatttgtgaagatgtttatgaaataagttcaaagctttttagtaaattttcactgagttaaa

SEQ ID NO: 564 - protein, 684 aa, Arabidopsis thaliana
  G838
MSMPLQRGISGVRVSDSSDDLRDSQMKDKTERARSTENNNLTLRFPFGFLFSNQSSSKHGGGGENGFSADPYSARSRHRLMLLFLKISLVLIVVIALAGSFWWTISISTSSRGHVYHNYRRLQEQLVSDLWDIGEISLGPNRWKELEYCNIESENFVPCFNVSENLALGYSNGDENDRFCGPGSKQECLELPPVKYRVPLRWPTGKDIIWHSNVKITAQEVVSSGSITKRMMMMEDDQISFRSASPMSDEVEDYSHQIAEMIGIKKDNFIEAGVRTILDIGCGYGSFGAHLLSKQILTMCIANYEASGSQVQLTLERGLPAMIGSFISKQLPYPSLSFDMLHCLRCGIDWDQKDGLLLVEIDRVLKPGGYFVWTSPLTNPRNKDHLKRWNFVHDFAESICWTLLNQQDETVVWKKTINTKCYSSRKPGVGPSVCTKGHDVESPYYRPLQMCIGGTRSRRWIPIEGRTRWPSRSNMNKTELSLYGLHPEVLGEDAENWKITVREYWSLLSPLIFSDHPKRPGDEDPSPPYNMLRNVLDMNAQFGGLNSALLEARKSVWVMNVVPTAGPNHLPMILDRGFVGVLHNWCEPFPTYPRTYDLVHADNLLSLQTSQPRKTCLLIDIFTEIDRLLRPEGWVIIRDTAQLVEKARETITQLKWEARVIEVESSSEQRLLICRKPFTKRQSI

SEQ ID NO: 565 - DNA, 2214 bp, Arabidopsis thaliana
  G849
aactcgagaattcttcatttcttttaaatcttagaatctcgagtttttgtataaatcgattctaatttttcctttgtacattgttttatatatacataaaacacacaaatcgggtatgggggaatttgggttttaagatagcgtgatctgtaataataagtggttcgcgatcgtgatcaagaaactggtggctgatagtgatatgcatatttgagagatggtgttcaagagaaagttagattgcctttccgtgggatttgattttcccaacattcccagagctcctcgttcatgcaggaggaaggttctaaacaagaggattgatcatgatgatgataacactcagatctgtgcaattgacttactagctttggctggaaagattctacaggaaagcgagagttcctctgcgtcttctaatgcatttgaagaaattaagcaagagaaagtagaaaattgcaagactattaaatctgagtcttctgaccaaggaaactctgtgtcaaagcctacttatgatatctctactgagaagtgtgtggtgaacagttgtttttcatttccggatagtgacggcgttttggagcggactccgatgtctgattacaagaagattcatggtttgatggatgtagggtgtgaaaacaagaatgtaaataatgggttcgagcaaggagaagcaaccgatcgcgtgggtgatggaggcttagtcactgatacttgcaacttagaggatgcaactgcgttaggtctgcagtttccgaaatcagtctgtgtgggtggtgatttaaaatcaccatccaccttggatatgacccctaatggttcctatgctagacatgggaaccatactaacctaggtagaaaagatgatgatgaaaaattctatagttaccataaacttagcaataaatttaagtcgtataggtctccaacaattcgaagaataagaaagtccatgtcgtccaaatactggaaacaagttccaaaagattttggatacagtagagctgatgtgggtgtgaagactctttatcgcaaaagaaaatcatgttatggttacaacgcatggcagcgtgagatcatttataagagaagaagatcacctgacagaagctcggtcgtaacttctgatggaggactcagtagtggaagtgtttccaagttacccaagaagggagatacagtaaagctaagcattaagtcctttaggattccagagctttttattgaagttccagaaactgcaacagtaggatcactaaagaggactgtgatggaggctgtcagtgttttactcagcggaggaatacgtgttggggtgttaatgcatgggaagaaggttagagatgaaaggaaaactctgtcccagactgggatctcatgtgatgaaaatctagacaaccttgggttcaccttggagcctagtcccagcaaagttcccctacctttgtgttctgaagatcctgctgtgccaaccgaccctacaagtttgtctgaacggtctgcggcgtctcctatgctagattctggaattccacatgcagatgacgtgattgattcaagaaatattgtggacagtaacctcgaattagttccatatcagggtgacatatctgttgatgaaccttcatcagattcaaaagagcttgtcccacttccagagttggaagtcaaggcgcttgccatagttccgttgaaccagaaacctaagcgtactgagctagcccagaggagaactaggagacccttctctgtgacagaggtagaagctcttgtacaagcagttgaggaactcgggactggaagatggcgtgatgtaaaattgcgtgctttcgaggatgcagatcatcggacttacgtggacttgaaggacaaatggaagacgctagttcacacagcaagtatatccccacagcaacgaagaggagagccggtgccacaagaactgctagacagagtcttgagggcatacgggtattggtcgcagcaccaaggaaaacatcaggcgagaggagcgtccaaagatccagacatgaacagaggtggagcttttgaatcaggtgtttcagtgtaaaaaaggaggtacgcattggtgggtgggtgtacagaagcaaacaacacaataaatggacaactcaatttctgcaaagtttaattgtctttatttctcgtttttttttttttttctcctacatacacttttttttttct

SEQ ID NO: 566 - protein, 619 aa, Arabidopsis thaliana
  G849
MVFKRKLDCLSVGFDFPNIPRAPRSCRRKVLNKRIDHDDDNTQICAIDLLALAGKILQESESSSASSNAFEEIKQEKVENCKTIKSESSDQGNSVSKPTYDISTEKCVVNSCFSFPDSDGVLERTPMSDYKKIHGLMDVGCENKNVNNGFEQGEATDRVGDGGLVTDTCNLEDATALGLQFPKSVCVGGDLKSPSTLDMTPNGSYARHGNHTNLGRKDDDEKFYSYHKLSNKFKSYRSPTIRRIRKSMSSKYWKQVPKDFGYSRADVGVKTLYRKRKSCYGYNAWQREIIYKRRRSPDRSSVVTSDGGLSSGSVSKLPKKGDTVKLSIKSFRIPELFIEVPETATVGSLKRTVMEAVSVLLSGGIRVGVLMHGKKVRDERKTLSQTGISCDENLDNLGFTLEPSPSKVPLPLCSEDPAVPTDPTSLSERSAASPMLDSGIPHADDVIDSRNIVDSNLELVPYQGDISVDEPSSDSKELVPLPELEVKALAIVPLNQKPKRTELAQRRTRRPFSVTEVEALVQAVEELGTGRWRDVKLRAFEDADHRTYVDLKDKWKTLVHTASISPQQRRGEPVPQELLDRVLRAYGYWSQHQGKHQARGASKDPDMNRGGAFESGVSV

SEQ ID NO: 567 - DNA, 1036 bp, Arabidopsis thaliana
  misc_feature (1012)..(1012): n is a, c, g, or t
  G859
gatttgtcattttttgtctagccaaaaaaaaaaaaaaaaaaggagagagagagagagagagagagagagagaaacgaagaaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacggagaacttgctgagagaagagaaccagactttggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggttaaaaataaaataaaacagaagctcatgcgaaagaattgtaaaactaagataaagctatagtagatctttattgtaccttcgtagacgatataagatttattcgtgtgtttgtcttcccctcnaaaaaaaaaaaaaaaaaaaaaaaa

SEQ ID NO: 568 - protein, 196 aa, Arabidopsis thaliana
  G859
MGRKKVEIKRIENKSSRQVTFSKRRNGLIEKARQLSILCESSIAVLVVSGSGKLYKSASGDNMSKIIDRYEIHHADELEALDLAEKTRNYLPLKELLEIVQSKLEESNVDNASVDTLISLEEQLETALSVTRARKTELMMGEVKSLQKTENLLREENQTLASQVGKKTFLVIEGDRGMSWENGSGNKVRETLPLLK

SEQ ID NO: 569 - DNA, 1210 bp, Arabidopsis thaliana
  misc_feature (1194)..(1196): n is a, c, g, or t
  G860
acaaaaccacatctctgaactgaaccaatttctcttctcccccttccggttatcggattaccagatctcgtttcccgcgatctagtttattctttgaaaaagtgatagaagcagaaatgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccagcatgaaatcggtcatagagagatacagcgatgccaaaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatctcgttcaccaagagaatttagacctccacaagaaagtaaacctaatgcaccaacagaacatggaactacatgaaaaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcataatataattcggtgtgccaacacacttatgttgacctcgtcggaatcatatcacaattcactgtgtcagcttgcctctgcataagcgaaaataaaaacataaacatgatcagtttgcattccatatctatcaaacaccagctttgtaacttttaaaactttttctccgtgcaaagacctttggtttggcgcttaagcatgtagtttgatgatcaaaggaaatgggtgttttagcataaagttgtcacccttccgttgcattttagcttcccatccaaatcaatttgtaaaatgtgagttagtttgcagcatgaaagctgattaaatatcagtcccgttatcacaagaggtaaaaaannnaaaaaaaaaaaaaa

SEQ ID NO: 570 - protein, 240 aa, Arabidopsis thaliana
  G860
MGRGKIAIKRINNSTSRQVTFSKRRNGLLKKAKELAILCDAEVGVIIFSSTGRLYDFSSSSMKSVIERYSDAKGETSSENDPASEIQFWQKEAAILKRQLHNLQENHRQMMGEELSGLSVEALQNLENQLELSLRGVRMKKDQMLIEEIQVLNREGNLVHQENLDLHKKVNLMHQQNMELHEKVSEVEGVKIANKNSLLTNGLDMRDTSNEHVHLQLSQPQHDHETHSKAIQLNYFSFIA

SEQ ID NO: 571 - DNA, 1134 bp, Arabidopsis thaliana
  G861
cttcttcctcctcctccatctcttctctttactctctctttaatcatctctcattcttgaatcttgatccatcaaaatcaatcccgttctcgaaagatccattaaaatcaaaacctaagctctctctcttgcttctagggtttttttgttcgttgtgatggcgagagaaaagattcagatcaggaagatcgacaacgcaacggcgagacaagtgacgttttcgaaacgaagaagagggcttttcaagaaagctgaagaactctccgttctctgcgacgccgatgtcgctctcatcatcttctcttccaccggaaaactgttcgagttctgtagctccagcatgaaggaagtcctagagaggcataacttgcagtcaaagaacttggagaagcttgatcagccatctcttgagttacagctggttgagaacagtgatcacgcccgaatgagtaaagaaattgcggacaagagccaccgactaaggcaaatgagaggagaggaacttcaaggacttgacattgaagagcttcagcagctagagaaggcccttgaaactggtttgacgcgtgtgattgaaacaaagagtgacaagattatgagtgagatcagcgaacttcagaaaaagggaatgcaattgatggatgagaacaagcggttgaggcagcaaggaacgcaactaacggaagagaacgagcgacttggcatgcaaatatgtaacaatgtgcatgcacacggtggtgctgaatcggagaacgctgctgtgtacgaggaaggacagtcgtcggagtctattactaacgccggaaactctaccggagcgcctgttgactccgagagctccgacacttcccttaggctcggcttaccgtatggtggttagagatggaacaattcaaagaagttgatggagtgaggagagtaatgtaaatctttttaactcggtagtaacaagagacaatgtctaagtagtgaattctcaaatgtttgtgtaagtttctgcctatggaagaggctttcatttttatgattttcactatgtatgatctctcttcactgcatttctggttagtaacggcttgtcaccgataaactttctcgttatggaaagttagaataaaaaaaaaaaaaaaaaaa

SEQ ID NO: 572 - protein, 240 aa, Arabidopsis thaliana
  G861
MAREKIQIRKIDNATARQVTFSKRRRGLFKKAEELSVLCDADVALIIFSSTGKLFEFCSSSMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQGTQLTEENERLGMQICNNVHAHGGAESENAAVYEEGQSSESITNAGNSTGAPVDSESSDTSLRLGLPYGG

SEQ ID NO: 573 - DNA, 1747 bp, Arabidopsis thaliana
  G864
tgcaaaaacattttcttgtctctcctctgcccaaattttttttctttccaggaatatttcctagaaaaacccaagcaaagctttaaccccttcctcctccaaaagtagcatcttcctctttttctatttctcctttcctcttcttatctctctctcgtttgtgaacgattccttaagaatataaccaaaagcccttttctcctttcttcaactttccgggaaaaatcttcacgcagcaaggtttctctctcggctctcgcagtgtttttcgggccttttgttctttctataaaaaaaaaattcgcgtcctttaagaaaactttttccacctagagaagaagaagagtatcactcttgttgttcaagtttctctctttaataaaaaatccatctttattctttgtcttctttcctttttgctttccctaatctctatgttataaacacacagagagaaacaaagtcacagtctcgagtcaaaaacagagaatacgaaagaaaaatggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaataatattttaaataaataaatagttataccggccgttactaaacggaaccggagaaagttttgtataccggtgacataaaatctcggttatgttcgtaatctttttttctttgttatatataaaaatatgaatgaaactgaattaatgtaagttaatggtgataattattaacgttttaagttttgaaaaaaaaaaaaaaaaaaaaaaaaaaa

SEQ ID NO: 574 - protein, 343 aa, Arabidopsis thaliana
  G864
MEAEKKMVLPRIKFTEHKTNTTTIVSELTNTHQTRILRISVTDPDATDSSSDDEEEEHQRFVSKRRRVKKFVNEVYLDSGAVVTGSCGQMESKKRQKRAVKSESTVSPVVSATTTTTGEKKFRGVRQRPWGKWAAEIRDPLKRVRLWLGTYNTAEEAAMVYDNAAIQLRGPDALTNFSVTPTTATEKKAPPPSPVKKKKKKNNKSKKSVTASSSISRSSSNDCLCSPVSVLRSPFAVDEFSGISSSPVAAVVVKEEPSMTTVSETFSDFSAPLFSDDDVFDFRSSVVPDYLGGDLFGEDLFTADMCTDMNFGFDFGSGLSSWHMEDHFQDIGDLFGSDPLLAV

SEQ ID NO: 575 - DNA, 1126 bp, Arabidopsis thaliana
  G865
atccccacttgttgttcatcaccaagccaagctccatgtcctagtcactccacagattccctatcatcatcaattcgtttcaaacttagttcctttcaaagtcttgtacatatatacacacacacctattattctcttggtgtgtttgtgtgttacatatacgtgtgagtacatactttgttgtaaaagtggatcggaggtatggaaagggaccggttccaccggaaacatcggcggcggcggatgataattcgtcttggaacgagactgatgtcaccgccatggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataatctaattattattgttggtcgaatcagttttataaatagctatcatagtttcatttttggtttccgtaacctttgttgcatggaaaatatgaatgaacgagggacatgtgtaacaatttgtttgtgtttcgtaaatgttagttgtatttggatttgctgaagtttgattttctgagcataaatcatttgacggtcaaaaaaaaaaa

SEQ ID NO: 576 - protein, 212 aa, Arabidopsis thaliana
  G865
MVSALSRVIENPTDPPVKQELDKSDQHQPDQDQPRRRHYRGVRQRPWGKWAAEIRDPKKAARVWLGTFETAEEAALAYDRAALKFKGTKAKLNFPERVQGPTTTTTISHAPRGVSESMNSPPPRPGPPSTTTTSWPMTYNQDILQYAQLLTSNNEVDLSYYTSTLFSQPFSTPSSSSSSSQQTQQQQLQQQQQQREEEEKNYGYNYYNYPRE

SEQ ID NO: 577 - DNA, 1198 bp, Arabidopsis thaliana
  G866
aaaaaaaacttgcacatcttctcagatcttcaagtttctcctctggtttctcatcatgaccgttgatattatgcgtttacctaagatggaagatcaaacggctatacaagaagctgcatcacaaggcttaaaaagcatggaacacttgattcgtgtcctctctaaccgtcccgaagaacgtaacgttgattgctctgagatcactgatttcacagtttctaagttcaagaaagttatctctcttcttaaccgttccggtcacgcccggtttagacgtggtccggttcattcccctccttcctcctccgttcctccaccggtgaaagtgacaactccggctcccactcagatctctgctccagcaccggttagcttcgttcaggcaaatcaacaaagcgtgacgttagatttcactagaccgagcgtttttggcgctaaaaccaagagctcggaggttgttgagtttgctaaagagagctttagcgtatcttctaactcttctttcatgtcttctgcgatcaccggtgatggaagtgtctctaaaggctcttcgatctttcttgctccggctccagcggtgccagtgacttcctccgggaaaccgccgctttctggtcttccttacaggaagagatgctttgaacatgaccactctgaaggcttttccggcaagatctctggctccggcaacggcaagtgccattgcaagaaaagccgaaaaaatcggatgaagagaaccgtgagagtaccggcggtaagtgcaaagatcgccgatataccaccagacgaatattcatggagaaagtatggacaaaaaccgatcaaaggctcaccacatccacggggttattacaagtgtagtacatttagaggatgtccagcgaggaaacacgtggaaagagctttggatgattcaacgatgttgattgtgacgtacgaaggagagcaccgtcatcaccagtccacgatgcaggagcatgtaactcctagcgtgagtggtttggtgtttggttcggcttgaagaattaattagtttggtagttttgtaatattttgagaaatagaggggttggttttgtaattttttttctataacaaaattagttttagatttttttttagtagtcttttgaatggattttaatcttactaccgagaaagaaaaaattcttactacattttcaaaaaaaaaaaaaaa

SEQ ID NO: 578 - protein, 321 aa, Arabidopsis thaliana
  G866
MTVDIMRLPKMEDQTAIQEAASQGLKSMEHLIRVLSNRPEERNVDCSEITDFTVSKFKKVISLLNRSGHARFRRGPVHSPPSSSVPPPVKVTTPAPTQISAPAPVSFVQANQQSVTLDFTRPSVFGAKTKSSEVVEFAKESFSVSSNSSFMSSAITGDGSVSKGSSIFLAPAPAVPVTSSGKPPLSGLPYRKRCFEHDHSEGFSGKISGSGNGKCHCKKSRKNRMKRTVRVPAVSAKIADIPPDEYSWRKYGQKPIKGSPHPRGYYKCSTFRGCPARKHVERALDDSTMLIVTYEGEHRHHQSTMQEHVTPSVSGLVFGSA

SEQ ID NO: 579 - DNA, 1281 bp, Arabidopsis thaliana
  G867
cacaacacaaacacatttctgttttctccattgtttcaaaccataaaaaaaaacacagattaaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactgtaaattttatttataggataaattttaaaaaaaaaaaaaaaaaaaa

SEQ ID NO: 580 - protein, 344 aa, Arabidopsis thaliana
  G867
MESSSVDESTTSTGSICETPAITPAKKSSVGNLYRMGSGSSVVLDSENGVEAESRKLPSSKYKGVVPQPNGRWGAQIYEKHQRVWLGTFNEEDEAARAYDVAVHRFRRRDAVTNFKDVKMDEDEVDFLNSHSKSEIVDMLRKHTYNEELEQSKRRRNGNGNMTRTLLTSGLSNDGVSTTGFRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDAGRVLRLFGVNISPESSRNDVVGNKRVNDTEMLSLVCSKKQRIFHAS

SEQ ID NO: 581 - DNA, 1571 bp, Arabidopsis thaliana
  G869
aggaacagtgaaaggttcggttttttgggtttcgatctgataatcaacaagaaaaaagggtttgatttatgtcggctgggtttgaatcgactgtgattttgtctttgattcatatctcttctccgatttcatcatcatcttccccatcatcgtcgtctttgaaatcttgtcttctcaacgctcttcacttctgctgtaataagcagaggcttgttctggagactccttctctttccatgcgcttaagacccaaaaggacttgttctagtgttgaagtctttgggggttttcacataaagcagcaaaagttttcttttttcatagttcgctgagagttttgagttttgataccaaaaaagttttgaccttttagagtgattttttgttctttctgttttctgggtatttttgaggagtgggtttaacaatggttgcgattagaaaggaacagtctttgagtggtgttagtagcgagattaagaagagagctaagagaaacactctatcgtcccttcctcaagaaacccaacctttgaggaaagtccgtattattgtgaatgatccttatgctactgatgattcctctagtgatgaggaagagcttaaggttcctaagccaaggaaaatgaaacgtatcgttcgtgagattaactttccttctatggaagtttctgaacagccttctgagagttcttctcaggacagtactaaaactgatggcaagatagctgtgtcagcttctcctgctgttcctaggaagaagcctgttggtgttaggcaaaggaaatgggggaaatgggctgctgagattagagatcctattaagaaaactaggacttggttgggtacttttgatactcttgaagaagctgctaaagcttatgatgctaagaagcttgagtttgatgctattgttgctggaaatgtgtccactactaaacgtgatgtttcttcatctgagactagccaatgctctcgttcttcacctgttgttcctgttgagcaagatgacacttctgcatcagctctcacttgtgtcaacaaccctgatgacgtctcgaccgttgctccaactgctccaactccaaatgttcctgctggtggaaacaaggaaacgttgttcgatttcgactttactaatctacagatccctgattttggtttcttggcagaggagcaacaagacctagacttcgattgtttcctcgcggatgatcagtttgatgatttcggcttgcttgatgacattcaaggattcgaagataacggtccaagtgcgttaccagatttcgactttgcggatgttgaagatcttcagctagctgactctagtttcggtttccttgatcaacttgctcctatcaacatctcttgcccattaaaaagttttgcagcttcataggatcttgcttagtaatgttaagtgagaagagtgttttgttttttcgtttatgctttagtaatttaagacatacaaaagtgtgtgttccggattgtagtaagatcttaagacataaagccgggttttgcaattaggaatcgagttttaatgaagttttagtttatgtttg

SEQ ID NO: 582 - protein, 324 aa, Arabidopsis thaliana
  G869
MVAIRKEQSLSGVSSEIKKRAKRNTLSSLPQETQPLRKVRIIVNDPYATDDSSSDEEELKVPKPRKMKRIVREINFPSMEVSEQPSESSSQDSTKTDGKIAVSASPAVPRKKPVGVRQRKWGKWAAEIRDPIKKTRTWLGTFDTLEEAAKAYDAKKLEFDAIVAGNVSTTKRDVSSSETSQCSRSSPVVPVEQDDTSASALTCVNNPDDVSTVAPTAPTPNVPAGGNKETLFDFDFTNLQIPDFGFLAEEQQDLDFDCFLADDQFDDFGLLDDIQGFEDNGPSALPDFDFADVEDLQLADSSFGFLDQLAPINISCPLKSFAAS

SEQ ID NO: 583 - DNA, 2603 bp, Arabidopsis thaliana
  G877
caaagattagactaatccgactgtgtttttaatcaatcatcattttatttaggggagagaagttgtaaagttttgatttttttttctgggttttttctgtgagacccagaagaagaacagagagaggaagaaggagaagaaaaaaatatctctttctctccggctttcaacaaaatctctcttttttccttcatcagtgttaaattcggatccgggtcgggtgggttttcggtttttggtgttcggatcagagcacagttggatgttagcgacggaactgaggatttcagtttgcggctgcggcggctgtgacggtgtttgtgtgtcgtcttcttttatcaatcaggagtttcatcacagtttgatcagagattcagccaaattcttggatactaaatggctggttttgatgaaaatgttgctgtgatgggagaatgggtgcctcgtagtcctagtcccgggacacttttctcctctgctattggagaagagaagagctcgaaacgtgttcttgaaagagagttatctttgaatcatggtcaagttattggtttagaagaagacactagtagtaatcataacaaggattcttcacaaagcaatgtttttcgaggtggtctcagtgaaagaattgctgcaagagctggatttaatgctccaaggttgaacactgagaatatccgcaccaacaccgacttttccattgactctaaccttcgatctccttgcttaaccatctcttctcctggccttagccctgcaacactcttggaatctcctgttttcctttctaacccattggctcaaccttctccaactaccgggaaatttccatttcttcctggtgttaatggtaatgcattgtcttctgagaaagcgaaagacgagttctttgatgatattggagcatcattcagcttccatcctgtttcaagatcatcttcctctttcttccaaggcacaacagagatgatgtcagttgattatggtaactacaacaatagatcttcttctcatcaatccgcagaagaagtaaaacctggctctgaaaacatagaaagctccaatctttatgggattgaaactgacaatcaaaacgggcagaacaagacatctgatgtcactacaaacaccagtcttgaaaccgtggatcatcaagaggaagaagaagagcaaagacgcggtgattcgatggctggtggtgcgcctgcagaggatggatataactggaggaaatacggacaaaagttggtcaaaggaagtgagtatccgcgaagctattacaagtgcacaaacccgaattgtcaggtgaagaagaaagttgagagatcaagggaaggtcacatcacagagattatatacaaaggagctcataatcatcttaaacctccacctaatcgccgctcagggatgcaagtagatggaactgaacaagttgaacaacaacaacaacagagagattctgctgcaacgtgggttagttgtaataacactcaacaacaaggtggaagcaatgagaacaatgtcgaagagggatctacgagattcgagtatggaaaccaatctggatcaattcaagctcaaaccggaggtcaatacgagtcaggtgatcctgtggttgtggttgatgcttcttcaacattctctaatgatgaagatgaagatgatcgagggacacatggaagtgtttctttgggttacgatggaggaggaggaggtgggggaggagaaggagatgaatcagagtcgaaaagaaggaaactagaagcttttgcagcagagatgagtggatcaacaagagccatacgtgagccaagagttgttgtgcagacaacgagtgatgttgacattcttgatgatggttatcgctggcgaaaatatggtcagaaagttgtcaaaggcaatccaaatccaaggagttattacaaatgcacagctccaggatgtacagtgaggaaacatgttgaaagagcttctcatgatctcaaatccgttataacaacttacgaaggcaaacataaccatgacgtccccgctgcacgcaacagcagccacggaggcggtggtgatagtggtaacggtaacagcggcggttcagccgcagtttctcaccattaccacaacggtcatcactcagagccgccacgtgggagattcgacagacaagtcacaactaacaatcagtctccttttagccgtccctttagctttcagccacatttgggtcctccttctggtttctccttcggtttaggacaaaccggtttggttaatctttcaatgcctggtttagcgtatggtcaagggaaaatgccgggtttgcctcacccgtatatgacacaaccggttgggatgagtgaagcaatgatgcagagagggatggaaccaaaggttgaaccggtttcagattcaggacaatcggtatataaccagatcatgagtagattacctcagatttgaaatttactcttcttcttcttcttctgcatttggtcactccttataataacttttaatttctgcttcttcttcttctttcatttattggtttcaaactttggggaaggtaaaggctgttttattgttaaaaaaaaaaaaaaaaa

SEQ ID NO: 584 - protein, 687 aa, Arabidopsis thaliana
  G877
MAGFDENVAVMGEWVPRSPSPGTLFSSAIGEEKSSKRVLERELSLNHGQVIGLEEDTSSNHNKDSSQSNVFRGGLSERIAARAGFNAPRLNTENIRTNTDFSIDSNLRSPCLTISSPGLSPATLLESPVFLSNPLAQPSPTTGKFPFLPGVNGNALSSEKAKDEFFDDIGASFSFHPVSRSSSSFFQGTTEMMSVDYGNYNNRSSSHQSAEEVKPGSENIESSNLYGIETDNQNGQNKTSDVTTNTSLETVDHQEEEEEQRRGDSMAGGAPAEDGYNWRKYGQKLVKGSEYPRSYYKCTNPNCQVKKKVERSREGHITEIIYKGAHNHLKPPPNRRSGMQVDGTEQVEQQQQQRDSAATWVSCNNTQQQGGSNENNVEEGSTRFEYGNQSGSIQAQTGGQYESGDPVVVVDASSTFSNDEDEDDRGTHGSVSLGYDGGGGGGGGEGDESESKRRKLEAFAAEMSGSTRAIREPRVVVQTTSDVDILDDGYRWRKYGQKVVKGNPNPRSYYKCTAPGCTVRKHVERASHDLKSVITTYEGKHNHDVPAARNSSHGGGGDSGNGNSGGSAAVSHHYHNGHHSEPPRGRFDRQVTTNNQSPFSRPFSFQPHLGPPSGFSFGLGQTGLVNLSMPGLAYGQGKMPGLPHPYMTQPVGMSEAMMQRGMEPKVEPVSDSGQSVYNQIMSRLPQI

SEQ ID NO: 585 - DNA, 2044 bp, Arabidopsis thaliana
  G878
caaaaaaaatctctcccattaaaagactgcccaaagaaatattttatacaaaatgaaagagagaaacacgacacgaattttgtataattaagattacacaaaaaaaagtgttagaaagagaaatatcttcttcttttttctgtgtgagttgggtttgttaaagttttatcctttttgttctcaaaatcaagaatcgatggcggagaaggaagaaaaagaaccatcgaagttaaaatcatccaccggagtttcacggccaacgatttcactacctcctcgaccgtttggtgaaatgttttttagcggtggcgttggatttagtcctggaccaatgactctcgtctcaaatttattctctgatcctgatgagttcaagtctttctctcagcttttagctggagctatggcttctccggcggcagctgctgttgccgccgctgctgtggttgctactgctcatcatcagacacctgtgagctctgtcggtgatggcggtggaagcggtggtgatgttgacccgaggtttaagcagagtagaccaacgggattgatgataactcaaccaccggggatgtttactgtaccgccggggttaagtccggctactcttttggattctccgagcttctttggtcttttttcacctcttcagggaacatttggtatgacacatcaacaagctttagcacaagtcactgcacaagcagttcaaggcaataatgttcatatgcagcaatcacaacaatctgaatatccttcttctacacaacaacaacaacaacaacaacaacaagcttcattgactgagattccatcattttcttctgcacctaggtctcagattcgagcctcggttcaagaaacatcgcagggtcagagagagacttcggaaatatctgtctttgagcatcggtcacagcctcaaaatgctgacaaaccagctgatgatggatacaactggcggaaatatgggcagaagcaagtgaaggggagcgattttcctcggagttattacaaatgtacgcatccagcttgtcctgtcaagaagaaagtggagaggtcactcgatggacaagtaacggaaatcatctacaagggtcaacacaatcatgagcttcctcaaaagcgcggtaacaataacgggagttgtaaaagttctgatattgcaaatcagtttcaaacaagtaatagcagtctcaacaagagtaagagggaccaggaaacaagccaagttacaacaacagagcagatgtctgaagcaagtgatagcgaggaggttgggaatgcagagactagtgtgggagaaagacatgaggatgagcctgatcccaagcgaagaaatacagaagttcgggtttcagaaccagttgcttcatcgcatagaactgtgacagagcctaggattattgtccaaacgacgagtgaagttgacctcttagatgatggatataggtggcgcaagtatggtcagaaagtagtcaaaggaaatccttatccgaggagctactataagtgtacaacaccagattgcggagtaaggaaacatgtagagagagcagcaactgacccaaaagctgttgtaacaacatatgaaggtaaacataaccatgatgttccagctgctagaaccagcagccatcagttaagaccaaacaatcaacacaacacctcaacggttaacttcaatcatcaacagcctgttgcacgtttaaggcttaaagaagagcaaatcacttgacagagaagaagaatacgacggcgcttgagcttttgtgagtttaatgaatcttctttttggttaatgaacctgtttttgttgcctcaaaacaccacaggtttctctggacagaatctctgatattacagtttcaaaaggtatgttcttttatttcatgttggaatcttctgtgtaatcttaagaagctttaggaggtaatgtaaaaaaccagattcaaagttatgcccttatgtgaattcttttgtacatgggataaacaaaatttacaggtatcctttttgttcttgttgtaaaaaaaaaaaaaaa

SEQ ID NO: 586 - protein, 513 aa, Arabidopsis thaliana
  G878
MAEKEEKEPSKLKSSTGVSRPTISLPPRPFGEMFFSGGVGFSPGPMTLVSNLFSDPDEFKSFSQLLAGAMASPAAAAVAAAAVVATAHHQTPVSSVGDGGGSGGDVDPRFKQSRPTGLMITQPPGMFTVPPGLSPATLLDSPSFFGLFSPLQGTFGMTHQQALAQVTAQAVQGNNVHMQQSQQSEYPSSTQQQQQQQQQASLTEIPSFSSAPRSQIRASVQETSQGQRETSEISVFEHRSQPQNADKPADDGYNWRKYGQKQVKGSDFPRSYYKCTHPACPVKKKVERSLDGQVTEIIYKGQHNHELPQKRGNNNGSCKSSDIANQFQTSNSSLNKSKRDQETSQVTTTEQMSEASDSEEVGNAETSVGERHEDEPDPKRRNTEVRVSEPVASSHRTVTEPRIIVQTTSEVDLLDDGYRWRKYGQKVVKGNPYPRSYYKCTTPDCGVRKHVERAATDPKAVVTTYEGKHNHDVPAARTSSHQLRPNNQHNTSTVNFNHQQPVARLRLKEEQIT

SEQ ID NO: 587 - DNA, 1152 bp, Arabidopsis thaliana
  G881
gtgaccgaagaaagcaaattgagactacgcaccaactagtcctttggtttgtatcttaagataaaggtttcttttatggacggttcttcgtttctcgacatctctctcgatctcaacaccaatcctttctccgcaaaacttccgaagaaggaggtctcagttttggcttctactcacttaaagaggaaatggttggagcaagacgagagcgcaagtgagttacgagaggagctaaacagagttaattcagagaacaagaagctaacagagatgttagctagagtctgtgagagctacaacgaactacataatcatttggagaagcttcagagtcgccagagccctgaaatcgagcagaccgatataccgataaagaaaagaaaacaagacccggatgagttcttaggctttcctattggactcagtagtggaaaaactgagaacagctccagcaacgaagatcatcatcatcatcatcagcaacatgagcagaaaaatcagcttctttcatgtaaaagaccagtcactgatagcttcaacaaagcaaaagtttcgactgtctacgtgcctactgaaacatcggacacaagcttgacagttaaagatggatttcaatggaggaaatacggacaaaaggttacaagagacaacccgtcacctagagcttactttagatgctcgtttgcaccgtcttgtccagtaaaaaagaaggtacaacgcagcgcagaggatccatctttacttgtagcgacatacgaagggacgcataaccacttgggtccaaatgcttctgaaggggatgctacaagccagggtgggtcaagcacagtgactttggatctggttaatggctgtcatagactagcgttggagaaaaacgaaagggataatacgatgcaagaggttctgattcaacaaatggcgtcatcgttaacaaaagattcgaaatttacagctgctcttgctgctgctatatctgggaggttaatggagcaatctagaacatgaacgtttttagtgaatgtattgtttttgtttgtttagaatgattcttcgttttcgaattgtgtctttcgattaggagataaaagatgtatataaatattataagtagatgaagaaatcgtataagtaaaaaaaaaaaaaaaaaaa

SEQ ID NO: 588 - protein, 310 aa, Arabidopsis thaliana
  G881
MDGSSFLDISLDLNTNPFSAKLPKKEVSVLASTHLKRKWLEQDESASELREELNRVNSENKKLTEMLARVCESYNELHNHLEKLQSRQSPEIEQTDIPIKKRKQDPDEFLGFPIGLSSGKTENSSSNEDHHHHHQQHEQKNQLLSCKRPVTDSFNKAKVSTVYVPTETSDTSLTVKDGFQWRKYGQKVTRDNPSPRAYFRCSFAPSCPVKKKVQRSAEDPSLLVATYEGTHNHLGPNASEGDATSQGGSSTVTLDLVNGCHRLALEKNERDNTMQEVLIQQMASSLTKDSKFTAALAAAISGRLMEQSRT

SEQ ID NO: 589 - DNA, 1195 bp, Arabidopsis thaliana
  G883
ctctctcgtcttcgtcttcttcttcttcaacgttcctctccaaaatcctcagaccaagaaatcatcatggccgtcgatctaatgcgtttccctaagatagatgatcaaacggctattcaggaagctgcatcgcaaggtttacaaagtatggaacatctgatccgtgtcctctctaaccgtcccgaacaacaacacaacgttgactgctccgagatcactgacttcaccgtttctaaattcaaaaccgtcatttctctccttaaccgtactggtcacgctcggttcagacgcggaccggttcactccacttcctctgccgcatctcagaaactacagagtcagatcgttaaaaatactcaacctgaggctccgatagtgagaacaactacgaatcaccctcaaatcgttcctccaccgtctagtgtaacactcgatttctctaaaccaagcatcttcggcaccaaagctaagagcgccgagctggaattctccaaagaaaacttcagtgtttctttaaactcctcattcatgtcgtcggcgataaccggagacggcagcgtctccaatggaaaaatcttccttgcttctgctccgtcgcagcctgttaactcttccggaaaaccaccgttggctggtcatccttacagaaagagatgtctcgagcatgagcactcagagagtttctccggaaaagtctccggctccgcctacggaaagtgccattgcaagaaaaggaaaaatcggatgaagagaaccgtgagagtaccggcgataagtgcaaagatcgccgatattccaccggacgaatattcgtggaggaagtacggacaaaaaccgatcaagggctcaccacacccacgtggttactacaagtgcagtacattcagaggatgtccagcgaggaaacacgtggaacgagcattagatgatccagcgatgcttattgtgacatacgaaggagagcaccgtcataaccaatccgcgatgcaggagaatatttcttcttcaggcattaatgatttagtgtttgcctcggcttgacttttttttgtactatttgttttttgattttttgagtactttagatggattgaaatttgtaaatttttttattaagaaatcaatttaaatagagaaaaattagtggtggtgcaaaaaaaaaaaaaaaaaaaaaaaaaaaaaaaaaaaaaaaaaa

SEQ ID NO: 590 - protein, 324 aa, Arabidopsis thaliana
  G883
MAVDLMRFPKIDDQTAIQEAASQGLQSMEHLIRVLSNRPEQQHNVDCSEITDFTVSKFKTVISLLNRTGHARFRRGPVHSTSSAASQKLQSQIVKNTQPEAPIVRTTTNHPQIVPPPSSVTLDFSKPSIFGTKAKSAELEFSKENFSVSLNSSFMSSAITGDGSVSNGKIFLASAPSQPVNSSGKPPLAGHPYRKRCLEHEHSESFSGKVSGSAYGKCHCKKRKNRMKRTVRVPAISAKIADIPPDEYSWRKYGQKPIKGSPHPRGYYKCSTFRGCPARKHVERALDDPAMLIVTYEGEHRHNQSAMQENISSSGINDLVFASA

SEQ ID NO: 591 - DNA, 1879 bp, Arabidopsis thaliana
  G884
tttttttttgtttgttaattttggggatcgatgtcggaaaaggaagaagctccgtcgacatcgaagtccaccggagctccgtcgcgtccgactttatctcttcctccacggccgtttagtgagatgttctttaacggtggcgttggattcagtcctggtccgatgactctggtctctaatatgttccctgattccgatgagtttaggtctttctctcagcttctcgctggagccatgtcttctccagcgactgcagctgctgctgctgctgctgcgacggctagtgattaccagagacttggtgaagggactaatagctctagtggtgatgttgacccgagattcaagcaaaacagaccaaccggtttgatgatttctcaatctcaatcgccgtcgatgttcaccgtaccgcctggtttaagtccagctatgttgctcgattcaccaagctttttgggtcttttctctcccgttcagggatcatatggaatgacacatcagcaagctctagctcaagtcactgctcaagcagttcaagccaatgccaatatgcaaccacaaacagagtaccctcctccctctcaagttcaatcattttcatcgggtcaagcgcagatcccgacctcggctccactaccagctcaaagagaaacctcagatgtaaccatcatagagcacaggtcacaacagcctctaaatgttgacaaaccagctgatgatggctataactggcgaaaatatgggcaaaagcaagttaaaggtagcgagtttccacgaagctattacaagtgtactaatccaggatgtcctgtcaagaagaaggttgagagatctcttgatggacaagtaacggagattatctacaaaggtcagcacaatcatgaacctcctcaaaacactaagcgaggtaacaaagataacaccgcgaatataaatgggagttcgataaataacaatcgcgggagttctgaattgggggcatcacagtttcaaactaatagctccaacaagactaagagagagcaacatgaagcagtaagtcaagctacgacaacagagcacttgtctgaggcaagtgacggtgaagaagttggtaatggagaaactgatgtgagagagaaagatgagaatgagcctgatcccaagagaagaagtacagaagttcggatttcagaaccagctcctgctgcttcacatagaactgtgacagagcctagaattattgtccaaacgacgagtgaagttgatcttctagatgatggatataggtggcgtaaatatggacagaaagttgtcaaagggaatccttatccgaggagctactacaagtgcacaacaccaggatgtggtgtgaggaaacatgtagagagagcagcaacagatccaaaagctgtagtaacaacatatgaaggaaaacataaccatgaccttcccgctgctaaatcaagcagccatgccgctgcagcggcacagttaaggccagataatcgacctggcggtttggctaacttaaatcaacagcagcagcaacagcccgttgcgcggctaaggcttaaagaagagcaaacaacttgagagaagaaaactcttgaccgtttttcattacaaaagctttcaaattccactcacacacttgtctgaaaaatctagcagtttgcaggaaagaaacagcttcaagaggttgtagttcttctatgttctggtgtaaaacttaaaagctttttagggttttcagatttctgtttactaatactgtatgtgaattcttttgtacatgaggaagaaaattacagggggatattttgtgttgtatcttttgtgttattgtttcagtaaaagataggtcttacattttgtgtaaaaaaaaaaaaaaaaaaaa

SEQ ID NO: 592 - protein, 514 aa, Arabidopsis thaliana
  G884
MSEKEEAPSTSKSTGAPSRPTLSLPPRPFSEMFFNGGVGFSPGPMTLVSNMFPDSDEFRSFSQLLAGAMSSPATAAAAAAAATASDYQRLGEGTNSSSGDVDPRFKQNRPTGLMISQSQSPSMFTVPPGLSPAMLLDSPSFLGLFSPVQGSYGMTHQQALAQVTAQAVQANANMQPQTEYPPPSQVQSFSSGQAQIPTSAPLPAQRETSDVTIIEHRSQQPLNVDKPADDGYNWRKYGQKQVKGSEFPRSYYKCTNPGCPVKKKVERSLDGQVTEIIYKGQHNHEPPQNTKRGNKDNTANINGSSINNNRGSSELGASQFQTNSSNKTKREQHEAVSQATTTEHLSEASDGEEVGNGETDVREKDENEPDPKRRSTEVRISEPAPAASHRTVTEPRIIVQTTSEVDLLDDGYRWRKYGQKVVKGNPYPRSYYKCTTPGCGVRKHVERAATDPKAVVTTYEGKHNHDLPAAKSSSHAAAAAQLRPDNRPGGLANLNQQQQQQPVARLRLKEEQTT

SEQ ID NO: 593 - DNA, 2946 bp, Arabidopsis thaliana
  G886
gaaaaagctaaactttgctctgttttttcaacaaaaaaagtgaactttgctctgttccgtccatgtccgatgatgatcggagtggaagcagaatgagatttgaagcaaacgtctagagttccgacgttatgggttgcggaggatcaaaagtagataatcaaccaatagtgattctctgtagagaacgaaaggagctgcttaaagcggcgtcgtatcatcgttctgctctcgctgtcgctcacctaacttacttccagtctctctccgacgtcggtgaagctattcaacgtttcgttgacgacgaagtcgtagctggtttttcttcttcttcttcgccggattctccagttcttacacttccgtccgacgaagggaaaccgacgaaacacaagaggatttctccttcttcaaccacctcaatttctcattccgtcatcgaagaagaagacactgatgatgattcgcatttgcatctaagctccggatccgaatccgaatcagaagttggatctaaggatcatatccaaattactagcactccagaacaagagcggtcaacggaatcatttccttccggttatcatccaacaaactatgctccaccggtttacccacctggttatccacccggttacccattcagttacccgaccggttattcatcgggtaattatcaaccgggttacccgaattacacaggtgagaatccatacggaaatcgaggaatgtattacatgaagaaatctgcgccacaatcacgaccgttcattttccaaccggagaatcatcgagtggaggagaacgcgcaatggccgtcggattctggatttagaaacacaggagtgcaacggagatcgccgtctccgttacctcctccgtcaccacctacggtttcaacttgggattttttgaatgtgtttgatacttatgattacagcaacgcccgttctcgtgcttcgggatattatccgatgggaatggcgtcaatctcaagcagtcctgattcgaaggaagttagagaaagagaagggattcctgagctagaagaagtaacagagcaagaagttatcaagcaagtgtatagacgtcccaagagaccaggattggagaaggttaaagaacacagagacgagcacaagcacaacgtttttcctgagaggaacattaacaaaagggaagttccaatgccagaacaagtcactgagagctcattggattcagagacaatttcgtctttttcaggaagtgatgtagaatcggagtttcactatgttaatggtggtgaaggaaagagtagcagcatcagttcaatcagtcatggggctgggacaaagagctcgagagaagtagaagaacagtatgggaggaaaaaaggagtgagctttgagttggaggaaacaacgagcacttcgtcttttgatgttgaatcttccaagataagtagcttatccagtttgtcgattcatgccactagggatctcagagaagttgttaaggagatcaagagtgagttcgagattgcttcttcttgtgggaaggaggttgctttgttacttgaagtcggcaagttgccttatcagcataaaaacaatggcgttaaagttatcttatccaggatcatgtatctggtagcaccatccacacggtcatcgcactctcagcccagactatcaatacgtttaacatctagaactcgaaaaatggcgaaatcatacaatggacaagatgttaatggaggcttcaatggaaacctctcatcaaccttagagaaactgtatgcgtgggaaaagaaactgtacaaggaagtcaaggacgaagaaaagcttcgtgctatctatgaagagaagtgcaggagactaaaaaaaatggatagtcatggagcagaatctatcaagatcgatgctactcgggcagccattaggaagcttctgaccaaaatcgatgtttgtataagatcagttgattcgatttccagcagaatccataaacttagagatgaagagttgcagccacagttgatacagttaattcacgggttgataagaatgtggaggtcaatgctgaggtgccaccagaaacagtttcaggcgatcagggagagcaaggttcgatctctaaaggcgaacacaaccttacaaaatgactctggctctacagcaattcttgatcttgagatagagcttagagaatggtgcatcagcttcaacaactgggtcaacacccagaaatcatacgtccagttcctaagcggatggctcacgaaatgccttcactatgaacccgaggcaaccgatgacggaatcgctcctttctctcctagccagatcggtgcaccgcccatctttatcatttgcaaagattggcaagaagcaatgtgtagaatatctggagagaatgtgaccaatgcaatgcaaggttttgcttcaagcctacacgagctatgggagaagcaagaagaagagcaaagggtaaaagcgcaatctgagcagcgagatgcagagtcagagagaagtgtggtttcgaaaggtcggtcagagagcgggatatcagctttggatgatttgaaagtggatttagattcaatgaggaagaggctagtcgaggagagaggtaagggtaaagaaaccattaagcttgtgaacaacgcgtcttcgagcagcttaaaagctggtttagttcccattttcggggcactgagaaaattcacatcagaagttgtgaaagctcatgaaattgttaggcttcaacatcctcagacctcttcttgagtagagagtgtggacttaccacatttttgcaccgttttgaagttttgttacttgcaaattagacataggtctatatagaaggaaattgttgtatagatgagttcatattcaattattggttggttagtttcccttgtaaaccgtttttaaatggtgaagaagaagatatctaaaaaaa

SEQ ID NO: 594 - protein, 879 aa, Arabidopsis thaliana
  G886
MGCGGSKVDNQPIVILCRERKELLKAASYHRSALAVAHLTYFQSLSDVGEAIQRFVDDEVVAGFSSSSSPDSPVLTLPSDEGKPTKHKRISPSSTTSISHSVIEEEDTDDDSHLHLSSGSESESEVGSKDHIQITSTPEQERSTESFPSGYHPTNYAPPVYPPGYPPGYPFSYPTGYSSGNYQPGYPNYTGENPYGNRGMYYMKKSAPQSRPFIFQPENHRVEENAQWPSDSGFRNTGVQRRSPSPLPPPSPPTVSTWDFLNVFDTYDYSNARSRASGYYPMGMASISSSPDSKEVREREGIPELEEVTEQEVIKQVYRRPKRPGLEKVKEHRDEHKHNVFPERNINKREVPMPEQVTESSLDSETISSFSGSDVESEFHYVNGGEGKSSSISSISHGAGTKSSREVEEQYGRKKGVSFELEETTSTSSFDVESSKISSLSSLSIHATRDLREVVKEIKSEFEIASSCGKEVALLLEVGKLPYQHKNNGVKVILSRIMYLVAPSTRSSHSQPRLSIRLTSRTRKMAKSYNGQDVNGGFNGNLSSTLEKLYAWEKKLYKEVKDEEKLRAIYEEKCRRLKKMDSHGAESIKIDATRAAIRKLLTKIDVCIRSVDSISSRIHKLRDEELQPQLIQLIHGLIRMWRSMLRCHQKQFQAIRESKVRSLKANTTLQNDSGSTAILDLEIELREWCISFNNWVNTQKSYVQFLSGWLTKCLHYEPEATDDGIAPFSPSQIGAPPIFIICKDWQEAMCRISGENVTNAMQGFASSLHELWEKQEEEQRVKAQSEQRDAESERSVVSKGRSESGISALDDLKVDLDSMRKRLVEERGKGKETIKLVNNASSSSLKAGLVPIFGALRKFTSEVVKAHEIVRLQHPQTSS

SEQ ID NO: 595 - DNA, 1276 bp, Arabidopsis thaliana
  G896
taatccgattcgtcttcatctgattccctcccttccgagaataataatgtacccgccacctccctcaagcatctacgctcctccgatgctggtgaattgctccggttgccggacgcctctccagctcccatccggcgcccgatctattcgctgcgctctctgccaggctgttactcatatcgccgaccctcgcaccgcccctcctccgcaaccttcctccgccccttctccgcctccccaaatccacgcgcctcccggtcagctgcctcacccccatggcaggaagagggccgtgatctgtggcatctcgtatcgtttctctcgccacgagctcaaaggctgcatcaacgacgccaagtgcatgcgtcaccttctcatcaacaaattcaaattctccccagattcaattctcatgcttaccgaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacagagctgggcagtatgtgtgggaggatcatcggcctaggtcaggtttgtggaaaggaactgctggtggagaagccatttcaattagtggatgtgatgatgatcagacttcggccgacacatcagcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggagcctcaactgactgcttgccaaacattcgatgtctatgcaaagcctttcactctctagtaaaggacaagtcactttttatgtatagcgagtgtgatttgagaatccgtccatataaccaccttttgtttcttatttttatttttctttcaaaagaataaaggaaaacattgatttggtgattcg

SEQ ID NO: 596 - protein, 367 aa, Arabidopsis thaliana
  G896
MYPPPPSSIYAPPMLVNCSGCRTPLQLPSGARSIRCALCQAVTHIADPRTAPPPQPSSAPSPPPQIHAPPGQLPHPHGRKRAVICGISYRFSRHELKGCINDAKCMRHLLINKFKFSPDSILMLTEEETDPYRIPTKQNMRMALYWLVQGCTAGDSLVFHYSGHGSRQRNYNGDEVDGYDETLCPLDFETQGMIVDDEINATIVRPLPHGVKLHSIIDACHSGTVLDLPFLCRMNRAGQYVWEDHRPRSGLWKGTAGGEAISISGCDDDQTSADTSALSKITSTGAMTFCFIQAIERSAQGTTYGSLLNSMRTTIRNTGNDGGGSGGVVTTVLSMLLTGGSAIGGLRQEPQLTACQTFDVYAKPFTL

SEQ ID NO: 597 - DNA, 1120 bp, Arabidopsis thaliana
  G897
aaacagtagagagagatatagagagcatcaatggcgtcgtcgtcaagactttgcgattcgtgcaaatcgacggcagcaactctattctgccgcgcagacgccgcgtttctctgcggcgactgcgacggtaagatccacacagctaacaaactcgcatcacgtcacgaacgagtttggctatgtgaagtatgcgaacaagcaccagcacacgtcacgtgcaaagctgacgccgctgcgttatgcgtcacgtgcgaccgtgatatccactcagctaatccactctctcgccgccacgagcgcgtaccaatcactcctttctacgacgctgtaggtccagcaaaatccgcttcctcctccgtcaatttcgtagatgaagatggcggtgacgtcactgcttcgtggcttttagctaaagaaggaatcgaaatcactaatttgttctccgatcttgattatccgaagattgaggtaacgtcggaggagaatagctccggtaacgacggagttgttcctgtgcagaataagttgtttcttaacgaagattacttcaatttcgatctctctgcttccaaaatttctcaacaaggattcaatttcatcaaccaaactgtttcgacgagaacgatagatgtaccgttggtgcctgaaagtggaggagtgacggcggagatgacgaacacggagacgccagctgtgcagttatcaccggcggagagggaagcaagggttttgaggtatagagagaagaggaagaatcggaaatttgagaagacgattaggtatgcgtcgcgtaaagcttacgctgagatgaggccgagaatcaaaggacgttttgctaagagaacagattcgagagagaatgatggtggagacgtcggagtttatggcggattcggtgttgttccgagtttctgatattttccggtgaaagaaacatggtagtagtatatcggttaatagcagattaaggataattaaaactaaaatgtttcctgatttaatcaggggctaagttattgttagaagattgttgttttttgaattaattctcacaattgtatcctaaattatatagtttacttaatgttgaactaataaattttgatttacaatctcaaaa

SEQ ID NO: 598 - protein, 294 aa, Arabidopsis thaliana
  G897
MASSSRLCDSCKSTAATLFCRADAAFLCGDCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYGGFGVVPSF

SEQ ID NO: 599 - DNA, 900 bp, Arabidopsis thaliana
  G901
atgaagattcagtgtaacgtttgtgaggcggcggaagcgacggttctatgttgcgccgacgaggctgctctttgttgggcttgcgatgagaaaattcacgccgctaataaactcgccggaaaacatcagagagtccctctctctgcctctgcctcttccatacccaaatgtgacatttgtcaggaagcatctggattcttcttttgtctgcaagatagagctttgctatgtaggaaatgtgatgttgcaatccacactgtgaatcctcatgtttcagctcaccagagatttcttctcactggaatcaaagttggtcttgaatctatagacactggtccttctactaaatcctcacctaccaatgatgataaaaccatggagaccaaaccttttgttcaatctatacctgagcctcaaaagatggccttcgatcatcatcatcaccagcagcagcaggaacagcaggaaggagttataccgggaactaaagtcaatgatcagacatcgacaaagcttcctctcgtaagtagcggatcaactactggaagcattcctcagtggcaaatagaggagattttcgggctaaccgactttgatcagagctatgaatacatggagaataatggatcatctaaggcggatactagtagacgaggagattcagacagttcttcgatgatgagatctgcagaagaagatggagaagataacaataactgcttgggaggtgagacatcatgggcggttccacagattcagtctccacctacagcgtctggtctaaactggcctaagcattttcaccaccactctgtgtttgttccggacataacttcttcaactccttataccggttcatccccgaatcaaagggttgggaaacggcggcgacggttctag

SEQ ID NO: 600 - protein, 299 aa, Arabidopsis thaliana
  G901
MKIQCNVCEAAEATVLCCADEAALCWACDEKIHAANKLAGKHQRVPLSASASSIPKCDICQEASGFFFCLQDRALLCRKCDVAIHTVNPHVSAHQRFLLTGIKVGLESIDTGPSTKSSPTNDDKTMETKPFVQSIPEPQKMAFDHHHHQQQQEQQEGVIPGTKVNDQTSTKLPLVSSGSTTGSIPQWQIEEIFGLTDFDQSYEYMENNGSSKADTSRRGDSDSSSMMRSAEEDGEDNNNCLGGETSWAVPQIQSPPTASGLNWPKHFHHHSVFVPDITSSTPYTGSSPNQRVGKRRRRF

SEQ ID NO: 601 - DNA, 863 bp, Arabidopsis thaliana
  G902
taattaatcagaggtttctacttattatttccacttctcatctctttcaatcgcaatctgagttctggctaaagattttgtcttgaaggtgagattcattgttccgaatagagtgagaaaaagacttataagattgaaaaagcaagatgcggattttgtgcgatgcttgcgagaacgcagccgcaatcatcttttgcgccgccgatgaagctgccctttgtcgcccctgcgatgaaaaagttcatatgtgcaacaagctagctagtcggcatgtacgtgttggtttagctgaaccaagcaatgccccatgctgtgatatatgcgaaaatgcacctgccttcttttactgtgagatagacggtagttctctttgtctgcaatgtgacatggtagtacatgttggtggcaagagaacacacggtcggtttcttttgctgagacagagaatcgagtttccaggggataagcctaaagaaaacaatacgagggacaatttgcagaaccaaagagtctctacaaatggaaatggtgaagccaatgggaagattgatgacgaaatgattgatctaaatgctaatccacaaagagtacatgagccatcatcaaataacaacgggattgatgtaaataacgagaacaatcacgagcctgcaggccttgtaccagttggaccctttaaacgagagtctgagaagtgataaggtgagagagagagagagaaagagactctttactctgattcaaaaaatcagtttaagaagaagattgtaaaaagtttcaagaactggagatttcatgtccgttttttttccttccttctgattcttagatcgttgctggtgtaaccgagctttgttgttgaa

SEQ ID NO: 602 - protein, 183 aa, Arabidopsis thaliana
  G902
MRILCDACENAAAIIFCAADEAALCRPCDEKVHMCNKLASRHVRVGLAEPSNAPCCDICENAPAFFYCEIDGSSLCLQCDMVVHVGGKRTHGRFLLLRQRIEFPGDKPKENNTRDNLQNQRVSTNGNGEANGKIDDEMIDLNANPQRVHEPSSNNNGIDVNNENNHEPAGLVPVGPFKRESEK

SEQ ID NO: 603 - DNA, 1673 bp, Arabidopsis thaliana
  G903
cccgggtcgacccacgcgtccgctctctctctctgaactatacaaaaacctacttttaatttctcttccaagaagtcaagaacccagaagaagacatgacaagtgaagttcttcaaacaatctcaagtggatcaggttttgctcagccacagagctcatcaaccctggatcatgatgaatctctcatcaatcctcctcttgttaagaaaaagagaaatctccctggaaatcctgatccggaagctgaagtgatagctttatcccccacgaccttgatggctacgaaccggttcctatgtgaggtatgtggcaaaggtttccaaagagaccaaaacttacagcttcatcggcgaggacataatcttccatggaagttgaagcagaggacaagcaaagaagtgagaaaacgtgtctacgtttgccccgagaagacatgtgtccaccatcactcctctagagctctaggcgatctcactggaatcaaaaagcatttttgccggaaacacggggagaagaagtggacgtgcgagaaatgtgctaagagatacgcagtccaatctgattggaaagctcattccaagacttgtggtactagagagtaccgttgcgattgtggcaccattttctcaaggcgagacagctttatcactcatagagctttctgcgatgccttagcggaagaaaccgctaagataaacgcagtgtctcatctcaacggtttagccgcggctggagccccaggatcagttaatctcaactatcaatatctcatgggaacattcatcccaccgcttcaaccatttgtaccacaaccgcaaacaaatccaaaccatcatcatcaacattttcagccaccaacttcttcgtcgctctctctatggatgggacaagatatcgcgccgcctcaaccgcaaccggactacgattgggtttttggaaacgctaaggcagcgtctgcttgcattgataataataatactcacgatgagcagattacgcaaaacgcaaacgcaagtttgaccactaccactactctctctgccccttctttattcagcagcgaccaaccacaaaacgcaaacgcaaattcaaacgtgaatatgtccgcgacagctttactacagaaagctgctgaaattggcgctacttctacaacaaccgcagcgaccaatgacccatcaacgtttcttcaaagtttcccgcttaaatccaccgatcaaaccaccagttatgacagtggcgaaaagttttttgctttgttcgggtctaacaacaacattgggttaatgagtcgtagtcatgatcatcaagagatcgagaacgctagaaatgacgttacggttgcgtctgccttggatgaattacagaattacccttggaaacgtagaagagttgatggtggaggtgaagtgggtggaggagggcaaactcgggatttcctcggggttggtgtacaaacgttgtgccatccatcgtctatcaatggatggatttgaaagagtttaaaaatttcggggttaatgcataaattacgtaaaagaagaaggaatcttttgtcatttccaccattttctaagataacatatgtatatggtaatggaagttgttttcttttattaattcaatattctaaaacttatgatatatgtataatgaatgtgtttatcttcaaa

SEQ ID NO: 604 - protein, 466 aa, Arabidopsis thaliana
  G903
MTSEVLQTISSGSGFAQPQSSSTLDHDESLINPPLVKKKRNLPGNPDPEAEVIALSPTTLMATNRFLCEVCGKGFQRDQNLQLHRRGHNLPWKLKQRTSKEVRKRVYVCPEKTCVHHHSSRALGDLTGIKKHFCRKHGEKKWTCEKCAKRYAVQSDWKAHSKTCGTREYRCDCGTIFSRRDSFITHRAFCDALAEETAKINAVSHLNGLAAAGAPGSVNLNYQYLMGTFIPPLQPFVPQPQTNPNHHHQHFQPPTSSSLSLWMGQDIAPPQPQPDYDWVFGNAKAASACIDNNNTHDEQITQNANASLTTTTTLSAPSLFSSDQPQNANANSNVNMSATALLQKAAEIGATSTTTAATNDPSTFLQSFPLKSTDQTTSYDSGEKFFALFGSNNNIGLMSRSHDHQEIENARNDVTVASALDELQNYPWKRRRVDGGGEVGGGGQTRDFLGVGVQTLCHPSSINGWI

SEQ ID NO: 605 - DNA, 1197 bp, Arabidopsis thaliana
  G905
tacttccaccatcaaatcgtcaaaccatttgcaaccatcgatggtggtcatgtcacgagtaagcttctactcttctttcttgctactactgttagaggtcgttgtcgctagcagcgagtttgatgatgaaggaagaacatcgttcagtccaaccacggctataatcatgatcgtactcgttagtgttttcttcgcacttggatgtatctccgtctacatgaggaggtgtctccagcacgctctggggatggacagcggtggtggtccaggaaactggcttaacgtgaggcaaacgacggagcctgggctagacgcgtctgttatagaaacgtttccaacgtttccttactctacagtgaagacgttgaggatcggtaaagaagctttggagtgtcccgtttgtctcaacgagttcgaggacgacgaaacgctgcgtttgattcctcagtgttgtcacgtgtttcatcctggttgcattgatgcctggctccgttctcagaccacatgtcctctttgccgagccaatctcgttcctgtaccgggtgagtctgtttcttcggagatacccggtttagctagagaaaccggtcagaactctctcagaacgccgattgatgataaccggaaaagggttttaacttcacctgacgagcggttgattgactcagtggcttggacgggtaaccaaagcatgccacgtaaatccatgtctacaggttggaaactagctgaattgtacagcccggctagttcaccgggccaaccggaggagaatctcgaccggtatacgctgaggttaccacaagagatacatgaccagcttgtgaactccagcctgggaaagcaagggtcaaaaggccaactggccttacctcaagaaaggagctcggttagagggttcagaaccggaagcctagggactgaaaagaactatttctactttgaacggtttgatcaagacggtcggttggaccggagaccattttctataactcctccataccatacccggtcgatacagtctccggatgagattatcaacgctagtggtaattatcaggatcgtgctggtgcacctaaaggtttgcttctagcaataaggtcaccgtttgatcggttatttactgggaagaaaaatgccggtgagcgttcgtaccttcaatccggcgatgcgagccctgtctaggcgaattacta

SEQ ID NO: 606 - protein, 381 aa, Arabidopsis thaliana
  G905
MVVMSRVSFYSSFLLLLLEVVVASSEFDDEGRTSFSPTTAIIMIVLVSVFFALGCISVYMRRCLQHALGMDSGGGPGNWLNVRQTTEPGLDASVIETFPTFPYSTVKTLRIGKEALECPVCLNEFEDDETLRLIPQCCHVFHPGCIDAWLRSQTTCPLCRANLVPVPGESVSSEIPGLARETGQNSLRTPIDDNRKRVLTSPDERLIDSVAWTGNQSMPRKSMSTGWKLAELYSPASSPGQPEENLDRYTLRLPQEIHDQLVNSSLGKQGSKGQLALPQERSSVRGFRTGSLGTEKNYFYFERFDQDGRLDRRPFSITPPYHTRSIQSPDEIINASGNYQDRAGAPKGLLLAIRSPFDRLFTGKKNAGERSYLQSGDASPV

SEQ ID NO: 607 - DNA, 1080 bp, Arabidopsis thaliana
  G907
atgatgatcggagaatctcatcgtggttttaatccaacggttcatattcctccatggccactttctgaagatctaacggtgtctgatatttacggaagtccagacggaggaagtagtatgatggaagctttggctgagttacaacgttatcttccgtcaaacgaaccggatccggattcagatccggatctctcgggtccggattcaccaatcgatgcttatacatgcgatcattttcggatgtatgagtttaaagtgagacgttgtgctcgtggccggagccatgattggacggagtgtccttacgctcatcccggagaaaaagctcgccgtcgtgatccgaggaagtttcattactccggtacggcgtgtcctgagtttcgtaaaggttgttgcaagagaggagacgcatgtgagttttctcatggtgtttttgagtgttggcttcacccggcgcgttaccggactcagccgtgtaaagacggtggtaactgtcgccgtcgtgtttgtttctttgctcattcgccggatcagattagggttttgcctaatcaaagccctgatcgtgttgattcgttcgacgttttgtctcctacgattcgtagagcgtttcagttttcgatttctccgtcgtctaactcgccgccggtgagtccacgaggtgactcggactcgtcgtgttcgttactgagtcgttcactcgggtctaatctgggaaacgacgtcgttgcgtctctcaggaatctgcaacttaataaagtgaagtcttctctttcgtcgtcatacaacaatcaaatcggaggatacggatccggattcgggtcgcctcgtggatcggttttgggtcctggtttccgtagcttaccaactacaccgacccgacctggttttatgaacatttgggagaatggcttggaggaagaaccggcgatggaacgggtcgagtcgggtcgtgaactgcgagcgcagctgttcgagaagctgagcaaagagaattgcatgggtcggattgaaccggatccggatcagggagcgggtgatactcctgatgtcgggtgggtctctgacttggttatgtga

SEQ ID NO: 608 - protein, 359 aa, Arabidopsis thaliana
  G907
MMIGESHRGFNPTVHIPPWPLSEDLTVSDIYGSPDGGSSMMEALAELQRYLPSNEPDPDSDPDLSGPDSPIDAYTCDHFRMYEFKVRRCARGRSHDWTECPYAHPGEKARRRDPRKFHYSGTACPEFRKGCCKRGDACEFSHGVFECWLHPARYRTQPCKDGGNCRRRVCFFAHSPDQIRVLPNQSPDRVDSFDVLSPTIRRAFQFSISPSSNSPPVSPRGDSDSSCSLLSRSLGSNLGNDVVASLRNLQLNKVKSSLSSSYNNQIGGYGSGFGSPRGSVLGPGFRSLPTTPTRPGFMNIWENGLEEEPAMERVESGRELRAQLFEKLSKENCMGRIEPDPDQGAGDTPDVGWVSDLVM

SEQ ID NO: 609 - DNA, 1432 bp, Arabidopsis thaliana
  G908
attctgagatagagaaagatgtcaggtttagcttgtaattcgtgtaacaaagacttcgaagacgacgctgagcagaagtttcactacaaatccgaatggcaccgttacaatctcaagcgcaagatagctggtgttcctggagtaacagaggcactatttgaagctagacaagctgctatagctcaagagaaggttaaagctgttgaagcaccgatgctttatagttgtggaatctgtaacaaaggttacaggagttccaaggctcatgagcagcatcttaagtcgaagagtcatgttttgaaggcttcgacgagtactggagaggaggataaagcgatcatcaagcagcttccgcctcgtcgtgttgagaagaataacactgctcaattgaagggttcgattgaggaggaagagagtgaagatgaatggattgaggttgattcggatgaggatttggatgcggaaatgaatgaggatggtgaagaagaagatatggatgaagatggtattgaatttgagttggatccggcttgttgtttgatgtgtgataagaagcataagactatagagaaatgtatggttcatatgcataagtttcatgggttcttcattcctgatattgagtacttgaaggatcctaaagggtttctgacctacctcggtctaaaggtcaagagagacttcgtgtgtctgtactgcaatgaattgtgccatccatttagtagtttggaagctgttcgtaagcatatggacgccaaaggtcattgcaaagtgcattatggtgatggtggtgatgaagaagatgcagaacttgaagagttctatgactacagcagcagctatgtcaatggagacgaaaatcagatggttgtgtccggtgagtcagtgaacactgtagagctttttggtgggtctgagcttgtgatcaccaagagaaccgataacaaagtaacgtctaggactcttgggtctcgagaattcatgcgctactacaaacagaagccagcaccgtcttctcagaagcatattgtcaactctctaacctccaggtacaagatgatgggtctagcaacagtgcagtcaaaggaggccatagtgaggatgaaggtgatgagagagatgaacaaaagaggagcgaaaagcagtgtcaggctcggaatgaagagcaacgtcatcaggaatctgcccaacaatgtcacctattagtcttgctcctcgattttcaggtctctcctctttgtttgattttgtgaccagagttttggtgagtaaatctatctaagtttttcactagtactcaagtatcttaggcccatttgggtctctgttttgtctgatttagtcttttgaaaatgttacgttttggctgagtttgtatctcttgcccagtgctttgtacactctacattaatctatatttcatttggtagaa

SEQ ID NO: 610 - protein, 395 aa, Arabidopsis thaliana
  G908
MSGLACNSCNKDFEDDAEQKFHYKSEWHRYNLKRKIAGVPGVTEALFEARQAAIAQEKVKAVEAPMLYSCGICNKGYRSSKAHEQHLKSKSHVLKASTSTGEEDKAIIKQLPPRRVEKNNTAQLKGSIEEEESEDEWIEVDSDEDLDAEMNEDGEEEDMDEDGIEFELDPACCLMCDKKHKTIEKCMVHMHKFHGFFIPDIEYLKDPKGFLTYLGLKVKRDFVCLYCNELCHPFSSLEAVRKHMDAKGHCKVHYGDGGDEEDAELEEFYDYSSSYVNGDENQMVVSGESVNTVELFGGSELVITKRTDNKVTSRTLGSREFMRYYKQKPAPSSQKHIVNSLTSRYKMMGLATVQSKEAIVRMKVMREMNKRGAKSSVRLGMKSNVIRNLPNNVTY

SEQ ID NO: 611 - DNA, 760 bp, Arabidopsis thaliana
  G909
aaaaaaaagataaaacaaaaaaaatgtctttcacaggaactctcgacaaatgcaatgtttgtgataagacagtctatgtggtggacatgttgtccattgaaggaatgccttaccacaagtcttgcttcaggtgtacccattgcaaaggaacccttcagatgagcaactattcctccatggatggagttttgtactgcaagactcattttgagcaactcttcaaggaatctggcaatttcagcaaaaactttcaaccaggaaaaactgagaagccagagctgactaggactcccagcaagatatcttccatcttctgtggaacacaagacaagtgtgccgcttgcgaaaaaactgtttaccctcttgaaaagatacaaatggaaggagaatgcttccacaagacatgtttccggtgcgctcacggtgggtgtacgctgactcactcctcctacgcctccttagatagcgttctctattgccgacatcactttaaccaactcttcatggagaaaggaaactacgctcacgtcctccaagccgccaatcaccgtcgcacagcctcaggcaacactcttccaccggaacctaccgaagacgtcgccgtggaggccaaggaagagaatggcgtttcagagtcttgaatatctcttacctgagtgtttttgagtgaatgattgaatgaatgttgttgcgggggaaagatttgatttcatttgtaatgagttgtttccatatgaagacatgaatttttttgttaaaa

SEQ ID NO: 612 - protein, 205 aa, Arabidopsis thaliana
  G909
MSFTGTLDKCNVCDKTVYVVDMLSIEGMPYHKSCFRCTHCKGTLQMSNYSSMDGVLYCKTHFEQLFKESGNFSKNFQPGKTEKPELTRTPSKISSIFCGTQDKCAACEKTVYPLEKIQMEGECFHKTCFRCAHGGCTLTHSSYASLDSVLYCRHHFNQLFMEKGNYAHVLQAANHRRTASGNTLPPEPTEDVAVEAKEENGVSES

SEQ ID NO: 613 - DNA, 480 bp, Arabidopsis thaliana
  G911
atgggtcttcctgaagatttcatcaccgagcttcagattccaggttacatattaaagatactttacgtcatcggtttctttagagacatggtcgatgctctttgtccttacattggtctacctagttttctagaccacaacgagacctctggacccgatccgacccgacacgctctctctacgtcagcgagtcttgctaacgagttgatcccggtggttcggttctcggatcttccgaccgatccggaagattgttgtacggtttgtttgtcagattttgagtccgacgataaggttaggcagctacccaagtgtggacacgtgtttcatcatcattgtttagaccgttggatcgttgactacaacaagatgaaatgtccggtttgtcggcaccggttcttaccgaaagaaaagtacacgcaatgtgattggggttctggttcagattggtttagtgatgaagtggaaagtaccaactaa

SEQ ID NO: 614 - protein, 159 aa, Arabidopsis thaliana
  G911
MGLPEDFITELQIPGYILKILYVIGFFRDMVDALCPYIGLPSFLDHNETSGPDPTRHALSTSASLANELIPVVRFSDLPTDPEDCCTVCLSDFESDDKVRQLPKCGHVFHHHCLDRWIVDYNKMKCPVCRHRFLPKEKYTQCDWGSGSDWFSDEVESTN

SEQ ID NO: 615 - DNA, 724 bp, Arabidopsis thaliana
  G912
catcttatccaaagaaaaaatgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctgattctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaattttttggctctttttctggataataagtt

SEQ ID NO: 616 - protein, 224 aa, Arabidopsis thaliana
  G912
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDE

SEQ ID NO: 617 - DNA, 1892 bp, Arabidopsis thaliana
  G915
atcacttctctcattttcttcttctccaagcccccctcctttctatatatatctgaaattggtcttttataaaacaaacttccatttttcgtatggctgcttcttttcttacaatggacaatagcagaaccagacaaaacatgaatggttctgctaattggtcacaacaatccggaagaacatctacttcctctttggaagatcttgagataccaaagttcagatcttttgctccttcttcaatctctatctctccttctcttgtctctccttccacttgtttcagtccctctctttttctcgattcccctgcttttgtctcctcctctgctaacgttctagcttctccaaccacaggagctttaatcacaaacgtaactaaccagaaaggtataaatgaaggagacaagagcaacaacaacaactttaacttattcgatttctcattccacacacaatcatcaggagtttctgctccgaccacaactacaactacaactacaactacaacaacaacaaacagttctatctttcaatctcaggaacaacagaagaagaaccagtcagaacaatggagccaaaccgagactcgtccaaacaatcaagctgtatcttacaatggaagagagcaaaggaaaggagaggatggttacaattggagaaagtacggacaaaaacaggtgaaaggaagtgagaatcctcggagttactataagtgtactttccctaattgtccaacgaagaagaaagtggagagatctttggaaggtcagatcacagagattgtgtataaaggaagccacaaccatcctaaacctcagtctactagaagatcttcttcgtcttcttcgacttttcattcagctgtgtacaatgccagtttggatcataatcgtcaagcttcttctgatcagcctaattccaataatagctttcatcagtctgattcctttgggatgcaacaagaggataatactacttctgattctgttggtgacgatgagttcgaacaaggctcatcgattgtcagcagagacgaagaagattgtgggagtgaacctgaagcaaagagatggaaaggggacaatgaaacaaatggtgggaatggtggtggaagcaagacagtgagagagccgagaatcgtagtgcagacaacgagtgatattgacattcttgacgacggttacagatggagaaaatacggccagaaagtcgttaagggaaacccaaatccaagaagctactacaagtgcacaaccatcggttgtccagtgaggaaacatgtggagagagcatcacacgacatgagagcagtaatcacaacctacgaagggaaacacaaccacgatgttcctgcagctcgtggtagcggttacgccacaaacagagcaccacaggattcgtcttcagtcccgattagaccagctgctattgctggtcactccaactacactacttcttctcaagcaccatatacacttcagatgctgcacaacaacaacactaataccgggccttttggttacgccatgaacaacaataacaacaacagcaaccttcaaacgcaacaaaactttgttggtggtggattctctagagcaaaggaagaaccaaacgaggagacctcatttttcgattcgtttatgccctgaagaaaaaaggaaccagttgttccttttttatgttccttttgtacatttctgccaccaaaggattttactacttactagttatcctgcaggatagtaagtcagacttctatagtccatagagaaattttttcatttgttttttcacacgcctgtaatatgtttaatgtttgtactttgtaccatagaactagaacacggaataaaaccaatcaattttcagtttcaaaaaaaaaaaaaaaa

SEQ ID NO: 618 - protein, 519 aa, Arabidopsis thaliana
  G915
MAASFLTMDNSRTRQNMNGSANWSQQSGRTSTSSLEDLEIPKFRSFAPSSISISPSLVSPSTCFSPSLFLDSPAFVSSSANVLASPTTGALITNVTNQKGINEGDKSNNNNFNLFDFSFHTQSSGVSAPTTTTTTTTTTTTTNSSIFQSQEQQKKNQSEQWSQTETRPNNQAVSYNGREQRKGEDGYNWRKYGQKQVKGSENPRSYYKCTFPNCPTKKKVERSLEGQITEIVYKGSHNHPKPQSTRRSSSSSSTFHSAVYNASLDHNRQASSDQPNSNNSFHQSDSFGMQQEDNTTSDSVGDDEFEQGSSIVSRDEEDCGSEPEAKRWKGDNETNGGNGGGSKTVREPRIVVQTTSDIDILDDGYRWRKYGQKVVKGNPNPRSYYKCTTIGCPVRKHVERASHDMRAVITTYEGKHNHDVPAARGSGYATNRAPQDSSSVPIRPAAIAGHSNYTTSSQAPYTLQMLHNNNTNTGPFGYAMNNNNNNSNLQTQQNFVGGGFSRAKEEPNEETSFFDSFMP

SEQ ID NO: 619 - DNA, 1130 bp, Arabidopsis thaliana
  misc_feature (1100)..(1100): n is a, c, g, or t
  G921
ccaagatcgactcttacttcgaatctctctcaactttcttcctcagcttacgggaacttccacacatatacatccacaagaacccatatcgaagattcatcctacatatatttacatggatcagtactcatcctctttggtcgatacttcattagatctcactattggcgttactcgtatgcgagttgaagaagatccaccgacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgttgtgaaagatgggtatcaatggaggaaatatggacagaaagtgactagagacaatccatctccaagagcttacttcaaatgtgcttgtgctccaagctgttctgtcaaaaagaaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatagtttagcttcaaattccgttagagtttttagatttgaatttgtcatgagtaagagaaagagagtagattataatccnttgtgatactgaaaaaaaaaaaaaaaaaaa

SEQ ID NO: 620 - protein, 302 aa, Arabidopsis thaliana
  G921
MDQYSSSLVDTSLDLTIGVTRMRVEEDPPTSALVEELNRVSAENKKLSEMLTLMCDNYNVLRKQLMEYVNKSNITERDQISPPKKRKSPAREDAFSCAVIGGVSESSSTDQDEYLCKKQREETVVKEKVSRVYYKTEASDTTLVVKDGYQWRKYGQKVTRDNPSPRAYFKCACAPSCSVKKKVQRSVEDQSVLVATYEGEHNHPMPSQIDSNNGLNRHISHGGSASTPVAANRRSSLTVPVTTVDMIESKKVTSPTSRIDFPQVQKLLVEQMASSLTKDPNFTAALAAAVTGKLYQQNHTEK

SEQ ID NO: 621 - DNA, 1516 bp, Arabidopsis thaliana
  G928
ctcatggcgatgttggtttcccaggaaaggtaaaagagacggagacgaaccaaaacaaggaagaaagaagaagatcttacatacgaagatcactctctgattcactctgagagacaaactggtttactttggttctgtttgacaaaaggagacatgcaaaaataaatctctatcccttgtttttcttcttcgcttcatcgattactcaaagaggttgttggttgtgagaataattagcttgttaaggaagacgttatgatgcatcagatgttgaataagaaagattcagctactcattccactttgccataccttaatactagcatctcttggggagtggttccaactgattccgttgctaatcgtcgcggtcctgctgaatcactaagcttgaaggttgattcaagacctgggcatatacaaactacaaagcaaatcagttttcaggaccaagattcatcttcaacacagtccactggtcaatcttatactgaagttgctagtagtggtgatgataatccttccagacaaatctccttttcggctaaatcaggatctgaaataactcaacggaaggggtttgcaagtaatcctaaacaaggctcgatgactggatttccgaatattcactttgctcctgcacaggctaatttctcatttcactatgctgatccacattatggtggtttattagctgcaacttacctaccacaggcaccaacatgcaatcctcaaatggtgagtatgattcctggtcgtgttcctttaccagcagagctcacagaaactgatccagtctttgtcaatgcgaagcaataccacgcaattatgaggaggagacagcaacgtgctaagcttgaggctcaaaacaaactaatcagagcccgtaagccctatcttcatgagtctcgacatgttcatgctcttaaaaggccaagaggatctggtggaagattcctaaacaccaaaaaacttcttcaagaatccgaacaggctgctgctagagaacaagaacaggacaagttaggccaacaggtaaacagaaagaccaacatgtctagattcgaagctcatatgctgcagaacaacaaagaccgcagctcaaccacttctggctcagacatcacctctgtttccgacggtgctgatatctttggacacactgaattccagttttcaggtttcccaactccgataaaccgagccatgcttgttcatggtcagtctaatgacatgcatggaggtggagacatgcaccatttctctgtccatatctgagacagtggatcttggtgctgtgttcatgttcccaccaagaaggggaagtcatccttggctactactagttctttcgcttgttgtaacttcagtgtttttatttcatattatgtctgtgttagacatcacaagaacgaccaagatcttcactttgaaacactctattaccttttcatcttctgttaccatggatctcttgtctaaactagtgatatgattcttctgataaaaaaaaaaa

SEQ ID NO: 622 - protein, 340 aa, Arabidopsis thaliana
  G928
MMHQMLNKKDSATHSTLPYLNTSISWGVVPTDSVANRRGPAESLSLKVDSRPGHIQTTKQISFQDQDSSSTQSTGQSYTEVASSGDDNPSRQISFSAKSGSEITQRKGFASNPKQGSMTGFPNIHFAPAQANFSFHYADPHYGGLLAATYLPQAPTCNPQMVSMIPGRVPLPAELTETDPVFVNAKQYHAIMRRRQQRAKLEAQNKLIRARKPYLHESRHVHALKRPRGSGGRFLNTKKLLQESEQAAAREQEQDKLGQQVNRKTNMSRFEAHMLQNNKDRSSTTSGSDITSVSDGADIFGHTEFQFSGFPTPINRAMLVHGQSNDMHGGGDMHHFSVHI

SEQ ID NO: 623 - DNA, 953 bp, Arabidopsis thaliana
  G929
ggagagacctttaacaattttctgagggtaagatccagagattgattgaatcagcttactattttatataattcagtttgttgttcctcagacttgtaactaggacagtcttctcatgaatcatgacttcttcagtacatgagctctctgataacaatgaaagtcatgcgaagaaagaacgtccagattcccaaacccgaccacaggttccttcaggacgaagttcggaatctattgatacaaactctgtctactcagagcccatggcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatcttgaggaaggtttctgcacaaccacaagtttagtttctattttgggtggatgttctcagggcatcatcgtctttagtgtttttggatacgctgtgtacaggttatttgctagggtaaactttgttttagcgattagaaataaaactaagcaaagaaatgaaaagtgtgattggaagtattgttgtaccaaattgatattctttgccaatgaactcatgttttggaaagtaaaaaaaaa

SEQ ID NO: 624 - protein, 198 aa, Arabidopsis thaliana
  G929
MTSSVHELSDNNESHAKKERPDSQTRPQVPSGRSSESIDTNSVYSEPMAHGLYPYPDPYYRSVFAQQAYLPHPYPGVQLQLMGMQQPGVPLQCDAVEEPVFVNAKQYHGILRRRQSRAKLEARNRAIKAKKPYMHESRHLHAIRRPRGCGGRFLNAKKENGDHKEEEEATSDENTSEASSSLRSEKLAMATSGPNGRS

SEQ ID NO: 625 - DNA, 1180 bp, Arabidopsis thaliana
  G931
ggaggttctttgacagacacatgtatcatcaatcttctctgttgaagcagagagagagagagctaattgttgcctctgagtcacatggataagaaagtttcatttactagctctgtggcacattcaactccaccataccttagtacttccatctcatggggacttccaaccaaatccaatggtgtgactgaatcactgagtttgaaggtggtagatgcaagaccagaacgtcttataaacacaaagaatatcagtttccaggaccaggattcatcttcaactctgtcctctgctcaatcttctaacgatgttacaagtagtggagatgataacccctcaagacaaatctcatttttagcacattcagatgtttgtaaaggatttgaagaaactcaaaggaagcgatttgcaattaaatcaggctcctccacggcaggaatcgctgatattcactcttctccttccaaggctaacttctcatttcactatgccgatccacattttggtggtttaatgcctgcggcttacctaccacaggcaacaatatggaatccccaaatgactcgagttccgctaccattcgatctcatagagaatgagcctgtctttgtcaatgcaaagcaattccatgcaattatgaggaggaggcaacagcgtgctaagctagaggcgcaaaacaaactaatcaaagcccgtaagccgtatcttcatgaatctcgacatgttcacgctcttaaacgacctagaggatctggtggaagattcctaaacaccaaaaagcttcaagaatctacagatccaaaacaagacatgccaatccaacagcaacacgcaacgggaaacatgtcaagatttgtgctttatcagttgcagaacagcaatgactgtgattgttcaaccacttctcgctctgacatcacatctgcttctgacagcgttaatctctttggacactctgaatttctgatatcagattgcccatctcagacaaacccaacaatgtatgttcatggtcaatcaaatgacatgcatggaggtaggaacacacaccatttctctgtccatatctgagccggtggaatctggtaatgtgtacgttcctacaaaaaaagggaagtcatccttggctgctacttcgcttattagctagttcttatttcacacgctttgtccagatatc

SEQ ID NO: 626 - protein, 328 aa, Arabidopsis thaliana
  G931
MDKKVSFTSSVAHSTPPYLSTSISWGLPTKSNGVTESLSLKVVDARPERLINTKNISFQDQDSSSTLSSAQSSNDVTSSGDDNPSRQISFLAHSDVCKGFEETQRKRFAIKSGSSTAGIADIHSSPSKANFSFHYADPHFGGLMPAAYLPQATIWNPQMTRVPLPFDLIENEPVFVNAKQFHAIMRRRQQRAKLEAQNKLIKARKPYLHESRHVHALKRPRGSGGRFLNTKKLQESTDPKQDMPIQQQHATGNMSRFVLYQLQNSNDCDCSTTSRSDITSASDSVNLFGHSEFLISDCPSQTNPTMYVHGQSNDMHGGRNTHHFSVHI

SEQ ID NO: 627 - DNA, 1519 bp, Arabidopsis thaliana
  G932
ccacgcgtccgaccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaaaaaaaaaaaaaaaaa

SEQ ID NO: 628 - protein, 335 aa, Arabidopsis thaliana
  G932
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 629 - DNA, 1440 bp, Arabidopsis thaliana
  G935
atgaatgcacagcctgaattatcaggcataattgatataaccaagacttatatgtatgagaaattatggaacatatgtgctggacctttgtgtgttcttccgaaacctggagaaaaagtttattactttcctcaagggcacatcgagctcattgagaattctacaagagatgaattggatcatatcaggccaatttttgatcttccatctaagcttcgatgtcgtgttgtggctattgatcgtaaggtagacaaaaatacagatgaagtctatgctcagatttcgttaatgcctgatacaacagatatgtcccaaccaatatccacacaaaatcttgttgcaaaggatctctatggtcaagaatggagtttcaaacatgtctttagaggtacaccgcagagacatatgtttactagcggcggcggctggagcgtatttgcaacaacaaaaagattgattgttggggatatatttgtactccttagaggagagaatggggagttacgatttggtattaggcgagcaaagcatcaacaaggccacataccttcatcagtaatatcagcaaattgtatgcaacatggagtaatagcttcagtagtgaatgcttttaaaaccaaatgcatgttcaatgtggtttataagccaagttcaagtcaatttgttataagctatgacaaatttgttgatgcaatgaacaataattacattgttggttcgagatttaggatgcagtttgagggtaaggatttttctgaaaaaagatacgatgggacgattattggtgtaaatgacatgtctcctcattggaaggattcagaatggcgaagcctaaaaatattttcatatataggtgcaacattatcgaatctttggacatgccaagaaattggacaacggagcatgaattctcctataagtgttcctgagtttagttatcccaatgcaattgaagattcaaagtttctttctggtttgctactgaatcactcactcctagccatacctaatgaaaactataacagcgaccaaatgattcaaccaaggaaagaagatataacaactgaagcaaccactagttgcctcttgtttggagttgatctgaccaaagttcatatgcaaggtgtagccataagtagagctgtggatttaactgctatgcatggatacaatcagctgatacaaaaactggaagaactctttgatctcaaagacgagttacgaactcgcaatcaatgggaaatagtttttacaaacaatgaaggagctgagatgcttgtcggggatgatccatggcctgagttctgcaatatggcgaaaagaatattcatatgctcaaaagaggagataaagaaaatgaagttgaagaacaaattctttcaacctgaatcaaaagctttaacatcttcagacgtaccaccaaacgtcacagataactaa

SEQ ID NO: 630 - protein, 479 aa, Arabidopsis thaliana
  G935
MNAQPELSGIIDITKTYMYEKLWNICAGPLCVLPKPGEKVYYFPQGHIELIENSTRDELDHIRPIFDLPSKLRCRVVAIDRKVDKNTDEVYAQISLMPDTTDMSQPISTQNLVAKDLYGQEWSFKHVFRGTPQRHMFTSGGGWSVFATTKRLIVGDIFVLLRGENGELRFGIRRAKHQQGHIPSSVISANCMQHGVIASVVNAFKTKCMFNVVYKPSSSQFVISYDKFVDAMNNNYIVGSRFRMQFEGKDFSEKRYDGTIIGVNDMSPHWKDSEWRSLKIFSYIGATLSNLWTCQEIGQRSMNSPISVPEFSYPNAIEDSKFLSGLLLNHSLLAIPNENYNSDQMIQPRKEDITTEATTSCLLFGVDLTKVHMQGVAISRAVDLTAMHGYNQLIQKLEELFDLKDELRTRNQWEIVFTNNEGAEMLVGDDPWPEFCNMAKRIFICSKEEIKKMKLKNKFFQPESKALTSSDVPPNVTDN

SEQ ID NO: 631 - DNA, 1755 bp, Arabidopsis thaliana
  G938
atgatgatgtttaacgagatgggaatgtatggaaacatggatttcttctcttcctccacatctctcgatgtgtgtccattaccacaagctgaacaagaacctgtagttgaagatgtcgactacaccgatgatgagatggatgtggatgagcttgagaagaggatgtggagagacaaaatgcgtttgaaacgtctcaaggagcaacagagtaagtgtaaagaaggcgtcgatggttcgaaacagaggcagtcgcaagagcaagctaggaggaagaaaatgtctagagcccaagatgggatcttgaagtatatgttgaagatgatggaagtttgtaaagctcaaggctttgtttatggtattattcctgagaagggtaagcctgtgactggtgcttcggataatttgagggaatggtggaaagataaggttaggtttgatcgtaatggtccagctgctattgctaagtatcagtcagagaataatatttctggagggagtaatgattgtaacagcttggttggtccaacaccgcatacgcttcaggagcttcaggacacgactcttggttcgcttttatcggctttgatgcaacattgtgatccaccgcagagacggtttcctttggagaaaggagtttctccaccttggtggcctaatgggaatgaagagtggtggcctcagcttggtttaccaaatgagcaaggtcctcctccttataagaagcctcatgatttgaagaaagcttggaaagtcggtgttttaactgcggtgatcaagcatatgtcgccggatattgcgaagatccgtaagcttgtgaggcaatcaaaatgcttgcaggataagatgacggcgaaagagagtgctacttggcttgccattattaaccaagaagaggttgtggctcgggagctttatcccgagtcatgccctcctctttcttcttcttcatcattaggaagcgggtcgcttctcattaatgattgtagcgagtatgacgttgaaggtttcgagaaggaacaacatggtttcgatgtggaagagcggaaaccagagatagtgatgatgcatcctctagcaagctttggggttgctaaaatgcaacattttcccataaaggaggaggtcgccaccacggtaaacttagagttcacgagaaagaggaagcagaacaatgatatgaatgttatggtaatggacagatcagcaggttacacttgtgagaatggtcagtgtcctcacagcaaaatgaatcttggatttcaagacaggagttcaagggacaaccaccagatggtttgtccatatagagacaatcgtttagcgtatggagcatccaagtttcatatgggtggaatgaaactagtagttcctcagcaaccagtccaaccgatcgacctatcgggcgttggagttccggaaaacgggcagaagatgatcaccgagcttatggccatgtacgacagaaatgtccaaagcaaccaaacgcctcctactttgatggaaaaccaaagcatggtcattgatgcaaaagcagctcagaatcagcagctgaatttcaacagtggcaatcaaatgtttatgcaacaagggacgaacaacggggttaacaatcggttccagatggtgtttgattcgacaccattcgatatggcagcattcgattacagagatgattggcaaaccggagcaatggaaggaatggggaagcagcagcagcagcagcagcagcagcaagatgtatcaatatggttctga

SEQ ID NO: 632 - protein, 584 aa, Arabidopsis thaliana
  G938
MMMFNEMGMYGNMDFFSSSTSLDVCPLPQAEQEPVVEDVDYTDDEMDVDELEKRMWRDKMRLKRLKEQQSKCKEGVDGSKQRQSQEQARRKKMSRAQDGILKYMLKMMEVCKAQGFVYGIIPEKGKPVTGASDNLREWWKDKVRFDRNGPAAIAKYQSENNISGGSNDCNSLVGPTPHTLQELQDTTLGSLLSALMQHCDPPQRRFPLEKGVSPPWWPNGNEEWWPQLGLPNEQGPPPYKKPHDLKKAWKVGVLTAVIKHMSPDIAKIRKLVRQSKCLQDKMTAKESATWLAIINQEEVVARELYPESCPPLSSSSSLGSGSLLINDCSEYDVEGFEKEQHGFDVEERKPEIVMMHPLASFGVAKMQHFPIKEEVATTVNLEFTRKRKQNNDMNVMVMDRSAGYTCENGQCPHSKMNLGFQDRSSRDNHQMVCPYRDNRLAYGASKFHMGGMKLVVPQQPVQPIDLSGVGVPENGQKMITELMAMYDRNVQSNQTPPTLMENQSMVIDAKAAQNQQLNFNSGNQMFMQQGTNNGVNNRFQMVFDSTPFDMAAFDYRDDWQTGAMEGMGKQQQQQQQQQDVSIWF

SEQ ID NO: 633 - DNA, 1095 bp, Arabidopsis thaliana
  G961
atgtcaaaatctatgagcatatcagtgaacggacaatctcaagtgcctcctgggtttaggtttcatccgaccgaggaagagctgttgcagtattatctccggaagaaagttaatagcatcgagatcgatcttgatgtcattcgcgacgttgatctcaacaagctcgagccttgggacattcaagagatgtgtaaaataggaacaacgccacaaaacgactggtatttctttagccacaaggacaaaaaatatccgacgggaacgagaactaacagagccactgcggctggattttggaaagcaactggccgcgacaagatcatatatagcaatggccgtagaattgggatgagaaagactcttgttttctacaaaggccgagctcctcacggccaaaaatctgattggatcatgcatgaatatagactcgatgacaacattatttcccccgaggatgtcaccgttcatgaggtcgtgagtattataggggaagcatcacaagacgaaggatgggtggtgtgtcgtattttcaagaagaagaatcttcacaaaaccctaaacagtcccgtcggaggagcttccctgagcggcggcggagatacgccgaagacgacatcatctcagatcttcaacgaggatactctcgaccaatttcttgaacttatggggagatcttgtaaagaagagctaaatcttgaccctttcatgaaactcccaaacctcgaaagccctaacagtcaggcaatcaacaactgccacgtaagctctcccgacactaatcataatatccacgtcagcaacgtggtcgacactagctttgttactagctgggcggctttagaccgcctcgtggcctcgcagcttaacggacccacatcatattcaattacagccgtcaatgagagccacgtgggccatgatcatctcgctttgccttccgtccgatctccgtaccccagcctaaaccggtccgcttcgtaccacgccggtttaacacaggaatatacaccggagatggagctatggaatacgacgacgtcgtctctatcgtcatcgcctggcccattttgtcacgtgtcgaatggtagtggataa

SEQ ID NO: 634 - protein, 364 aa, Arabidopsis thaliana
  G961
MSKSMSISVNGQSQVPPGFRFHPTEEELLQYYLRKKVNSIEIDLDVIRDVDLNKLEPWDIQEMCKIGTTPQNDWYFFSHKDKKYPTGTRTNRATAAGFWKATGRDKIIYSNGRRIGMRKTLVFYKGRAPHGQKSDWIMHEYRLDDNIISPEDVTVHEVVSIIGEASQDEGWVVCRIFKKKNLHKTLNSPVGGASLSGGGDTPKTTSSQIFNEDTLDQFLELMGRSCKEELNLDPFMKLPNLESPNSQAINNCHVSSPDTNHNIHVSNVVDTSFVTSWAALDRLVASQLNGPTSYSITAVNESHVGHDHLALPSVRSPYPSLNRSASYHAGLTQEYTPEMELWNTTTSSLSSSPGPFCHVSNGSG

SEQ ID NO: 635 - DNA, 1221 bp, Arabidopsis thaliana
  G964
atttctcttccacaaagagtcctaacttcgagttgaaacaaacaccatttctcatctctatctcagaaagaacaaaccatttcgtgttctttctttctctattctcataaggaaatataattcctgaaactgttgagttcttgtgaaaggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtagctggtccatcatcatcgaaccatcaccacaatcacaggccggtttcgattaacccgtggattgcttgtgctggtcaggtggctcatgggctgaattttgaagccttgcgtccacgatcgtaatttttagtggtgggggaagggtgttttgggttttttcattatcgttatatagtctatctgtgtggggtcattgtaattttggatgattggccttctcatgaactagtcatatgtatgatgcaaccttaaaaatatttcaagtagcaaaacttaattacaaacttgctatattaaccaaaaattatgaaaaaaaaaaaaaaaaaaaaaa

SEQ ID NO: 636 - protein, 283 aa, Arabidopsis thaliana
  G964
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 637 - DNA, 1983 bp, Arabidopsis thaliana
  G965
gattctctgtgtatgtctgaatccttacaggatccaagagctttggaaaaaagatataatgaataacaagatatgggtttagctactacaacttcttctatgtcacaagattatcatcatcaccaaggaatcttttccttctctaatggattccaccgatcatcatcaaccactcatcaggaggaagtagatgaatccgccgtcgtctccggtgctcaaattccggtttatgaaaccgccggaatgttgtctgaaatgtttgcttaccctggcggaggtggcggcggttccggtggagagattcttgatcagtctactaaacagttgctagagcaacaaaaccgtcacaacaacaacaataactcaactcttcatatgttattaccaaatcatcatcaaggttttgctttcaccgacgaaaacactatgcagccgcagcaacaacaacactttacatggccatcttcctcctccgatcatcatcaaaaccgagatatgatcggaaccgtccacgtggaaggaggaaagggtttgtctttatctctctcatcttcattagccgcagctaaagccgaggaatatagaagcatttattgtgcagccgttgatggaacttcttcttcttctaacgcatccgctcatcatcatcaattcaatcagttcaagaatcttcttcttgagaattcttcttctcaacatcatcaccatcaagttgttggacattttggttcatcatcatcatctcccatggcggcttcttcatccattggagggatctacacgttgaggaattcgaaatatacgaaaccggctcaagagttgttggaagagttttgtagtgttggaagaggacatttcaagaagaacaaacttagtaggaacaactcaaaccctaatactaccggtggaggaggaggcggagggtcctcgtcatcggccggaacagctaatgatagtcctcctttgtctccggctgatcggattgaacatcaaagaagaaaagtcaagctactatctatgcttgaagaggtggaccgacggtacaaccactactgcgaacaaatgcaaatggtagtgaactcattcgaccaagtaatgggttacggcgcggcggttccgtacacgacattagctcaaaaggcaatgtctaggcatttccggtgtttgaaagacgcggtagcggttcagcttaaacgcagctgtgagcttctaggggataaagaggcggcaggggctgcatcctcggggttaaccaaaggggaaacgccgcgattgcgtttgctagagcagagtttgcgtcagcaacgagcgtttcatcatatgggtatgatggagcaagaggcatggagaccgcaacgtggtttgcctgaacgctccgttaatatccttagagcttggctattcgagcattttcttaatccgtacccaagcgatgctgataagcacctcttagcacgacagactggtttatccagaaatcaggtgtcaaattggttcataaatgctagggttcgcctatggaaaccaatggtggaagagatgtatcaacaagaagcaaaagaaagagaagaagcagaagaagaaaatgaaaatcaacaacaacaaagaagacagcaacaaacaaacaacaacgacacgaaacccaacaacaatgaaaacaacttcactgtcataaccgcacaaactccaacgacgatgacatcgacacatcacgaaaacgactcttcattcctctcttccgtcgccgccgcttctcacggcggttcagacgcgttcaccgtcgccacgtgtcagcaagacgtcagtgacttccacgtcgacggagatggtgtgaacgtcataagattcgggaccaaacagactggtgacgtgtctcttacgcttggtctacgccactctggcaatattcctgataagaacacttctttctccgttagagactttggagatttttagtcttctttgtttctcaatttattcatc

SEQ ID NO: 638 - protein, 627 aa, Arabidopsis thaliana
  G965
MGLATTTSSMSQDYHHHQGIFSFSNGFHRSSSTTHQEEVDESAVVSGAQIPVYETAGMLSEMFAYPGGGGGGSGGEILDQSTKQLLEQQNRHNNNNNSTLHMLLPNHHQGFAFTDENTMQPQQQQHFTWPSSSSDHHQNRDMIGTVHVEGGKGLSLSLSSSLAAAKAEEYRSIYCAAVDGTSSSSNASAHHHQFNQFKNLLLENSSSQHHHHQVVGHFGSSSSSPMAASSSIGGIYTLRNSKYTKPAQELLEEFCSVGRGHFKKNKLSRNNSNPNTTGGGGGGGSSSSAGTANDSPPLSPADRIEHQRRKVKLLSMLEEVDRRYNHYCEQMQMVVNSFDQVMGYGAAVPYTTLAQKAMSRHFRCLKDAVAVQLKRSCELLGDKEAAGAASSGLTKGETPRLRLLEQSLRQQRAFHHMGMMEQEAWRPQRGLPERSVNILRAWLFEHFLNPYPSDADKHLLARQTGLSRNQVSNWFINARVRLWKPMVEEMYQQEAKEREEAEEENENQQQQRRQQQTNNNDTKPNNNENNFTVITAQTPTTMTSTHHENDSSFLSSVAAASHGGSDAFTVATCQQDVSDFHVDGDGVNVIRFGTKQTGDVSLTLGLRHSGNIPDKNTSFSVRDFGDF

SEQ ID NO: 639 - DNA, 1303 bp, Arabidopsis thaliana
  G971
ttttttttcttccctcttttagaactctctctctctctcgtttttgacacttatcctctctcttttttctctctccctctctctctggccggaaaaaagaacaacgtcgtttatagctaaagattcgatcatgttggatcttaacctaaagatcttttcttcttataacgaagatcaagatcggaaagtaccattaatgatctcaaccaccggtgaagaagaatctaactcatcttcctcctccacaacagactctgcagcgagagatgctttcatcgcttttggaattctcaaacgcgacgatgaccttgttcctcctcctcctcctcctcctcataaagaaacaggagatctctttccggtggtggctgatgctcgtcggaatatagaattctccgtggaagacagtcactggttgaatctttcttctttacaaagaaatacacagaaaatggtgaagaagagcagaagaggaccaaggtctcgtagctcccaatatcgtggcgtcactttttaccgtcgcaccggtcgttgggaatctcatatttgggattgtggaaagcaagtttatttgggcgggtttgatactgcttacgcagcagcaagggcttacgaccgagctgctatcaaattccgtggtctcgatgcagacatcaatttcgtcgtggatgattataggcatgacatcgataagatgaagaatttaaataaggtggagttcgtgcaaacacttaggcgagagagtgcgagtttcggaagaggaagttccaaatacaaaggcttggctcttcaaaaatgcacccaattcaaaactcatgatcagattcatctcttccaaaacaggggatgggatgcagcagcaataaaatacaatgagttgggaaagggagaaggagccatgaagtttggtgcccatatcaaaggaaatggtcacaatgatcttgaactaagtctcggaatttcatcatcatcggaaagtataaagttgacaacaggcgattactataagggtatcaatcggtccacgatgggtttatacggtaagcaatcatcgatatttttacccatggcaaccatgaaacctctgaagacagttgcagcatcatcaggattcccttttatcagcatgacaagttcctcttcctccatgtccaattgttttgatccataggatcgttctacactctcttaactaatatatatttttactctatctgattattgtatacaaggataaaatttgattctttccttaatgagtgagaaatattggaagtgttaaaaaaaaaaaaaaaaaaaaaaa

SEQ ID NO: 640 - protein, 346 aa, Arabidopsis thaliana
  G971
MLDLNLKIFSSYNEDQDRKVPLMISTTGEEESNSSSSSTTDSAARDAFIAFGILKRDDDLVPPPPPPPHKETGDLFPVVADARRNIEFSVEDSHWLNLSSLQRNTQKMVKKSRRGPRSRSSQYRGVTFYRRTGRWESHIWDCGKQVYLGGFDTAYAAARAYDRAAIKFRGLDADINFVVDDYRHDIDKMKNLNKVEFVQTLRRESASFGRGSSKYKGLALQKCTQFKTHDQIHLFQNRGWDAAAIKYNELGKGEGAMKFGAHIKGNGHNDLELSLGISSSSESIKLTTGDYYKGINRSTMGLYGKQSSIFLPMATMKPLKTVAASSGFPFISMTSSSSSMSNCFDP

SEQ ID NO: 641 - DNA, 1430 bp, Arabidopsis thaliana
  G974
aaaaaaaaagttgatatactttctggttttctccttaacttttattctttacaaatccatcccccttagatctgtttatttcccgctactttgattcatttctgttagtaatctgtctttcgtatagaagaaaactgatttcttggtttgtattttcttaaagagatcaatctttttttatttttgatcttcttgtgtttttttttctttgtagaattaatcgtttgtgagggtatttttttaattccctcctctcagaaatctacacagaggttttttattttataaacctctttttcgattttcttgaaaacaaaaaatcctgttctttactttttttacaagaacaagggaaaaaaatttctttttattagaaatgacaacttctatggatttttacagtaacaaaacgtttcaacaatctgatccattcggtggtgaattaatggaagcgcttttaccttttatcaaaagcccttccaacgattcatccgcgtttgcgttctctctacccgctccaatttcatacgggtcggatctccactcattttctcaccatcttagtcctaaaccggtctcaatgaaacaaaccggtacttccgcggctaaaccgacgaagctatacagaggagtgagacaacgtcactggggaaaatgggtggctgagattcgtttaccgaggaatcgaactcgactttggctcggaacattcgacacggcggaggaagctgctttagcttatgacaaggcggcgtataagctccgaggagattttgcgcggcttaatttccctgatctccgtcataacgacgagtatcaacctcttcaatcatcagtcgacgctaagcttgaagctatttgtcaaaacttagctgagacgacgcagaaacaggtgagatcaacgaagaagtcttcttctcggaaacgttcatcaaccgtcgcagtgaaactaccggaggaggactactctagcgccggatcttcgccgctgttaacggagagttatggatctggtggatcttcttcgccgttgtcggagctgacgtttggtgatacggaggaggagattcagccgccgtggaacgagaacgcgttggagaagtatccgtcgtacgagatcgattgggattcgattcttcagtgttcgagtcttgtaaattagatgttgccataggggtattttagggactttagagctctctgcgatggagtttttggtcattgcagagattttattattattaagggggtttgttatgttaatatcaaataagtttatctactttgatgttaattagtgttaatctctgcgtcggtccaagctgtttttttttggcatgcttcgaccgtgtgagatttcttatgtaatttttgtagttccttgattttcttagttcaagttaaattggcacaaaaaaaaaaaaaaaaaa

SEQ ID NO: 642 - protein, 261 aa, Arabidopsis thaliana
  G974
MTTSMDFYSNKTFQQSDPFGGELMEALLPFIKSPSNDSSAFAFSLPAPISYGSDLHSFSHHLSPKPVSMKQTGTSAAKPTKLYRGVRQRHWGKWVAEIRLPRNRTRLWLGTFDTAEEAALAYDKAAYKLRGDFARLNFPDLRHNDEYQPLQSSVDAKLEAICQNLAETTQKQVRSTKKSSSRKRSSTVAVKLPEEDYSSAGSSPLLTESYGSGGSSSPLSELTFGDTEEEIQPPWNENALEKYPSYEIDWDSILQCSSLVN

SEQ ID NO: 643 - DNA, 768 bp, Arabidopsis thaliana
  G975
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctattttcattgctgatttacagccaaaataatcaattataccgtgtattttatagatgttttatattaaaaggttgttagatata

SEQ ID NO: 644 - protein, 199 aa, Arabidopsis thaliana
  G975
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 645 - DNA, 963 bp, Arabidopsis thaliana
  G976
cttatatataacaaataaacacataagttgacatatatactatatacaagtatattaattatacatatatggctgaccctaacaatcctatcactgaacctaaagctataatccaatcttctacttcatcgtcagttactattgtgccagttcccacgtgcggtgacagcctctctgactctgccacgtgtgaaaacccttgtccacttgatactatcactactactactactactgtttgttttgcggctccttcttctactgcaagtggtaatgatattaatactttaatggccactgacaccgacatctctcgccggaaaaagaatccggtttatcggggaattcgttgtcggagtggaaaatgggtgtctgaaatccgagagcctaaaaagactacacgtgtctggcttgggacttatccgacgccggagatggctgctgccgcatatgacgtggcggcgttagctcttaaaggtggagacactctcttgaacttcccggattccctgggatcttaccccattcccctttcctcttccgcagctcatatcagatgcgctgcagctgcggctgctgcgactaggggtgcggctggagcggccgtgaaggtaggtcaaaagaaggaagataaagtttatgatacggcggaatcttcaactatggggtttgtggatgaagaagagctattgaacatgcctggtttgctagcggatatggccaaagggatgatggtggctccaccgtggatgggatctccaccgtcagatgattcgccagagaattctgatggagagagcttgtggagctattgatcgattgaaagcagtttaatatcttttttggatcctttgttcacgtttatgctagtcatctttgtttctttatcctatgattgttagagatgatttgttaaatatataatcgtaatgattttcacttttttttattcaaaaaaaaaaa

SEQ ID NO: 646 - protein, 248 aa, Arabidopsis thaliana
  G976
MADPNNPITEPKAIIQSSTSSSVTIVPVPTCGDSLSDSATCENPCPLDTITTTTTTVCFAAPSSTASGNDINTLMATDTDISRRKKNPVYRGIRCRSGKWVSEIREPKKTTRVWLGTYPTPEMAAAAYDVAALALKGGDTLLNFPDSLGSYPIPLSSSAAHIRCAAAAAAATRGAAGAAVKVGQKKEDKVYDTAESSTMGFVDEEELLNMPGLLADMAKGMMVAPPWMGSPPSDDSPENSDGESLWSY

SEQ ID NO: 647 - DNA, 833 bp, Arabidopsis thaliana
  misc_feature (810)..(810): n is a, c, g, or t
  G977
caccaaactcacctgaaaccctatttccatttaccattcacactaatggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtgagaaatggccttgtcgttttagcgtattcttttcatttttatttttgtttccacaaaaacggcgtcgtaagtgatgagagtagtagtgagagaaggctaatttcaagacattttgatctgaattggcctcttttgaaacactgattctagtttctataagagcaatcgatcatatgctatgttatgtatagtattataaaaaaatgttattttctgattnaaaaaaaaaaaaaaaaaaaaaaa

SEQ ID NO: 648 - protein, 181 aa, Arabidopsis thaliana
  G977
MARPQQRFRGVRQRHWGSWVSEIRHPLLKTRIWLGTFETAEDAARAYDEAARLMCGPRARTNFPYNPNAIPTSSSKLLSATLTAKLHKCYMASLQMTKQTQTQTQTQTARSQSADSDGVTANESHLNRGVTETTEIKWEDGNANMQQNFRPLEEDHIEQMIEELLHYGSIELCSVLPTQTL

SEQ ID NO: 649 - DNA, 1530 bp, Arabidopsis thaliana
  misc_feature (1499)..(1500): n is a, c, g, or t
  misc_feature (1503)..(1503): n is a, c, g, or t
  misc_feature (1505)..(1505): n is a, c, g, or t
  misc_feature (1507)..(1507): n is a, c, g, or t
  misc_feature (1512)..(1512): n is a, c, g, or t
  misc_feature (1514)..(1514): n is a, c, g, or t
  misc_feature (1518)..(1518): n is a, c, g, or t
  G979
cctctgaggaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgccccttttnnaangntncaagntnaaanaaaaaaaaaaaa

SEQ ID NO: 650 - protein, 430 aa, Arabidopsis thaliana
  G979
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 651 - DNA, 1022 bp, Arabidopsis thaliana
  G986
cattaaattggctcctgtgaacctaaatttatggactatgatcccaacaccaatccgttcgaccttcatttctccggtaaacttccgaaaagagaagtctcggcttcagcttctaaagttgtagagaagaaatggttagtgaaagatgagaagagaaatatgctacaagatgaaataaaccgggttaattcggagaacaagaagctaaccgaaatgttagcaagagtctgtgagaagtactatgctcttaataatcttatggaggagttgcagagtcgaaagagtcctgaaagtgttaactttcagaacaaacagctaacggggaaacgaaaacaagaacttgatgagtttgttagctccccaattggactcagtctcggaccaatcgagaacatcaccaacgataaagcgacggtttcaaccgcttactttgctgctgagaagtctgacacaagcttgactgtgaaagatggatatcaatggaggaaatacgggcaaaagattacgagagataatccatctcctagagcttacttcagatgctcgttttcaccgtcttgtctagtcaagaagaaggtgcaacgaagtgcagaagatccatctttcttggtagccacttacgaagggacacataaccacaccggaccacatgcaagtgtgtccaggacagtgaaacttgatctagttcaaggtgggcttgaaccagttgaggaaaagaaagagagagggacgattcaagaggttttggtgcaacaaatggcttcttcgttgaccaaagatcctaagttcactgcagctcttgcgactgctatttccgggagattgatagagcattcaagaacatgaaagttctctagaacatgtatatttctgttttgttctattttgttgctcattcctagtaaaaaggtaaagatttgtttgatcttgattaggaggcatagatgtcaattttaatgtgtgtgtatataattacatcaaatctaagtatccaaaaagggtcacccccattttatcttatg

SEQ ID NO: 652 - protein, 271 aa, Arabidopsis thaliana
  G986
MDYDPNTNPFDLHFSGKLPKREVSASASKVVEKKWLVKDEKRNMLQDEINRVNSENKKLTEMLARVCEKYYALNNLMEELQSRKSPESVNFQNKQLTGKRKQELDEFVSSPIGLSLGPIENITNDKATVSTAYFAAEKSDTSLTVKDGYQWRKYGQKITRDNPSPRAYFRCSFSPSCLVKKKVQRSAEDPSFLVATYEGTHNHTGPHASVSRTVKLDLVQGGLEPVEEKKERGTIQEVLVQQMASSLTKDPKFTAALATAISGRLIEHSRT

SEQ ID NO: 653 - DNA, 4011 bp, Arabidopsis thaliana
  G987
atgggttcttactcagctggcttccctggatccttggactggtttgattttcccggtttaggaaacggatcctatctaaatgatcaacctttgttagatattggatctgttcctcctcctctagacccatatcctcaacagaatcttgcttctgcggatgctgatttctctgattctgttttgaagtacataagccaagttcttatggaagaggacatggaagataagccttgtatgtttcatgatgctttatctcttcaagcagctgagaagtctctctatgaagctctcggcgagaagtacccggttgatgattctgatcagcctctgactactactactagccttgctcaattggttagtagtcctggtggttcttcttatgcttcaagcaccacaaccacttcctctgattcacaatggagttttgattgtttggagaataataggccttcttcttggttgcagacaccgatcccgagtaacttcatttttcagtctacatctactagagccagtagcggtaacgcggttttcgggtcaagttttagcggtgatttggtttctaatatgtttaatgatactgacttggcgttacaattcaagaaagggatggaggaagctagtaaattccttcctaagagctctcagttggttatagataactctgttcctaacagattaaccggaaagaagagccattggcgcgaagaagaacatttgactgaagaaagaagtaagaaacaatctgctatttatgttgatgaaactgatgagcttactgatatgtttgacaatattctgatatttggcgaggctaaggaacaacctgtatgcattcttaacgagagtttccctaaggaacctgcgaaagcttcaacgtttagtaagagtcctaaaggcgaaaaaccggaagctagtggtaacagttatacaaaagagacacctgatttgaggacaatgctggtttcttgtgctcaagctgtttcgattaacgatcgtagaactgctgacgagctgttaagtcggataaggcaacattcttcatcttacggcgatggaacagagagattggctcattattttgctaacagtcttgaagcacgtttggctgggataggtacacaggtttatactgccttgtcttccaagaaaacatctacttctgacatgttgaaagcttatcagacatatatatcagtctgtccgttcaagaaaatcgcaatcatattcgccaaccatagtattatgcggttggcttcaagtgctaatgccaaaaccatccacatcatagattttggaatatctgatggtttccagtggccttctctgattcatcgacttgcttggagacgtggttcatcttgtaagcttcggataaccggtatagagttgcctcaacgtggttttagaccagccgagggagttattgagactggtcgtcgcttggctaagtattgtcagaagttcaatattccgtttgagtacaatgcgattgcgcagaaatgggaatcaatcaagttggaggacttgaagctaaaagaaggcgagtttgttgcggtaaactctttatttcggtttaggaatcttctagatgagacggtggcagtgcatagcccgagagatacggttttgaagctgataaggaagataaagccagacgtgttcatccccgggatcctcagcggatcctacaacgcgcctttctttgtcacgaggtttagagaagttctgtttcattactcatctctgtttgacatgtgtgacacgaatctaacacgggaagatccaatgagggttatgtttgagaaagagttctatgggcgggagatcatgaacgtggtggcgtgtgaggggacggagagagtggagaggccagagagttataagcagtggcaggcgagggcgatgagagccgggtttagacagattccgctggagaaggaactagttcagaaactgaagttgatggtggaaagtggatacaaacccaaagagtttgatgttgatcaagattgtcactggttgcttcagggctggaaaggtagaattgtatacggttcatctatttgggttcctttctttttctatgtgggcagagcaactagggttttgatcatggatccaaacttctctgaatctctaaacggctttgagtattttgatggtaaccctaatttgcttactgatccaatggaagatcagtatccaccaccatctgatactctgttgaaatacgtgagtgagattcttatggaagagagtaatggagattataagcaatctatgttctatgattcattggctttacgaaaaactgaagaaatgttgcagcaagtcattactgattctcaaaatcagtcctttagtcctgctgattcattgattactaattcttgggatgcaagcggaagcatcgatgaatcggcttattcggctgatccgcaacctgtgaatgaaattatggttaagagtatgtttagtgatgcagaatcagctttacagtttaagaaaggggttgaagaagctagtaaattccttcccaatagtgatcaatgggttatcaatctggatatcgagagatccgaaaggcgcgattcggttaaagaagagatgggattggatcagttgagagttaagaagaatcatgaaagggattttgaggaagttaggagtagtaagcaatttgctagtaatgtagaagatagtaaggttacagatatgtttgataaggttttgcttcttgacggtgaatgcgatccgcaaacattgttagacagcgagattcaagcgattcggagtagtaagaacataggagagaaagggaagaagaagaagaagaagaagagtcaagtggttgattttcgtacacttctcactcattgtgcacaagccatttccacaggagataaaaccacggctcttgagtttctgttacagataaggcaacagtcttcgcctctcggtgacgcggggcaaagactagctcattgtttcgctaacgcgcttgaagctcgtctacagggaagtaccggtcctatgatccagacttattacaatgctttaacctcgtcgttgaaggatactgctgcggatacaattagagcgtatcgagtttatctttcttcgtctccgtttgttaccttgatgtatttcttctccatctggatgattcttgatgtggctaaagatgctcctgttcttcatatagttgattttgggattctatacgggtttcaatggccgatgtttattcagtctatatcagatcgaaaagatgtaccgcggaagctgcggattactggtatcgagcttcctcagtgcgggtttcggcccgcggagcgaatagaggagacaggacggagattggctgagtattgtaaacggtttaatgttccgtttgagtacaaagccattgcgtctcagaactgggaaacaatccggatagaagatctcgatatacgaccaaacgaagtcttagcggttaatgctggacttagactcaagaaccttcaagatgaaacaggaagcgaagagaattgcccgagagatgctgtcttgaagctaataagaaacatgaacccggacgttttcatccacgcgattgtcaacggttcattcaacgcacccttctttatctcgcggtttaaagaagcggtttaccattactccgctctcttcgacatgtttgattcgacgttgcctcgggataacaaagagaggattaggttcgagagggagttttacgggagagaggctatgaacgtgatagcgtgcgaggaagctgatcgagtggagaggcctgagacttacaggcaatggcaggttagaatggttagagccgggtttaagcagaaaacgattaagcctgagctggtagagttgtttagaggaaagctgaagaaatggcgttaccataaagactttgtggttgatgaaaatagtaaatggttgttacaaggctggaaaggtcgaactctctatgcttcttcttgttgggttcctgcctag

SEQ ID NO: 654 - protein, 1336 aa, Arabidopsis thaliana
  G987
MGSYSAGFPGSLDWFDFPGLGNGSYLNDQPLLDIGSVPPPLDPYPQQNLASADADFSDSVLKYISQVLMEEDMEDKPCMFHDALSLQAAEKSLYEALGEKYPVDDSDQPLTTTTSLAQLVSSPGGSSYASSTTTTSSDSQWSFDCLENNRPSSWLQTPIPSNFIFQSTSTRASSGNAVFGSSFSGDLVSNMFNDTDLALQFKKGMEEASKFLPKSSQLVIDNSVPNRLTGKKSHWREEEHLTEERSKKQSAIYVDETDELTDMFDNILIFGEAKEQPVCILNESFPKEPAKASTFSKSPKGEKPEASGNSYTKETPDLRTMLVSCAQAVSINDRRTADELLSRIRQHSSSYGDGTERLAHYFANSLEARLAGIGTQVYTALSSKKTSTSDMLKAYQTYISVCPFKKIAIIFANHSIMRLASSANAKTIHIIDFGISDGFQWPSLIHRLAWRRGSSCKLRITGIELPQRGFRPAEGVIETGRRLAKYCQKFNIPFEYNAIAQKWESIKLEDLKLKEGEFVAVNSLFRFRNLLDETVAVHSPRDTVLKLIRKIKPDVFIPGILSGSYNAPFFVTRFREVLFHYSSLFDMCDTNLTREDPMRVMFEKEFYGREIMNVVACEGTERVERPESYKQWQARAMRAGFRQIPLEKELVQKLKLMVESGYKPKEFDVDQDCHWLLQGWKGRIVYGSSIWVPFFFYVGRATRVLIMDPNFSESLNGFEYFDGNPNLLTDPMEDQYPPPSDTLLKYVSEILMEESNGDYKQSMFYDSLALRKTEEMLQQVITDSQNQSFSPADSLITNSWDASGSIDESAYSADPQPVNEIMVKSMFSDAESALQFKKGVEEASKFLPNSDQWVINLDIERSERRDSVKEEMGLDQLRVKKNHERDFEEVRSSKQFASNVEDSKVTDMFDKVLLLDGECDPQTLLDSEIQAIRSSKNIGEKGKKKKKKKSQVVDFRTLLTHCAQAISTGDKTTALEFLLQIRQQSSPLGDAGQRLAHCFANALEARLQGSTGPMIQTYYNALTSSLKDTAADTIRAYRVYLSSSPFVTLMYFFSIWMILDVAKDAPVLHIVDFGILYGFQWPMFIQSISDRKDVPRKLRITGIELPQCGFRPAERIEETGRRLAEYCKRFNVPFEYKAIASQNWETIRIEDLDIRPNEVLAVNAGLRLKNLQDETGSEENCPRDAVLKLIRNMNPDVFIHAIVNGSFNAPFFISRFKEAVYHYSALFDMFDSTLPRDNKERIRFEREFYGREAMNVIACEEADRVERPETYRQWQVRMVRAGFKQKTIKPELVELFRGKLKKWRYHKDFVVDENSKWLLQGWKGRTLYASSCWVPA

SEQ ID NO: 655 - DNA, 789 bp, Arabidopsis thaliana
  G991
gaaaaatggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgccttctcactctcacctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaaaaaaaaaaaaaaaaaaaaaaaaaaa

SEQ ID NO: 656 - protein, 175 aa, Arabidopsis thaliana
  G991
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 657 - DNA, 1095 bp, Arabidopsis thaliana
  G994
tgtatatatagttagttagttgagataaacttggttaccacttttgtgtggtctttctttttctttttctccattttccatttatcgaccccttgggtgtagctaattactttcgcgattttcaaatccaataaagttttaatttgatgaagctttttttaaaccatataatataaataatgggtggtcgtaaaccatgttgtgatgaggttggattaagaaagggtccatggacagtggaagaagatgggaaactagttgatttcttaagggcacgtggcaactgcggtggtggtggaggaggatggtgctggagagacgtgccaaaactggcggggctaaggaggtgtggcaaaagttgccgtctccggtggactaattatctccggccagatctcaagagaggtctttttactgaagaagaaatccaactagtcattgatcttcatgctcgccttggcaatagatggtcgaagattgcagtggagttaccaggaagaacagacaacgatatcaaaaattattggaacactcatataaagaggaagcttataagaatgggtattgatccaaacacacatcgtcgatttgaccaacaaaaagtcaacgaggaggaaacgatattggtcaacgatccaaagcctctgtctgagaccgaggtatctgttgctttgaagaatgacacgtcagcagtgttatcaggaaatctaaaccaattggctgacgtggacggtgatgatcagccgtggagctttctaatggaaaatgacgaaggaggaggtggcgacgccgccggagagcttacgatgctattgtccggtgacattacgtcatcatgttcttcttcgtcatctttgtggatgaagtatggagaattcggatacgaagatttagaacttggatgtttcgatgtttagagattcaagtatgtttaattaggccgtaggttgattaatcataaggttcattgacttcattctagaattgtgtagttggaccagtataaagaatcaaagttatgaaacattgtaatttgatttccaaattaatctaatgaataaatgtgctttgcaaaaaaaaaaaaaaaaaaaaaaa

SEQ ID NO: 658 - protein, 245 aa, Arabidopsis thaliana
  G994
MGGRKPCCDEVGLRKGPWTVEEDGKLVDFLRARGNCGGGGGGWCWRDVPKLAGLRRCGKSCRLRWTNYLRPDLKRGLFTEEEIQLVIDLHARLGNRWSKIAVELPGRTDNDIKNYWNTHIKRKLIRMGIDPNTHRRFDQQKVNEEETILVNDPKPLSETEVSVALKNDTSAVLSGNLNQLADVDGDDQPWSFLMENDEGGGGDAAGELTMLLSGDITSSCSSSSSLWMKYGEFGYEDLELGCFDV

SEQ ID NO: 659 - DNA, 1082 bp, Arabidopsis thaliana
  G996
cgatcgatcttgaattgattctttgtagtattttatttacatatatatatagatgggaagacattcatgttgttacaaacagaaactgaggaaaggactttggtctcctgaagaagatgagaagcttcttcgttacatcactaagtatggtcatggttgctggagctctgtccctaaacaagctggtttacagagatgtggaaaaagttgtagattaagatggataaattatttaagaccagatttgaagagaggagcattttctcaagatgaagaaaatctcattattgaacttcatgccgttcttggcaatagatggtctcagatagctgcacagcttcctggaagaaccgacaatgaaatcaagaatctttggaattcttgtttgaagaagaaattgaggctgagaggaattgacccggttacacacaagctcttaaccgaaatcgaaaccggtacagatgacaaaacaaaaccggttgagaagagtcaacagacctacctcgttgagactgatggctcctctagtaccactacttgtagtactaaccaaaacaacaacactgatcatctttataccggaaatttcggttttcaacggttaagtctagaaaacggttcaagaatcgcagccggttctgacctcggtatctggattccccaaaccggaagaaaccatcatcatcatgtcgatgaaaccatccctagtgcagtggtactacccggttcaatgttctcatccggtttaaccggttatagatcctccaatctcggtttaattgaattggaaaactcattctcaaccgggccaatgatgacagagcatcagcaaattcaagagagtaactacaacaattcaacattctttggaaatgggaatctgaattggggattaacaatggaggaaaatcaaaatccattcacaatatcgaatcattcaaattcgtccttatacagtgatataaaatcagagaccaatttttttggcacagaggctacaaatgttggtatgtggccatgtaaccagcttcagcctcagcaacatgcatatggccatatataaatcttcttgtatattataa

SEQ ID NO: 660 - protein, 336 aa, Arabidopsis thaliana
  G996
MGRHSCCYKQKLRKGLWSPEEDEKLLRYITKYGHGCWSSVPKQAGLQRCGKSCRLRWINYLRPDLKRGAFSQDEENLIIELHAVLGNRWSQIAAQLPGRTDNEIKNLWNSCLKKKLRLRGIDPVTHKLLTEIETGTDDKTKPVEKSQQTYLVETDGSSSTTTCSTNQNNNTDHLYTGNFGFQRLSLENGSRIAAGSDLGIWIPQTGRNHHHHVDETIPSAVVLPGSMFSSGLTGYRSSNLGLIELENSFSTGPMMTEHQQIQESNYNNSTFFGNGNLNWGLTMEENQNPFTISNHSNSSLYSDIKSETNFFGTEATNVGMWPCNQLQPQQHAYGHI

SEQ ID NO: 661 - DNA, 513 bp, Arabidopsis thaliana
  G997
tcgacccacgcgtccgatacaaaccaaccttctcaattcctctcttttcatccacattttcactagctaatggcttctagttcaatgagcacctcatcatggacagctagagaggacaagcaattcgaaatggcgttggcgaaattcgacaaggacactcctgaccgttggcaaaaaattgcaagggcagttggtgggaaatcaactgaagaagtaaagcgacactatgaattgctccttagggatgtgaatgacattgagtcaggacgctatccacaacctaggtaccgtaacactaattgaagccattaataaaatgcctttctatcaagaagaggacatttgagagaatctataaagaactaagaatttcgatgtatttcttatattctatttgctttctttttttgtttttttttttaatttctgtttggttttcagatatataataatctctctcaatatccatcctattctaatccaatcaatttaagttcatataaaaaaaaaaaa

SEQ ID NO: 662 - protein, 77 aa, Arabidopsis thaliana
  G997
MASSSMSTSSWTAREDKQFEMALAKFDKDTPDRWQKIARAVGGKSTEEVKRHYELLLRDVNDIESGRYPQPRYRNTN

SEQ ID NO: 663 - DNA, 1027 bp, Arabidopsis thaliana
  G998
gaaaacataaacatagaagagcaaattaagcaacagtcttacacagacagaagttgtagaattgatttgtgagtgaaaaactatttaagactgaacaagtatgcttgattggggagttcaaggtcatcatcaaaagcatgatcatgatatttatcaacaacaacatcaacaacaaggatgtaggaagggaccatggacacttgaagaagacaagcttctcgcagagtatgttacttcgcatggtgaaggaagatggagcactgtagctaagtgtgcagggttgaatagaagtggtaaaagctgtagactaaggtgggtgaactacttgaggccagggcttaagagaggacaaatcactcctcaagaagaaggaatcatccttgaacttcattccctttggggtaacaagtggtctacaatcgcaagatatttaccaggacgaaccgataatgaaataaaaaactactggagaacacattacaagaaaaaccaaaaatcttcttcgaagcaagacaaagtaaaaaaatctctatcccggaaacaacaacaagtggatcttaaaccacaaccacaagcacaatctgagaatcatcagtctcagctagtgtcccaagatcacatgaatatcgacaacgatcataacatagcttcatccttgtattacccgacaagtgtcttcgatgacaaattatatatgcctcaaagtgtagcaacaacctcatccgaccactctatgatcgatgaaggtcacttgtggggcagcttgtggaatctagacgaggatgatccgcatagctttggtggtggctcaggacagggaacagctgcggatattgatgagaagtttccagacagcggaattgaggccccgtcgtgtggctcaggggattatagttatactggagtttacatgggaggctatattttttgattagtatgctcgaagatatcaagaagttgtgtcttcgtaggttgagaaaaaaattaaaacacaacattgtgaatttataactttagtagtgatcta

SEQ ID NO: 664 - protein, 276 aa, Arabidopsis thaliana
  G998
MLDWGVQGHHQKHDHDIYQQQHQQQGCRKGPWTLEEDKLLAEYVTSHGEGRWSTVAKCAGLNRSGKSCRLRWVNYLRPGLKRGQITPQEEGIILELHSLWGNKWSTIARYLPGRTDNEIKNYWRTHYKKNQKSSSKQDKVKKSLSRKQQQVDLKPQPQAQSENHQSQLVSQDHMNIDNDHNIASSLYYPTSVFDDKLYMPQSVATTSSDHSMIDEGHLWGSLWNLDEDDPHSFGGGSGQGTAADIDEKFPDSGIEAPSCGSGDYSYTGVYMGGYIF

SEQ ID NO: 665 - DNA, 1059 bp, Arabidopsis thaliana
  G1004
atggcgactcctaacgaagtatctgcactttggttcatcgagaaacatctactcgacgaggcttctcctgtggctacagatccatggatgaagcacgaatcatcatcagcaacagaatctagctctgactcttcttctatcatcttcggatcatcgtcctcttctttcgccccaattgatttctctgaatccgtatgcaaacctgaaatcatcgatctcgatactcccagatctatggaatttctatcgattccatttgaatttgactcagaagtttctgtttctgatttcgattttaaaccttctaatcaaaatcaaaatcagtttgaaccggagcttaaatctcaaattcgtaaaccgccattgaagatttcgcttccagctaaaacagagtggattcaattcgcagctgaaaacaccaaaccggaagttactaaaccggtttcggaagaagagaagaagcattacagaggagtaagacaaagaccgtgggggaaattcgcggcggagattcgtgacccgaataaacgcggatctcgcgtttggcttgggacgtttgatacagcgattgaagcggctagagcttatgacgaagcagcgtttagactacgaggatcgaaagcgattttgaatttccctcttgaagttgggaagtggaaaccacgcgccgatgaaggtgagaagaaacggaagagagacgatgatgagaaagtgactgtggttgagaaagtgttgaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttgattagttttttttgagtttttgaacgatgtgtatgctgacgtggacgtacacgtaggtgcatgcgatgaaaaaaacatctatttgttcatatttttgcgtttttctatttgttcattctttttcacaattcacaatacattatttcagttaatgatc

SEQ ID NO: 666 - protein, 300 aa, Arabidopsis thaliana
  G1004
MATPNEVSALWFIEKHLLDEASPVATDPWMKHESSSATESSSDSSSIIFGSSSSSFAPIDFSESVCKPEIIDLDTPRSMEFLSIPFEFDSEVSVSDFDFKPSNQNQNQFEPELKSQIRKPPLKISLPAKTEWIQFAAENTKPEVTKPVSEEEKKHYRGVRQRPWGKFAAEIRDPNKRGSRVWLGTFDTAIEAARAYDEAAFRLRGSKAILNFPLEVGKWKPRADEGEKKRKRDDDEKVTVVEKVLKTEQSVDVNGGETFPFVTSNLTELCDWDLTGFLNFPLLSPLSPHPPFGYSQLTVV

SEQ ID NO: 667 - DNA, 1281 bp, Arabidopsis thaliana
  G1005
gctttttgtgttgaagagagagtttcctatcttctccattcctcccaccatctccctcatcttcatcttcctctctctttctctctttctcaacaatctctattagatctttctccattaccattacctctggctttctcttaaatccaccatcatgaggagaggaagaggctcttccgccgtcgccggacctaccgtcgttgccgccatcaacggatctgtaaaagaaatcagattcagaggcgtaaggaagagaccttggggacgattcgcagctgagatccgtgatccatggaaaaaagctcgtgtttggttaggtactttcgattccgccgaagaagctgctcgcgcttacgactccgccgctcgtaacctccgtggtcctaaagccaaaactaatttccccatcgattcttcttctcctcctcctcctaatctccgatttaatcagattcgtaatcaaaatcaaaaccaagtcgatccgtttatggaccaccggttattcaccgaccatcaacaacagttcccgattgttaaccggcctactagtagcagcatgagcagcaccgttgaatcgtttagcggacccagacctacgacgatgaaaccggccacgacgaagagatatcctagaactccaccggttgttccggaggattgtcacagcgattgcgattcgtcgtcgtctgtaatcgacgacgacgacgatatcgcatcgtcttcacggcgacggaatccgccgtttcaattcgatcttaattttccaccgttggattgtgttgacttgttcaatggcgctgatgatcttcactgtaccgatctacgtctctaatgaattggtaaaatcaaactcaaaatcacagatccgtgatcggtttgattttaatcgaaaacacacaacaaaatccttttttttttttttttaaattttctgtttcgttgatctcatataatttttactatgcgggagaaatagaaagacaaagaaacgaagaagaagaagaagatggtgatgagcttgagagagcttgagctggttctgtgtttcttctgtgatgatattgtaagagtattattattttactattattactaaatcttcaaaaccaagaagaagaagaccgaacacgatgatctgttgtgtctgtttgttttactgtaagaaaaacgcagatctgggtttcgtttttttcttgagatagatcaaacaacccccatctttgtaacatatacatttggaacactcatgattctaaataaaaaatctagaatctttttttc

SEQ ID NO: 668 - protein, 225 aa, Arabidopsis thaliana
  G1005
MRRGRGSSAVAGPTVVAAINGSVKEIRFRGVRKRPWGRFAAEIRDPWKKARVWLGTFDSAEEAARAYDSAARNLRGPKAKTNFPIDSSSPPPPNLRFNQIRNQNQNQVDPFMDHRLFTDHQQQFPIVNRPTSSSMSSTVESFSGPRPTTMKPATTKRYPRTPPVVPEDCHSDCDSSSSVIDDDDDIASSSRRRNPPFQFDLNFPPLDCVDLFNGADDLHCTDLRL

SEQ ID NO: 669 - DNA, 913 bp, Arabidopsis thaliana
  G1006
gataaatcaatcaacaaaacaaaaaaaactctatagttagtttctctgaaaatgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataagtttgatcttgtgtgttttgtagttgaatagttttgctataaatgttgaggcaccaagtaaaagtgttcccgtgatgtaaattagttactaaacagagccatatatcttcaatcaaaaaaaaaaaaaaaa

SEQ ID NO: 670 - protein, 243 aa, Arabidopsis thaliana
  G1006
MYGQCNIESDYALLESITRHLLGGGGENELRLNESTPSSCFTESWGGLPLKENDSEDMLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSRALLNFPLRVNSGEPDPVRITSKRSSSSSSSSSSSTSSSENGKLKRRRKAENLTSEVVQVKCEVGDETRVDELLVS

SEQ ID NO: 671 - DNA, 476 bp, Arabidopsis thaliana
  G1012
aacacacaattcgttgattcatcatatctcctcttcattaatgaatggcctcgtcgactcttctcgagataagaagatgaaaaatccgcgattttcgtttcgcacaaagagtgatgcagatattctcgatgatggttatcgatggagaaagtacggtcagaaatccgtcaagaacagcttgtatcccaggagctattatagatgcacacaacacatgtgtaacgtgaagaagcaagttcagaggctgtcgaaggagacgagcattgtggagacaacttatgaaggaatccataaccatccttgtgaggagctcatgcaaaccctaactcctcttcttcatcaattgcagttcctctctaagttcacctaattatgtttgtatatatattaacgttctaagagcatctccaatggaagtatctcaatgagatacctaacaaaagaaaaaaaatttaaaaaaaaaaaaaaaaaaaaaa

SEQ ID NO: 672 - protein, 109 aa, Arabidopsis thaliana
  G1012
MNGLVDSSRDKKMKNPRFSFRTKSDADILDDGYRWRKYGQKSVKNSLYPRSYYRCTQHMCNVKKQVQRLSKETSIVETTYEGIHNHPCEELMQTLTPLLHQLQFLSKFT

SEQ ID NO: 673 - DNA, 813 bp, Arabidopsis thaliana
  G1020
ctgttcacaagaaagctccccaaaaggagcgttgctttactctcctataaaaagaagctcttctacttcttctcgttaccacaaaactctttcaccgatcttctcgttccattcttcttcctaattacaccatgcccaacatcaccatgggtttgaaacccgacccggttgctccaacgaacccgactcatcatgagagtaatgctgccaaagagattcgttacagaggcgttaggaaacgtccatggggaagatacgccgctgagatccgagatccggttaagaaaactcgagtctggctcggtacgttcgacaccgctcagcaggcggcgcgtgcttacgacgcagccgcgcgtgactttcgtggtgttaaggctaagaccaatttcggtgttatcgttggtagtagtcctactcagagtagcaccgtcgtcgactctcccacggcggcacggtttataacacctccgcacctcgagctcagcttaggcggcggcggcgcgtgtcgtcgtaagatcccgcttgtgcatccggtttactactataacatggcgacgtatccaaagatgacgacgtgtggtgtccagagcgagtctgaaacgtcgtcggtcgttgatttcgaaggtggagctgggaagatatctccgccgttagatctggatcttaacttagctcctccggcggaataggccgtgagttttttttttcttatgtcgtttctttagacaaaaaaaaataacgtttcctttttttttctgcctaagaaaaaaatattatccgttttttagaagaaaaaaaaaaaaaaaaaaaaaa

SEQ ID NO: 674 - protein, 185 aa, Arabidopsis thaliana
  G1020
MPNITMGLKPDPVAPTNPTHHESNAAKEIRYRGVRKRPWGRYAAEIRDPVKKTRVWLGTFDTAQQAARAYDAAARDFRGVKAKTNFGVIVGSSPTQSSTVVDSPTAARFITPPHLELSLGGGGACRRKIPLVHPVYYYNMATYPKMTTCGVQSESETSSVVDFEGGAGKISPPLDLDLNLAPPAE

SEQ ID NO: 675 - DNA, 1390 bp, Arabidopsis thaliana
  G1022
aagaatctgagtggttggtctctgatttgatgagatgactgttgagctgatgatgagcagctacagcggcggcggaggaggaggtgatggttttcctgcaatcgccgcggcggcgaaaatggaagataccgctttgagagaagctgcttctgcagggattcacggtgtggaggagtttcttaaactgatcggtcaaagtcaacaaccaacggagaagagtcagacggagataaccgcggtgactgacgtcgccgttaacagcttcaagaaggtcatttctctactcggtagatctagaaccggacacgctagattcagacgagctcccgcgtcaacgcaaacgccgtttaagcaaacgccggtggttgaggaggaggtggaggtggaggagaagaagccagaaacaagctccgtgttaacaaaacagaaaacagagcaatatcacggtggtggatctgcgtttagagtttattgtccaacaccaattcatcgtcgtcctcctctatcacacaataacaacaacaatcagaatcaaacaaagaacggttcgtcttcttcatctcctccgatgctcgcaaacggagcaccgtcaacgataaactttgcgccgtcaccaccagtctcagcgacgaactcattcatgtcttctcatagatgtgacaccgatagtactcacatgtcatcaggattcgagttcactaacccatctcagctctctggttcgagaggtaaacctcctttatcatcagcttcgttgaagagaagatgtaattcatctccctcaagccgttgccattgctccaagaaaaggaaatcaagagtaaaaagagtgattagagttccagcagtaagtagcaaaatggctgatataccatcagatgagttttcatggagaaaatatggtcaaaaaccaatcaaaggctctcctcatcctcggggatattacaagtgcagcagtgtaagaggttgtccggcgcgtaagcatgtggagcgtgcactagatgatgcgatgatgctaatcgtgacgtacgaaggagaccacaaccatgctttggttctcgagacgacgacgatgaatcatgacaaaactctttagtttctcgagtttgaggggaactgtctgtgtgtgaccactatccagattagtcaacgacagagtgggcccgcactgcacttttttattcttttctttttgaaaagcttttgctttatctttctttttgattggaggaaatagagggaggggagataaagacgagagaggaacgttgtggatcttgatggaagttgaatcatgtgaatgtccttttctgtttatttatttctaggataatatatatttagtgcactatttttgtcaaaaaaaaaaaaaaaaaaaaaaaaaaaaaaa

SEQ ID NO: 676 - protein, 353 aa, Arabidopsis thaliana
  G1022
MTVELMMSSYSGGGGGGDGFPAIAAAAKMEDTALREAASAGIHGVEEFLKLIGQSQQPTEKSQTEITAVTDVAVNSFKKVISLLGRSRTGHARFRRAPASTQTPFKQTPVVEEEVEVEEKKPETSSVLTKQKTEQYHGGGSAFRVYCPTPIHRRPPLSHNNNNNQNQTKNGSSSSSPPMLANGAPSTINFAPSPPVSATNSFMSSHRCDTDSTHMSSGFEFTNPSQLSGSRGKPPLSSASLKRRCNSSPSSRCHCSKKRKSRVKRVIRVPAVSSKMADIPSDEFSWRKYGQKPIKGSPHPRGYYKCSSVRGCPARKHVERALDDAMMLIVTYEGDHNHALVLETTTMNHDKTL

SEQ ID NO: 677 - DNA, 1693 bp, Arabidopsis thaliana
  G1023
tcgtcttcttaatcgctttctgctctgtttttctcgttcatcaagctacatctactagctctctcagtgattgatttctcacagtttcatcgatttccatgcgtttaagacctaaaaggacttgttctggggtaaaggacttttcttgttcttgagagagttcattttgaggcttttctgggaattttgagaggttttttagggtttaagggggtttggttttgaatttcgcacaccaagtgttcgataaaatggctgaacgaaagaaacgctcttctattcaaaccaataaacccaacaaaaaacccatgaagaagaaaccttttcagctaaatcacctcccaggtttatctgaagatttgaagactatgagaaaactccgtttcgttgtgaatgatccttacgctactgactactcatcaagcgaagaagaagaaaggagtcagagaaggaaacgttatgtctgtgagatcgatcttcctttcgctcaagctgctactcaagcagaatctgaaagctcatattgtcaggagagtaacaataatggtgtaagcaagactaaaatctcagcttgtagcaaaaaggttttacgcagcaaagcatctccggtcgttggacgttcttctactactgtctcgaagcctgttggtgttaggcagaggaaatggggtaaatgggctgctgagattagacatccaatcaccaaagtaagaacttggttgggtacttacgagacgcttgaacaagcagctgatgcttatgctaccaagaagcttgagtttgatgctctggctgcagccacttctgctgcttcctctgttttgtcaaatgagtctggttctatgatctcagcctcagggtcaagcattgatcttgacaagaagctagttgattcgactcttgatcaacaagctggtgaatcgaagaaagcgagttttgatttcgactttgcagatctacagattcctgaaatgggttgcttcattgatgactcattcatcccaaatgcttgtgagcttgattttctcttaacagaagagaacaacaaccaaatgttggatgattactgtggcatagatgatctggacatcattggtcttgaatgtgacggtccaagcgaacttccagactatgatttctcagatgtggagatcgatcttggtctcattggaaccaccattgacaagtatgctttcgttgatcatatcgcaacaactactcccactcctcttaatatcgcgtgcccataagttttgcagctaggtgttattattagctataggagcaacgtaaaaagctcgttgttactcggttttgtcttaagttattaaagtatagcagaggcagttaatctcaagggaagcaaaaaccctaaagatagaagcagatgcagttttgtgtgttggtgttactaaagaaagttttgttgacataatggttttgatgttgtggagaagatagagaggtgtgatcgaaattgtaaatctcaggtggttttttttgaaggcaattgtttctcatttagggtttttttctatatgaggattgtctttgaaaagcctttagatgttttctaattcgtaagctctctcaatctttgtaagttttgcctgttgagttattgatacatatgtgagacctactttatttgttttgtgctacatacattgttgatggtttcgtcaaaaaaaaa

SEQ ID NO: 678 - protein, 332 aa, Arabidopsis thaliana
  G1023
MAERKKRSSIQTNKPNKKPMKKKPFQLNHLPGLSEDLKTMRKLRFVVNDPYATDYSSSEEEERSQRRKRYVCEIDLPFAQAATQAESESSYCQESNNNGVSKTKISACSKKVLRSKASPVVGRSSTTVSKPVGVRQRKWGKWAAEIRHPITKVRTWLGTYETLEQAADAYATKKLEFDALAAATSAASSVLSNESGSMISASGSSIDLDKKLVDSTLDQQAGESKKASFDFDFADLQIPEMGCFIDDSFIPNACELDFLLTEENNNQMLDDYCGIDDLDIIGLECDGPSELPDYDFSDVEIDLGLIGTTIDKYAFVDHIATTTPTPLNIACP

SEQ ID NO: 679 - DNA, 4514 bp, Arabidopsis thaliana
  G1025
gcaggcttttgatgcatgtgattctcttcttgagaatacaaggcagatttggaaaaagagtatgattcatgtcatgtcttggttgaggccagaggtaatgacatcagaggctaggtatgggcaagattcaacgtcaaggatattgagtcatcagttgtgacggaagatgaaactttggactctagtaagcagtctagttttgatgctgctgctttttatgaagccataaagccatcaaagacggatgcaatgcttggagatgacatagctgatttgctcccagaacttaggccgtaccaacgacgggcagcttattggatggttcagcgagagagaggcgatccaataacgttgggagacaaggaagacaaccaattcatttcacctttgtctatctccgtgggattccttgactctgctacaaaaatgttcttgaacccattcagtgggaatatctcattgacaccagagtatttttcacctcgaattcagggcggtatccttgctgatgaaatgggattgggaaaaacggtggaactacttgcttgtatcttttctcatcgaaaaccagcggaggatgaaatttctgtgtctaatggttcatcagttactgatgttttgaacgctggcttgagaagattgaaaagagaacgtgttgagtgcatatgtggagctgtcagtgaaagtcacaaatacaaaggagtttgggtacagtgtgacctttgtgatgcttggcagcatgccgactgtgtaggttattcacctaaagggaaaggtaagaaggatagtcaacatattgatgaaaaagcgtctcaaaagaagagcaaaaaggatgcaacggaaattattgtcagagaaggtgaatatatttgccaaatgtgctcagaacttctacaagtcactgcctctcccatctctacgggtgccactcttattgtctgtccagctcctatattaccgcaatggcattccgagattacacgccatacacgcttgggatctctcataacatgtatctatgaaggtgtgaggaacgcctcactttctgaagaacctatgattgacattactgaacttctcaatgcggacattgttttaactacgtatgatgtccttaaagaggacttgacacatgacttcgacaggcatgatggtgaccggcactgtcttagattccagaaaaggtaccctgttattccgactccactcaccagaatattttggtggaggatttgtttggatgaggcccagatggtggagagcaatgcagctgctgcaacagagatggcgttgagattatacaccaaacaccgttggtgtatcaccggaactcctatacaacgcaaacttgatgacttatttggactattgaagtttcttagagcaaatcctttcgatgtttcaagatggtggattgaagttataagagacccatatgagaggcgagacacaaaggccatggaatttacgcataagtttttcaaacaagttatgtggcgttcttcaaaagtccatgtggctgatgagttgcaacttccacctcaagaggaatgcgtctcgtggcttaaattttccgcaattgaagaacacttttacagtagacagcatgacacttgtgtgagttatgctcgtgaagttatagaaactttgaaacgtgatattctcaaaagaggtcatacttcttctgataatcctttagtcactcatgctgaagctgcaaaactgttgaactcgctcttgaaattgcgccaagcttgctgccaccctcaagtaggaagttcaggtttacgctctttgcaacaaagtccaatgaccatggaagaaattttaatggtccttgtgaaaaagacccagagcgagggagaagaagctcttagagtgttaattgttgcattaaatgggattgctgctattgccatgcttaagcaagaattttctgaagctgtgtccttatacaaggaagcattaagtataactgaagaacacgccgaggattttcgtcttgatccattgttaaatattcacattcttcacaatttagctgagatactaccaatggccaaaagctacggtggaaaactttctgcatcaggaaggcctgaaacaaaaatagatgtaaaagatgatgatcatcatcgtgcatcgaagaggcaaaggatcaatgagctcgagagtttaactcatgattcttcagaaactgtacatcagcgggaagctattgctccagacaatggtttaaagaaggatggagagtgtcatgaagaatgcaaaactctggatatagtttgtgacacactgaaggttaagtatttatccgcattcaactcaaagctttctgcagcacagcacgaattcaaaaaatcatacaatcaggtttctgagtcgttgagcaatatggggaaacaacgttcagtttggtggttggatgccctgcaacttactgaacagaataaagacttctctagcgagttgacaaggaagattgaagaggccctccatggaaacttaaacaattcaagctcctccagagagagttctcgatttagaactatacatggcatgaaacttcatctgcagacgtgtatggatatgctggagagatctagaaagaaagtgatagataggattctagaaattgatcagactatggagaaaccaaagttggaggatattgagcgtattagcaactgcaagtattgcaataagaatagtgatggccccccgtgtattcattgcgagctagatgaactattccaggaatatgaggctaggcttttccgtcttaacaaatctcgcaggggagtaatggaaattgcggctgctgaagagacggtacatttgcagaagaagagagatgctcgtaatctttttttatttggtttatcatcaagaagcaaggatctaaatgcatcacgtggtgatgacgaggagccaaccaaaagaaatgctggtgacattgtggttctttcaaaatctccatctgagacggaaatagttcttggagtgataagaaaccattgcaaaactcatttagatagggaaagcaaattggcagctacaaaacatttgcatacccttgaggtgatgcgaaaggaatatgtacatgcaagggtcttagctagggatcaagctcaactcctacgtgcctatgatgagattaacatgtcaacaatgagactacagcttagagaatcggaagatgacacatcgatctatgctttgggccgggacgagttagatgttgctagtgtgctgaacacaaatgacaaatttatggctcaatcctcgttgcttagtataaaagggaaacttcgttatttgaagggtttgatgaaatccaaacagaaacaagaatccgagagtccagatctttcctcaccaatacatgaaacagtcgatgcttcggatcctgctgaacaggaaagcgaaaacctgcttaagagagatgaagcatgcccgatttgtcatgaaattctaaggaatcagaagatggttttccagtgcgggcattccacttgctgtaactgcttttttgctatgactgagcgcaaatcagttcaagaaacgctgcaaaagtgggtgatgtgtccaatatgcaggcagcatacagatgttagaaatattgcatatgctgatgatagaagaaacagttcttcgtcagatcaagatcacaaagacagtgaagcatcattggtggttcaaggttcatatggaacaaagattgaagctgttactagaagaatcttatggatcaagtcaagtgacccacaaacgaaggttcttgttttctccagctggaacgatgttcttgatgtgttggaacatgccttcgctgcaaatagcatcacctgcatccggatgaaagggggcaggaaatcacagacagccattagcaaattcaagggatctgagaaagaaacccaaaagacaaactcccatcaaaaagaggaaaaatcgattcaagtgttattgcttttggtgcagcatggtgccaacggtcttaatcttctagaagcacagcatgttattctggtggagccacttctaaatccagctgcggaagcgcaagctgttgggcgtgttcaccgaattggacaagagaagcctactctagttcatcggtttctggtatcgggcacagtggaagagagcatctacaaactgaacaggaataagaatacaaacttaagttcatttagcagcaggaatacaaagaatcaagatcaacagttcttgacactaaaagatcttgaatctctatttgcttcaccaacagcagaaacagcagagatggaacaaaacccaggagagagacaggagaatctgagagatctaccaccctcagtcgctgcagcattagcagccgagaggagaatgaaggaaagtaatgcatcctcatcaactacaaacgcatcatgactatggaaaaggttgcagagagattggttccagccaaatgtttgttggagcgtcttgttgtatgcacataagatggtgaagagagaagctgctcg

SEQ ID NO: 680 - protein, 1389 aa, Arabidopsis thaliana
  G1025
MLGDDIADLLPELRPYQRRAAYWMVQRERGDPITLGDKEDNQFISPLSISVGFLDSATKMFLNPFSGNISLTPEYFSPRIQGGILADEMGLGKTVELLACIFSHRKPAEDEISVSNGSSVTDVLNAGLRRLKRERVECICGAVSESHKYKGVWVQCDLCDAWQHADCVGYSPKGKGKKDSQHIDEKASQKKSKKDATEIIVREGEYICQMCSELLQVTASPISTGATLIVCPAPILPQWHSEITRHTRLGSLITCIYEGVRNASLSEEPMIDITELLNADIVLTTYDVLKEDLTHDFDRHDGDRHCLRFQKRYPVIPTPLTRIFWWRICLDEAQMVESNAAAATEMALRLYTKHRWCITGTPIQRKLDDLFGLLKFLRANPFDVSRWWIEVIRDPYERRDTKAMEFTHKFFKQVMWRSSKVHVADELQLPPQEECVSWLKFSAIEEHFYSRQHDTCVSYAREVIETLKRDILKRGHTSSDNPLVTHAEAAKLLNSLLKLRQACCHPQVGSSGLRSLQQSPMTMEEILMVLVKKTQSEGEEALRVLIVALNGIAAIAMLKQEFSEAVSLYKEALSITEEHAEDFRLDPLLNIHILHNLAEILPMAKSYGGKLSASGRPETKIDVKDDDHHRASKRQRINELESLTHDSSETVHQREAIAPDNGLKKDGECHEECKTLDIVCDTLKVKYLSAFNSKLSAAQHEFKKSYNQVSESLSNMGKQRSVWWLDALQLTEQNKDFSSELTRKIEEALHGNLNNSSSSRESSRFRTIHGMKLHLQTCMDMLERSRKKVIDRILEIDQTMEKPKLEDIERISNCKYCNKNSDGPPCIHCELDELFQEYEARLFRLNKSRRGVMEIAAAEETVHLQKKRDARNLFLFGLSSRSKDLNASRGDDEEPTKRNAGDIVVLSKSPSETEIVLGVIRNHCKTHLDRESKLAATKHLHTLEVMRKEYVHARVLARDQAQLLRAYDEINMSTMRLQLRESEDDTSIYALGRDELDVASVLNTNDKFMAQSSLLSIKGKLRYLKGLMKSKQKQESESPDLSSPIHETVDASDPAEQESENLLKRDEACPICHEILRNQKMVFQCGHSTCCNCFFAMTERKSVQETLQKWVMCPICRQHTDVRNIAYADDRRNSSSSDQDHKDSEASLVVQGSYGTKIEAVTRRILWIKSSDPQTKVLVFSSWNDVLDVLEHAFAANSITCIRMKGGRKSQTAISKFKGSEKETQKTNSHQKEEKSIQVLLLLVQHGANGLNLLEAQHVILVEPLLNPAAEAQAVGRVHRIGQEKPTLVHRFLVSGTVEESIYKLNRNKNTNLSSFSSRNTKNQDQQFLTLKDLESLFASPTAETAEMEQNPGERQENLRDLPPSVAAALAAERRMKESNASSSTTNAS

SEQ ID NO: 681 - DNA, 885 bp, Arabidopsis thaliana
  G1030
cgaaaaatattcacagatattttcgatcttaaccgagaaaaaggaagaaatggctggaccatcgacaacttcaaacgcaccaaagcagaggaagagagtcgaagccgagactagcagcaacacttctactaccttacgtcgcgctaaagacggaagcgctttcgctctctgtgaaggatgtaacaagagtgtagctgtagcgcttataagcatgcacaattgcagtctcgatgctaagatcagagtgaatctcgaagcacaagttgtggagacacaagcagaggctaagaagaagcctgcagagaagaagaagacaacatctgatggacctaagccaaagagacttaagaaaaccaatgatgagaagaagagctcgtctacttcaaacaagcccaagcgacctcttaccgctttctttatcttcatgagtgacttccgtaaaacgtttaagtcagagcataatggttcgttagctaaggatgctgcaaagatcggtggtgagaagtggaagtctttgactgaggaagagaagaaagtttatctggataaagctgctgaacttaaggcagagtataacaagtcactggaaagtaatgatgctgatgaggaagaggaagatgaggagaagcaatctgatgatgttgatgatgctgaggagaaacaagttgacgatgatgatgaagttgaggagaaagaagttgagaacacagatgatgacaagaaagaagctgagggtaaagaagaggaggaagaagagattttggatgactactagaaatgatatgctcgtttttgtggttctagtcttactgaaatcggtttatctctaatcgttgcgatgcattgtaaatgaagcctttattagtgaaagtagtttatttgaaa

SEQ ID NO: 682 - protein, 241 aa, Arabidopsis thaliana
  G1030
MAGPSTTSNAPKQRKRVEAETSSNTSTTLRRAKDGSAFALCEGCNKSVAVALISMHNCSLDAKIRVNLEAQVVETQAEAKKKPAEKKKTTSDGPKPKRLKKTNDEKKSSSTSNKPKRPLTAFFIFMSDFRKTFKSEHNGSLAKDAAKIGGEKWKSLTEEEKKVYLDKAAELKAEYNKSLESNDADEEEEDEEKQSDDVDDAEEKQVDDDDEVEEKEVENTDDDKKEAEGKEEEEEEILDDY

SEQ ID NO: 683 - DNA, 1771 bp, Arabidopsis thaliana
  G1034
ggtgccggtttaattgggttatcggcttttattccctctatcgattatttaatcatcatttttcttcgcgcatcttttgtttagcgcaactgcatgtttttggttatcccttcaacataattgcatattaatttctttcattttaatacctgatacaaaaaagtcgctctaatatataatttattctcaaactttcaatacactccacacagcatggaaactgtacgatatccaaagtacgaaaattcgccggccgagaccatggtggaaagcttcgtgtcgacaccttcttcatttcataaccctccacttttcgacaacaacttaaaccctgtagatgggttttccccacaatcatttgaccgtgactacaatttcaacggtagtttatcagggctgaaccttcccgagaaaaaacccatcaaaaagcgcaagtcttggggacagcaacttcccgaacccaaaacaaaccttcctccgaggaagcgcgcaaagactcaagatgaaaaagagcaacggcgtgttgagcgcgtcctacgcaatcgtagagcggcccaatcatcacgagaacgaaaacgccaggaggtcgaggctttggaagtcgagaaacgagctattgagcgcaaaaacatggatcttgagatgcgcttagcagacatggaagcaaagtactaccttcttcaacaggaactgaaacgagccagtggttacaacaagacaaactttctttcctactctgattcttcaactccagacatctccgaagattcacaattatcacctttgactttctctaagcaactcttcaacgctcaagatgaattgtgtcgaccaataagtcctcagtcaatcggtccgctgacttcaagaaccgttgacccttctacactctcacctaagtctttatcttctcccgattcatccaattctaattcttccgacatgacacaacatcctgccgtggtgttgtgcgacctgcagtgtcagtcggaactgggtcagccttggatgaattcgacatatctttctttgagaacgaaagctctgaaattatcggtaacttaccttattacaatgttaacaacttttttgattgtcctcggaaacctgaatcagaatatcatgtttttaatgacgagatttctcctcacaccaacgtattttattcagaggatgaaaatattcggggacagaacgacggtgttttcgatgaatttgtcgtatgtgatcttctcaacgatgaaactctatcaaacgagagtctgcattcggatcagcttgctgggacgacgacaagcctgcagccgcaatttggcgcgttctctaatgaatgcgacgatggcggcattgcggtttgagtccaaacagcgactttttcgcaattttctctctactgtagcgcttcagatttctcgaagatcctcccactttttatggtactgaaaatactcgaagacactaaactgaacgagagaaatgagaagcgatggttccaatttcaaatgtcgaccttaacttattgtgttcgattgaggattagtaaaaatctaatggtatatttagaataatattcataaagaaaatttataataaatctactcaatacattgaaaaattagcttttggatttttactgcttaggatatagaaatggtcacagttcatagctggttatagacaacgatcatgaaattttaaatgtatctatcctccagtaaggtagtaatcaacgattttgatcgtctaccaccaaaaaaaaaaaaaaaaaaaa

SEQ ID NO: 684 - protein, 409 aa, Arabidopsis thaliana
  G1034
METVRYPKYENSPAETMVESFVSTPSSFHNPPLFDNNLNPVDGFSPQSFDRDYNFNGSLSGLNLPEKKPIKKRKSWGQQLPEPKTNLPPRKRAKTQDEKEQRRVERVLRNRRAAQSSRERKRQEVEALEVEKRAIERKNMDLEMRLADMEAKYYLLQQELKRASGYNKTNFLSYSDSSTPDISEDSQLSPLTFSKQLFNAQDELCRPISPQSIGPLTSRTVDPSTLSPKSLSSPDSSNSNSSDMTQHPAVVLCDLQCQSELGQPWMNSTYLSLRTKALKLSVTYLITMLTTFLIVLGNLNQNIMFLMTRFLLTPTYFIQRMKIFGDRTTVFSMNLSYVIFSTMKLYQTRVCIRISLLGRRQACSRNLARSLMNATMAALRFESKQRLFRNFLSTVALQISRRSSHFLWY

SEQ ID NO: 685 - DNA, 1722 bp, Arabidopsis thaliana
  G1037
atgactgttgaacaaaatttagaagctttggatcagtttcctgtaggaatgagagttcttgctgttgatgatgaccaaacttgtctcaaaatccttgaatctctccttcgtcactgccaataccatgtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataatgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatccgaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagaaggctatgcctaaaaagattttggatctgatgaatgttgagaagctcactagagaaaatgtggccagtcatcttcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatagctcttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtga

SEQ ID NO: 686 - protein, 573 aa, Arabidopsis thaliana
  G1037
MTVEQNLEALDQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVRSRFDKNRGSNNNGDKRDGSGNEGVGNSDPNNGKGNRKRKDQYNEDEDEDRDDNDDSCAQKKQRVVWTVELHKKFVAAVNQLGYEKAMPKKILDLMNVEKLTRENVASHLQKFRLYLKRISGVANQQAIMANSELHFMQMNGLDGFHHRPIPVGSGQYHGGAPAMRSFPPNGILGRLNSSSGIGVRSLSSPPAGMFLQNQTDIGKFHHVSSLPLNHSDGGNILQGLPMPLEFDQLQTNNNKSRNMNSNKSIAGTSMAFPSFSTQQNSLISAPNNNVVVLEGHPQATPPGFPGHQINKRLEHWSNAVSSSTHPPPPAHNSNSINHQFDVSPLPHSRPDPLEWNNVSSSYSIPFCDSANTLSSPALDTTNPRAFCRNTDFDSNTNVQPGVFYGPSTDAMALLSSSNPKEGFVVGQQKLQSGGFMVADAGSLDDIVNSTMKQV

SEQ ID NO: 687 - DNA, 2031 bp, Arabidopsis thaliana
  G1038
gctcgttttcaaattaaaaacagggagaaatttggaaattccagtacgacgggagataaaacctaacatacgccatggtgaccgttatctaaactacgccaaaatatttgaagtgtcgtcgtttcataataaaacgcaaacaaaaacccactcccactttctcctttccaaaaaaagaactctcgccactttctctgctcttttctttctctctctctttcttgttttcgccggcgatcatggagaaaagcggcttctctcccgtcggtctaagggttcttgtcgtagacgatgatccaacttggctcaagattctcgagaaaatgctcaagaagtgttcttacgaagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataatgatgtcggtggacggcgaaacaagccgagtgatgaagggagtgcacacgggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacaaagctggtcccaagaagatattggatctcatgaatgttccatggctcactagagaaaatgttgcaagccaccttcagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgaccccaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaatttctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaaggcgattctgaagaagcttgaactggggaacttccagaatcacatcattctgtttctttagacactgacttagacttgacttggcttcaaggcgagcgtttcttgcaaacaccgactccagtttcaagatacagtagtagcccatcactcctatctgagctcccagcccaccttaattggtatggaaatgagcggctgcctgaccctgacgagtattccttcatggtagaccaaggtttattcatatcttaaccttgttccaataacttcttttcgtatattggttggtgtaatgcagaaagattttgtgggtatacctgaaaataatcttgctttcccaagaaccttccatgatcggatgcattgtacaataatccacgagtgtcgtaggctaattacaccaaacaggttgatgacagtgataaggccacatgtttcacaccgtcgcttaagatctttactgtcacctggaaggaaa

SEQ ID NO: 688 - protein, 444 aa, Arabidopsis thaliana
  G1038
MEKSGFSPVGLRVLVVDDDPTWLKILEKMLKKCSYEVTTCGLAREALRLLRERKDGYDIVISDVNMPDMDGFKLLEHVGLELDLPVIMMSVDGETSRVMKGVHTGACDYLLKPIRMKELKIIWQHVLRKKLQEVRDIEGCGYEGGADWITRYDEAHFLGGGEDVSFGKKRKDFDFEKKLLQDESDPSSSSSKKARVVWSFELHHKFVNAVNQIGCDHKAGPKKILDLMNVPWLTRENVASHLQKYRLYLSRLEKGKELKCYSGGVKNADSSPKDVEVNSGYQSPGRSSYVFSGGNSLIQKATEIDPKPLASASLSDPNTDVIMPPKTKKTRIGFDPPISSSAFDSLLPWNDVPEVLESKPVLYENSFLQQQPLPSQSSYVAISAPSLMEEEMKPPYETPAGGSSVNADEFLMPQDKIPTVTLQDLDPSAMKLQEFNTEGDSEEA

SEQ ID NO: 689 - DNA, 1262 bp, Arabidopsis thaliana
  G1039
caagatttatgttttcgtaactgtaactcatagcaaaaacgagtctaagatctgttcataatgatgatgttcaagagcggtgacatggattacacccagaaaatgaagagatgtcacgaatatgtagaagctctagaagaagaacaaaaaaagattcaagtctttcaacgtgagctccctttatgtttagaacttgtaacccaagctatcgagtcatgtcggaaggagttatcggaatcttcagaacatgttggcggccagtcagaatgttctgagcggacaactagtgaatgcggcggtgccgtgtttgaagagtttatgccaatcaagtggagttctgcttcatctgatgaaaccgataaagatgaagaagctgagaaaactgagatgatgaccaatgaaaataacgatggtgataagaagaaatcggattggcttagatctgttcaattgtggaaccaatcaccagatccacaacctaataataagaaaccgatggtaattgaagtcaaacgcagcgctggtgcgtttcaaccgtttcaaaaggagaaacctaaggctgcagattctcaaccacttattaaagcaattactccgacgtcgacgacgacaactagttccacggcggaaaccgtcgggggtggaaaagagtttgaggagcagaaacaatctcattcgaataggaagcaaagacgttgctggtcaccggagttacaccgcagattcttgcacgcgcttcaacaacttggtggatcacatgttgctacgcctaagcagattagagatcttatgaaggtcgatggtttaactaatgacgaagttaaaagtcatttacagaaatatagattgcatacaagaagaccagctactccggtagtaaggaccggtggtgaaaatccacaacaacggcagtttatggtgatggaaggcatttgggtaccttcacacgatacaactaataatagagtttacgctcctgtggcgacacaaccgccgcaatcttcaacgtcgggagagagaagcaatcggggttgcaaatctcccgcaacatcttctactactacacacacaccacaccttcttcctctttcataaatatatagttaccgatttgtatgaaaatttgttttcttctttatatatttgttttgtaaccaagaatgttcgttctaggtttaagagttttgaataaattgtaacaatagatatacattgcacacaattgaataaaagaaaaagttttgataaaaaaaaaaaaaaaa

SEQ ID NO: 690 - protein, 344 aa, Arabidopsis thaliana
  G1039
MMMFKSGDMDYTQKMKRCHEYVEALEEEQKKIQVFQRELPLCLELVTQAIESCRKELSESSEHVGGQSECSERTTSECGGAVFEEFMPIKWSSASSDETDKDEEAEKTEMMTNENNDGDKKKSDWLRSVQLWNQSPDPQPNNKKPMVIEVKRSAGAFQPFQKEKPKAADSQPLIKAITPTSTTTTSSTAETVGGGKEFEEQKQSHSNRKQRRCWSPELHRRFLHALQQLGGSHVATPKQIRDLMKVDGLTNDEVKSHLQKYRLHTRRPATPVVRTGGENPQQRQFMVMEGIWVPSHDTTNNRVYAPVATQPPQSSTSGERSNRGCKSPATSSTTTHTPHLLPLS

SEQ ID NO: 691 - DNA, 1099 bp, Arabidopsis thaliana
  G1043
aaataagataccactcaccaaaaacttcctcaaaactaacaaatggatactaataaagcaaaaaagcttaaagttatgaaccaactcgttgaaggccatgacttaacaactcagcttcagcaactcctctctcaacccgggtccggtctagaggatctagtggctaaaatcttagtgtgtttcaataacaccatctccgttcttgataccttcgaacccatctcctcctcctcatccctcgccgccgttgagggatctcaaaatgcttcatgtgataacgacggcaagtttgaagattccggcgatagtcggaaaagattgggacccgttaagggtaaaagaggatgctacaaaagaaaaaagagatcggagacgtgtactatagagtcgactatacttgaggacgcattttcttggaggaaatatggacaaaaggagattcttaatgccaaattcccaagaagttactttagatgcacacacaagtatacccaagggtgcaaggcaacaaagcaagtccagaaggttgagctcgaacccaagatgttcagtatcacatacataggaaaccacacgtgtaacaccaacgcagaaactcccaagagcaagacttgtgaccatcatgatgagatcttcatggattccgaagatcacaagagtcctagtttatctacctcaatgaaggaagaagacaatcctcatcgtcatcatggttcgtccacggagaatgacttgtcattggtgtggccagaaatggttttcgaagaagattatcatcatcaggccagttacgtcaatgggaaaacgagtacatctatcgatgttttgggttctcaggatctcatggtgtttggaggtggcggcgatttcgagtttagcgaaaatgagcacttctctatcttcagttcatgttcgaatctatcttgagtttaccactactataggactaagaccatgagttttaatcattaattaggccatgtagagtggaaaacatataatacatattttgcccttttctctaatgagtgtatgtactgtacatatagtactataaataaaactcttgctggattaaaacaaaaaaaaaaaaaaaaaa

SEQ ID NO: 692 - protein, 294 aa, Arabidopsis thaliana
  G1043
MDTNKAKKLKVMNQLVEGHDLTTQLQQLLSQPGSGLEDLVAKILVCFNNTISVLDTFEPISSSSSLAAVEGSQNASCDNDGKFEDSGDSRKRLGPVKGKRGCYKRKKRSETCTIESTILEDAFSWRKYGQKEILNAKFPRSYFRCTHKYTQGCKATKQVQKVELEPKMFSITYIGNHTCNTNAETPKSKTCDHHDEIFMDSEDHKSPSLSTSMKEEDNPHRHHGSSTENDLSLVWPEMVFEEDYHHQASYVNGKTSTSIDVLGSQDLMVFGGGGDFEFSENEHFSIFSSCSNLS

SEQ ID NO: 693 - DNA, 968 bp, Arabidopsis thaliana
  G1045
aacattttaaggtaatctcaaaaccaaaaagcctatcaatctttgtacttggatgttttgttgttgcaaggattgcagaggaaaccaacgagtttctaactttgattctctaacaggtgttttctttggagatcttgagtttggacctcagaatcaaagatatataaagatgaatgaggaagaagataaagatcaagatcgagtaacgagaggatgtagtcacactcatagctgtaaccctccaggcccagaggatgcttctcactcccacacatgcttccacgctcacactcatctcatcatctctcaggatcagcaagagaatgatcattctgacagtagcaacaagaaacggttatgtggtaatagagaggcagtgaggaagtacagggagaagaagaaggctcgcactgcataccttgaagatgaagtgatgagattgcaatctctgaatgagcaattccttagaaaacttcagagccaagaaatggtggaaactgaattgatcagactccgggctcttctggtagagatgcaggggaaaattgaagttgaactttgtagtttctcgtttcagaaacaatgcaacggttctggttttgtgttcaaagaagatggatgcaacttagcaacaagtaatatgatgtgtgaagcggcaagagtggagtgcgaggagggccaaacacttcatgatcctattcaatcttttgttcctcaaccaccaccattctcacgttaagcgtttacgggctgtggtattgtgtgtatatatatacatatgggtttaattaggggcatagaggtcggattccaatatagttaacatatacacagattggtaacttattctacatatgtctattttaagggtaccaaaacatcttgatgtggaattgattttgaaatgaagaggaggatgattgtagatttgtagttgtatgtatatatgatgataattgtgggcttaa

SEQ ID NO: 694 - protein, 228 aa, Arabidopsis thaliana
  G1045
MFCCCKDCRGNQRVSNFDSLTGVFFGDLEFGPQNQRYIKMNEEEDKDQDRVTRGCSHTHSCNPPGPEDASHSHTCFHAHTHLIISQDQQENDHSDSSNKKRLCGNREAVRKYREKKKARTAYLEDEVMRLQSLNEQFLRKLQSQEMVETELIRLRALLVEMQGKIEVELCSFSFQKQCNGSGFVFKEDGCNLATSNMMCEAARVECEEGQTLHDPIQSFVPQPPPFSR

SEQ ID NO: 695 - DNA, 1035 bp, Arabidopsis thaliana
  G1048
gaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctctctcttgttttgtatttcgctgttgaaagttttctgtctaatatcgataagttaacagtgaaaaaaaaaaaaaaaaa

SEQ ID NO: 696 - protein, 295 aa, Arabidopsis thaliana
  G1048
MAEEFGSIDLLGDEDFFFDFDPSIVIDSLPAEDFLQSSPDSWIGEIENQLMNDENHQEESFVELDQQSVSDFIADLLVDYPTSDSGSVDLAADKVLTVDSPAAADDSGKENSDLVVEKKSNDSGSEIHDDDDEEGDDDAVAKKRRRRVRNRDAAVRSRERKKEYVQDLEKKSKYLERECLRLGRMLECFVAENQSLRYCLQKGNGNNTTMMSKQESAVLLLESLLLGSLLWLLGVNFICLFPYMSHTKCCLLRPEPEKLVLNGLGSSSKPSYTGVSRRCKGSRPRMKYQILTLAA

SEQ ID NO: 697 - DNA, 1766 bp, Arabidopsis thaliana
  G1050
ttccccatttcagaaaatcaaaatgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggtttcggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaaaccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcagacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactagggtaagtaaaactgcgatccgcagttgtctagttacatatatgataagaatcttttgtgcagagttctgtttttggaagttttaaagaaacatatataaagattatgtccgggaaatttgatcatatttcctgaaacatacacacatatatatagtggtaatggaggactttctttctggacca

SEQ ID NO: 698 - protein, 519 aa, Arabidopsis thaliana
  G1050
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVSVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVQTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 699 - DNA, 1304 bp, Arabidopsis thaliana
  G1052
tgatcatctaaaactttcaatttctctcttgatcctcacttgaattttttgttgtttctctcaaatctttgatcctttcctttgtttttcatttgacctcttacaaaaaaatctggtgtgccattaaatctttattaatggcacaacttcctccgaaaatcccaaccatgacgacgccaaattggcctgacttctcctcccagaaactcccttccatagccgcaacggcggcagccgcagcaaccgctggacctcaacaacaaaacccttcatggatggatgagtttctcgacttctcagcgactcgccgtgggactcaccgtcgttctataagcgactccattgctttccttgaaccaccttcctccggcgtcggaaaccaccacttcgataggtttgacgacgagcaattcatgtccatgttcaacgacgacgtacacaacaataaccacaatcatcatcatcatcacagcatcaacggcaatgtgggtcccacgcgttcatcctccaacacctccacgccgtccgatcataatagccttagcgacgacgacaacaacaaagaagcaccaccgtccgatcatgatcatcacatggacaataatgtagccaatcaaaacaacgccgccggtaacaattacaacgaatcagacgaggtccaaagccagtgcaagacggagccacaagatggtccgtcggcgaatcaaaactccggtggaagctccggtaatcgtattcacgaccctaaaagggtaaaaagaattttagcaaataggcaatcagcacagagatcaagggtgaggaaattgcaatacatatcagagcttgaaaggagcgttacttcattgcagactgaagtgtcagtgttatcgccaagagttgcgtttttggatcatcagcgattgcttctcaacgtcgacaatagtgctatcaagcaacgaatcgcagctttagcacaagataagattttcaaagacgctcatcaagaagcattgaagagagaaatagagagacttcgacaagtatatcatcaacaaagcctcaagaagatggagaataatgtctccgatcaatctccggccgatatcaaaccgtccgttgagaaggaacagctcctcaatgtctaaagctgttcgttcactaagatctttcttttcatggcgaaaagattcttgactataaaacctctttgtgtcaagaaattaatttatcaaagaagatggccttttttatttgatctaatcacatttttttaagttgtgatgaatttgcttttgatgtatctgtttttttttttttttttt

SEQ ID NO: 700 - protein, 329 aa, Arabidopsis thaliana
  G1052
MAQLPPKIPTMTTPNWPDFSSQKLPSIAATAAAAATAGPQQQNPSWMDEFLDFSATRRGTHRRSISDSIAFLEPPSSGVGNHHFDRFDDEQFMSMFNDDVHNNNHNHHHHHSINGNVGPTRSSSNTSTPSDHNSLSDDDNNKEAPPSDHDHHMDNNVANQNNAAGNNYNESDEVQSQCKTEPQDGPSANQNSGGSSGNRIHDPKRVKRILANRQSAQRSRVRKLQYISELERSVTSLQTEVSVLSPRVAFLDHQRLLLNVDNSAIKQRIAALAQDKIFKDAHQEALKREIERLRQVYHQQSLKKMENNVSDQSPADIKPSVEKEQLLNV

SEQ ID NO: 701 - DNA, 549 bp, Arabidopsis thaliana
  G1053
gaaactcttacatactcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactcaaa

SEQ ID NO: 702 - protein, 166 aa, Arabidopsis thaliana
  G1053
MIPAEINGYFQYLSPEYNVINMPSSPTSSLNYLNDLIINNNNYSSSSNSQDLMISNNSTSDEDHHQSIMVLDERKQRRMLSNRESARRSRMRKQRHLDELWSQVIRLRNENNCLIDKLNRVSETQNCVLKENSKLKEEASDLRQLVCELKSNKNNNNSFPREFEDN

SEQ ID NO: 703 - DNA, 2221 bp, Arabidopsis thaliana
  G1055
atgacggaatcaacatccgtggttgctcctccgccggagatacctaatctgaaccctagcatgttttctgagtccgatttgttttctattccgccgctagatcctcttttcctatctgattctgatccgatttcaatggatgcgccaatctccgatctcgacttcttactcgacgatgagaacggagatttcgctgattttgatttctcgtttgataattctgatgatttcttcgatttcgatttatcggagcccgcggtggtgatccctgaggagatcggtaacaatcgttcgaatttggactcatcggaaaacagaagcggcgatggaggtttagaaggaagatctgagtctgttcattcacaggtttcatctcaaggctccaagacttttgtgtccgacaccgttgacgcatcatcctcccctgaatcaagcaatcaccagaaatcttctgttagcaagaggaagaaggaaaatggagactccagtggcgaattaaggagctgcaagtaccaaaagtccgatgataaatcagtcgctacgaacaacgaaggtgatgatgacgacgacaagaggaagttgataaggcagattaggaaccgtgaaagtgctcagctttcgaggttgaggaagaagcaacaaactgaggagcttgaaagaaaagtgaagagtatgaatgctaccattgctgaattgaatggtaagattgcttatgttatggctgagaatgtcgctttaaggcaacaaatggctgttgcttctggtgctcctcctatgaatccttatatggctgccccgcctttaccgtatcaatggatgccgtatccgccgtatcctgttaggggatatggatcacagacacctttggttcccattcctaagttaaatcctaagcctgtctcgagttgtagaccgaagaaggcagagagtaagaagaatgagggtaaaagtaagctcaagaaggttgctagtattagttttattggaattctcttctttgtcttcttgtttggtacattggttccttttatgaatgtaaattttggaggagaacgtggaagctttggcggtttgtctaaatatgatggccaccggtattacgatgaacataaggggagggttttaatggtcggcgatggttctgatgttagaagaaatagtggaatttctgaaggaaatatccattctagtaggattagtcatggtgagagagatagttgtggaggagtagattataatgctcatccgaaagtagaaggacgaccaagttcgttgagcaatgccagtgatcctctctttgcttctctctatgtcccaagaaacgatgggcttgtgaagatcgatgggaacttgataattcactctgttttggcgagcgagaaagcaaggggtttaggaaagaagaatatcactgaaacagtaaaaactaaagaaccggatttgaccattcctggtgcactgtcttctgcattagctgttccgggggtaagaggaaatgcagcaatgcttccgcattcaacagctctctcttctgaagggaaaagacttcaccaatggtttcatgaaggtggctcagggccactaatggattacagcatgtgcaccgaggttttccagtttgatattgctcctggtgctatagtcccgtcatcagtctccagcatttctgcggagcatctccaaaatgtcactacccacggcaagagaatgaagaacaggagaatccttgagggacttcctgtttcacttgtggcgtcagagctcaatatcaccggaacccagccaaacaaagacgctcaaaataagacctttaatggaaacactaacaaacccacatcatcatcctccatggttgtctcagtgttacttgatccaagagaggtcgttgactctgaaaccgacagagtggttcccccaaacccaaaatcactttcccggatctttgtggtggtgcttcttgacagtgtcaagtacgttacctactcatgcgttcttcctcgatcgggtctccatctcgtagccacctgatttgagctactcagatcttgaccttaagtaggcgaacattgacttgtttatacatacagaccttgttgactttttttccctgtgttgtataactcttatgttctaaggttttggattttaattttgagataagcataaagtggaatccttgttttaaaggcatttccaatagctttaggctgataatacatcc

SEQ ID NO: 704 - protein, 675 aa, Arabidopsis thaliana
  G1055
MTESTSVVAPPPEIPNLNPSMFSESDLFSIPPLDPLFLSDSDPISMDAPISDLDFLLDDENGDFADFDFSFDNSDDFFDFDLSEPAVVIPEEIGNNRSNLDSSENRSGDGGLEGRSESVHSQVSSQGSKTFVSDTVDASSSPESSNHQKSSVSKRKKENGDSSGELRSCKYQKSDDKSVATNNEGDDDDDKRKLIRQIRNRESAQLSRLRKKQQTEELERKVKSMNATIAELNGKIAYVMAENVALRQQMAVASGAPPMNPYMAAPPLPYQWMPYPPYPVRGYGSQTPLVPIPKLNPKPVSSCRPKKAESKKNEGKSKLKKVASISFIGILFFVFLFGTLVPFMNVNFGGERGSFGGLSKYDGHRYYDEHKGRVLMVGDGSDVRRNSGISEGNIHSSRISHGERDSCGGVDYNAHPKVEGRPSSLSNASDPLFASLYVPRNDGLVKIDGNLIIHSVLASEKARGLGKKNITETVKTKEPDLTIPGALSSALAVPGVRGNAAMLPHSTALSSEGKRLHQWFHEGGSGPLMDYSMCTEVFQFDIAPGAIVPSSVSSISAEHLQNVTTHGKRMKNRRILEGLPVSLVASELNITGTQPNKDAQNKTFNGNTNKPTSSSSMVVSVLLDPREVVDSETDRVVPPNPKSLSRIFVVVLLDSVKYVTYSCVLPRSGLHLVAT

SEQ ID NO: 705 - DNA, 923 bp, Arabidopsis thaliana
  G1056
gctacatatatgggttctattagaggaaacattgaagagcctatatctcagtcattaacgaggcagaactctctctatagcttaaagctccatgaggttcaaacccacttaggaagttctggaaaaccactaggaagcatgaaccttgatgagcttctcaagactgtcttgccaccagctgaggaagggcttgttcgtcagggaagcttgacgttacctcgagatctcagtaaaaagacagttgatgaggtctggagagatatccaacaggacaagaatggaaacggtactagtactactactactcataagcagcctacactcggtgaaataacacttgaggatttgttgttgagagctggtgtagtgactgagacagtagtccctcaagaaaatgttgttaacatagcttcaaatgggcaatgggttgagtatcatcatcagcctcaacaacaacaagggtttatgacatatccggtttgcgagatgcaagatatggtgatgatgggtggattatcggatacaccacaagcgcctgggaggaaaagagtagctggagagattgtggagaagactgttgagaggagacagaagaggatgatcaagaacagagaatctgcagcacgttcacgagctaggaaacaggcttatacacatgaattagagatcaaggtttcaaggttagaagaagaaaacgaaaaacttcggaggctaaaggaggtggagaagatcctaccaagtgaaccaccaccagatcctaagtggaagctccggcgaacaaactctgcttctctctgatcctaaagactcttctttctttcttcttctttgtgttggtttatatcagaccgctttgttctttgtatattgtgtagactttattgactttgaacagcatgtctttataaacatttcttgagtgt

SEQ ID NO: 706 - protein, 262 aa, Arabidopsis thaliana
  G1056
MGSIRGNIEEPISQSLTRQNSLYSLKLHEVQTHLGSSGKPLGSMNLDELLKTVLPPAEEGLVRQGSLTLPRDLSKKTVDEVWRDIQQDKNGNGTSTTTTHKQPTLGEITLEDLLLRAGVVTETVVPQENVVNIASNGQWVEYHHQPQQQQGFMTYPVCEMQDMVMMGGLSDTPQAPGRKRVAGEIVEKTVERRQKRMIKNRESAARSRARKQAYTHELEIKVSRLEEENEKLRRLKEVEKILPSEPPPDPKWKLRRTNSASL

SEQ ID NO: 707 - DNA, 1663 bp, Arabidopsis thaliana
  G1057
tgcaaaattaagctcagagattcacaccgcatctgaaattgtgctcagaggggttccaaatattaccagtcgttaggaagcaatcacgagttgttttaggaattagtgaacgtgataatggctagcaatgagatggaaaaatcgagtaaagagaaggaacctaaaacacctcctccttcttctactgcccctccctcttcacaggaaccttcatcggctgtgagtgctggcatggctactccagattggtctggttttcaggcatattctcctatgccgccgcctcatggttatgtggcatctagtccccaacctcacccttatatgtggggagttcagcatatgatgcctccttatggaactccgcctcatccttatgttgcaatgtatcccccaggtggcatgtacgcacatccttcaatgcctccgggttcttatccctatagcccttatgctatgccttctccaaatggaatgactgaagtttctggcaatactacaggcggcactgatggtgatgctaaacaatctgaagtgaaggaaaaattgcccatcaaaagatcaagaggaagcttgggaagtttgaacatgattacaggaaagaacaatgaacctgggaaaaactcaggagcatcagctaatggagcttactccaaaagtggggagagtgcttctgatggttcaagtgaaggaagtgatgggaactctcaaaatgattcgggatctggactagatggaaaggatgctgaagcagcatcagagaatggtggttctgccaatggtccgcaaaatggaagtgctggtacacctattctaccggtgagccagaccgtaccaatcatgccaatgacagctgcaggtgttcctggcccaccaacaaatttaaatattgggatggattactggggtgctccaacttcagctggtatccctggaatgcatgggaaagtatctacaccagttcctggagttgttgctccaggctcgcgagatggtggccattcacaaccctggttacaggacgatagagaacttaagcgacagagacggaagcagtccaatagggagtctgctcgaagatcaaggttgcgtaaacaggccgaatgtgatgagctggcccaacgcgctgaggtgttgaacgaagaaaacacaaatctcagagcagaaatcaacaagctcaaaagccaatgcgaagagcttaccaccgagaacacctctctcaaggaccaactttcattattccctccacttgaaggcataagcatggacaatgaccaccaagaaccagacaccaatcaaacaggtgccgcagagagaaaggttgattcatacaaagactcaacgtgagaagacatagagcaaaaccaattcctaacacaggtataaaaaagtagcagcagcagcaacaacaacactcggcggttctttgctaacagatggtttgtaggattttaggcatcagagatcgattggttccgaatagtttattgagggttgttggtccagtgtatgtgtgtgtaagttacgaaattagatattgggagaaaaaattccctcgtttaatgttttactttgcctttgctctacttgcagaagcgaatctgaggcaatgtgcttatctgtatcaaaattgttaccctttttattagcttttcctatttat

SEQ ID NO: 708 - protein, 409 aa, Arabidopsis thaliana
  G1057
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSGNTTGGTDGDAKQSEVKEKLPIKRSRGSLGSLNMITGKNNEPGKNSGASANGAYSKSGESASDGSSEGSDGNSQNDSGSGLDGKDAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKDQLSLFPPLEGISMDNDHQEPDTNQTGAAERKVDSYKDST

SEQ ID NO: 709 - DNA, 1421 bp, Arabidopsis thaliana
  G1058
aaaagatttcgggtcgatgaacatggatgaactcctgaagagcatatggactgctgaggaagctcaggccatggccatgacttctgcgccagctgctacagcggtagcgcaacctggtgctggtatcccacccccaggtgggaatctccagaggcaaggttcgttgacgttgcctagaacaattagtcagaagactgttgatgaggtgtggaaatgtttgatcaccaaggatggtaatatggaaggtagcagcggaggcggtggtgagtcgaatgtgcctcctggaaggcaacagactttaggggaaatgacacttgaagaatttctgttccgtgctggggttgtaagagaagataactgtgttcaacagatgggtcaggtcaacggaaacaataacaatgggttttatggtaacagcactgctgctggcggcttaggttttggatttggtcagccaaatcaaaacagcataacattcaatggtactaatgattctatgatcttgaatcagccacctggtttagggctcaaaatgggtggaacaatgcagcagcaacaacaacaacagcagttgcttcagcagcaacaacagcagatgcagcagctgaatcagcctcatccacagcagcggctgcctcaaaccatttttcctaaacaagcaaacgtagcattttctgcgcctgtgaatataaccaacaagggttttgctggggctgcaaataattctatcaacaataataatggattagctagttacggaggaaccggggtcactgttgcagcaacttctccaggaacaagcagcgcagaaaataattctttatcaccagttccgtatgtgcttaatcgaggacgaagaagcaatacaggtctagagaaggttatcgagaggaggcaaaggagaatgatcaagaatcgggaatcagctgctagatcaagagctcgaaagcaggcttatacattggaactggaagccgaaattgaaaagctcaagaaaacgaatcaagaactgcagaaaaaacaggctgaaatggtggaaatgcagaagaatgagctgaaagaaacgtcgaagcgaccgtggggcagcaaaaggcaatgcttgagaaggacattaaccggaccatggtgaaggatgaagcaacaagaacggatgaaccagactcctagcttgggattaatgtaataggatagtgctacctgtacaggagattaagagaaattgagtgaaagatctaggttacagagtaggagagagttttcattatgaataaatgacattttgtgccctgacctttgttagtttaggtttagattatcctctgttattgacttattgtgctttctggttgttagggtttctaaaagacatagttgtttatatatatgtctgactttgtaaaaaaaaaaaaaaaaaaaaaaaa

SEQ ID NO: 710 - protein, 370 aa, Arabidopsis thaliana
  G1058
MNMDELLKSIWTAEEAQAMAMTSAPAATAVAQPGAGIPPPGGNLQRQGSLTLPRTISQKTVDEVWKCLITKDGNMEGSSGGGGESNVPPGRQQTLGEMTLEEFLFRAGVVREDNCVQQMGQVNGNNNNGFYGNSTAAGGLGFGFGQPNQNSITFNGTNDSMILNQPPGLGLKMGGTMQQQQQQQQLLQQQQQQMQQLNQPHPQQRLPQTIFPKQANVAFSAPVNITNKGFAGAANNSINNNNGLASYGGTGVTVAATSPGTSSAENNSLSPVPYVLNRGRRSNTGLEKVIERRQRRMIKNRESAARSRARKQAYTLELEAEIEKLKKTNQELQKKQAEMVEMQKNELKETSKRPWGSKRQCLRRTLTGPW

SEQ ID NO: 711 - DNA, 1313 bp, Arabidopsis thaliana
  G1061
caaaaaaaagtgtagaagcagaagaaacccatcatcatcatgatgaactcttctcttctaactccttcttcttcatcttcttcccatatccaaactccatcaacaactttcgaccacgaagacttcctcgatcaaatcttttcctcggccccgtggccctccgtcgtcgatgatgctcatcctcttccctccgatggcttccacggccacgatgtcgactcaaggaatcagccgatcatgatgatgcctttgaatgatggctcctccgtccacggtctttataatggcttctccgtcgccggatctcttcctaactttcaaatccctcagggatcggagggaggattgatgaaccaacaaggacaaacgcaaacgcaaacgcaacctcaggcgagcgcgtctacagctactggcggtacggtggcggctccgccgcagagtaggactaaaatccgagctaggagaggtcaagcaactgatcctcatagtatcgccgaaaggttacgaagagagagaattgcggaaagaatgaaagctcttcaagaactcgttcctaacggcaataagacagacaaggcatcgatgctcgatgagatcatagattatgtcaagtttttacaactccaagtcaaggtactgagcatgagcagattgggaggtgctgcttccgtttcttctcaaatctccgaggctggtggatcccacgggaacgcatcctccgccatggtcggcggtagccagacggccggaaactccaacgacagcgttacaatgacggaacatcaagtggccaaactaatggaagaagacatgggctcggccatgcaatatcttcaagggaaaggtctttgtctcatgccaatctctttagccaccgccatctcaaccgccacgtgtcactcccgtaaccctttgatccctggagctgttgccgacgccggaggtccttcccctcccaatctttctgccatgaccatacagtcgacgagtacaaaaatgggtagcggtaatgggaaattaaacggtaacggcgtgaccgagaggtcgtcttctatcgccgttaaagaggccgtatccgtttcgaaagcgtgataacggccgtttacttttggggttaggcagagagataccaaaaacaaagagaaagtggggtgaagtgggagataaagtcaaagtctacgaagaatgaggttgaggttgtttgatgtgttctctcaacgaagccatatttttcgtagagttttggttcttttacctacgcactacaaaaccactcaagggacatttctttttcttttttaaatatatggtgc

SEQ ID NO: 712 - protein, 350 aa, Arabidopsis thaliana
  G1061
MMNSSLLTPSSSSSSHIQTPSTTFDHEDFLDQIFSSAPWPSVVDDAHPLPSDGFHGHDVDSRNQPIMMMPLNDGSSVHGLYNGFSVAGSLPNFQIPQGSEGGLMNQQGQTQTQTQPQASASTATGGTVAAPPQSRTKIRARRGQATDPHSIAERLRRERIAERMKALQELVPNGNKTDKASMLDEIIDYVKFLQLQVKVLSMSRLGGAASVSSQISEAGGSHGNASSAMVGGSQTAGNSNDSVTMTEHQVAKLMEEDMGSAMQYLQGKGLCLMPISLATAISTATCHSRNPLIPGAVADAGGPSPPNLSAMTIQSTSTKMGSGNGKLNGNGVTERSSSIAVKEAVSVSKA

SEQ ID NO: 713 - DNA, 2026 bp, Arabidopsis thaliana
  G1062
caaaaaaaaagtttcaatttttgaaagctctgagaaatgaaatctatcattctctctctctatctctatcttccttttcagatttcgcttcttcaattcatgaaatcctcgtgattctactttaatgcttctctttttttacttttccaagtctctgaatattcaaagtatatatcttttgttttcaaacttttgcagaattgtcttcaagcttccaaatttcagttaaaggtctcaactttgcagaattttcctctaaaggttcagactttggggtaaaggtgtcaactttggcgatgggtcttgacggaaacaatggtggaggggtttggttaaacggtggtggtggagaaagggaagagaacgaggaaggttcatggggaaggaatcaagaagatggttcttctcagtttaagcctatgcttgaaggtgattggtttagtagtaaccaaccacatccacaagatcttcagatgttacagaatcagccagatttcagatactttggtggttttccttttaaccctaatgataatcttcttcttcaacactctattgattcttcttcttcttgttctccttctcaagcttttagtcttgacccttctcagcaaaatcagttcttgtcaactaacaacaacaagggttgtcttctcaatgttccttcttctgcaaacccttttgataatgcttttgagtttggctctgaatctggttttcttaaccaaatccatgctcctatttcgatggggtttggttctttgacacaattggggaacagggatttgagttctgttcctgatttcttgtctgctcggtcacttcttgcgccggaaagcaacaacaacaacacaatgttgtgtggtggtttcacagctccgttggagttggaaggttttggtagtcctgctaatggtggttttgttgggaacagagcgaaagttctgaagcctttagaggtgttagcatcgtctggtgcacagcctactctgttccagaaacgtgcagctatgcgtcagagctctggaagcaaaatgggaaattcggagagttcgggaatgaggaggtttagtgatgatggagatatggatgagactgggattgaggtttctgggttgaactatgagtctgatgagataaatgagagcggtaaagcggctgagagtgttcagattggaggaggaggaaagggtaagaagaaaggtatgcctgctaagaatctgatggctgagaggagaaggaggaagaagcttaatgataggctttatatgcttagatcagttgtccccaagatcagcaaaatggatagagcatcaatacttggagatgcaattgattatctgaaggaacttctacaaaggatcaatgatcttcacaatgaacttgagtcaactcctcctggatctttgcctccaacttcatcaagcttccatccgttgacacctacaccgcaaactctttcttgtcgtgtcaaggaagagttgtgtccctcttctttaccaagtcctaaaggccagcaagctagagttgaggttagattaagggaaggaagagcagtgaacattcatatgttctgtggtcgtagaccgggtctgttgctcgctaccatgaaagctttggataatcttggattggatgttcagcaagctgtgatcagctgttttaatgggtttgccttggatgttttccgcgctgagcaatgccaagaaggacaagagatactgcctgatcaaatcaaagcagtgcttttcgatacagcagggtatgctggtatgatctgatctgatcctgacttcgagtccattaagcatctgttgaagcagagctagaagaactaagtccctttaaatctgcaattttcttctcaactttttttcttatgtcataacttcaatctaagcatgtaatgcaattgcaaatgagagttgtttttaaattaagcttttgagaacttgaggttgttgttgttggatacataacttcaaccttttattagcaatgttaacttccatttatgtttcatctt

SEQ ID NO: 714 - protein, 494 aa, Arabidopsis thaliana
  G1062
MGLDGNNGGGVWLNGGGGEREENEEGSWGRNQEDGSSQFKPMLEGDWFSSNQPHPQDLQMLQNQPDFRYFGGFPFNPNDNLLLQHSIDSSSSCSPSQAFSLDPSQQNQFLSTNNNKGCLLNVPSSANPFDNAFEFGSESGFLNQIHAPISMGFGSLTQLGNRDLSSVPDFLSARSLLAPESNNNNTMLCGGFTAPLELEGFGSPANGGFVGNRAKVLKPLEVLASSGAQPTLFQKRAAMRQSSGSKMGNSESSGMRRFSDDGDMDETGIEVSGLNYESDEINESGKAAESVQIGGGGKGKKKGMPAKNLMAERRRRKKLNDRLYMLRSVVPKISKMDRASILGDAIDYLKELLQRINDLHNELESTPPGSLPPTSSSFHPLTPTPQTLSCRVKEELCPSSLPSPKGQQARVEVRLREGRAVNIHMFCGRRPGLLLATMKALDNLGLDVQQAVISCFNGFALDVFRAEQCQEGQEILPDQIKAVLFDTAGYAGMI

SEQ ID NO: 715 - DNA, 869 bp, Arabidopsis thaliana
  G1065
cggacgcgtgggtttggttttcttttttcctctctatttcttcggctgagaggcggcgactatggcggaggaacagaagatagcgttagaatcagaatctccggcgaaggttacgactcctgctccagcagatacaccggctccagctccggcagagattccggctccagctccagctccgactccggctgatgtcacgaaagacgttgcagaggagaaaattcaaaacccacctccggagcaaattttcgatgactccaaagcccttactgttgttgagaaacctgtagaagagcctgcaccggcgaaacctgcgtctgcatcgctcgatagagatgttaagctagctgatttgtcaaaggaaaagagattgtctttcgtcagagcgtgggaagaaagcgaaaagagcaaagcagagaacaaagctgagaagaagattgcagatgttcatgcttgggaaaacagcaagaaagcagctgtcgaagcgcaactcaagaaaatcgaggagcaactagagaagaagaaagcagagtatgcagagaggatgaagaataaggttgcagcgattcacaaggaagcagaagagagaagagcaatgattgaagctaagcgtggagaagacgttcttaaagcagaagaaacggctgctaaatacagagccactggaattgttccaaaggcaacttgtggatgtttctaatcttgaatttgcgaatcaaagtttcaagacttcgtaactgtaaagtgtaatcaaatttctctgttctctttaatggcttgtaatgttgtttgtatattgattttgtgtgtgacaatcagagtgaaaaatatgtttcattgttttctaaaaaaaaaaaaaaaaaaaaaaa

SEQ ID NO: 716 - protein, 212 aa, Arabidopsis thaliana
  G1065
MAEEQKIALESESPAKVTTPAPADTPAPAPAEIPAPAPAPTPADVTKDVAEEKIQNPPPEQIFDDSKALTVVEKPVEEPAPAKPASASLDRDVKLADLSKEKRLSFVRAWEESEKSKAENKAEKKIADVHAWENSKKAAVEAQLKKIEEQLEKKKAEYAERMKNKVAAIHKEAEERRAMIEAKRGEDVLKAEETAAKYRATGIVPKATCGCF

SEQ ID NO: 717 - DNA, 1473 bp, Arabidopsis thaliana
  G1067
tctcaagcttctctctcctttttttcccatagcacatcagaatcgctaaatacgactcctatgcaaagaagaagctacttctttctcttgccctaattaatctacctaactagggtttcctcttacctttcatgagagagatcatttaacataagtcaccttttttatatcttttgcttcgtctttaatttagttctgttcttggtctgtttctatattttgtcggcttgcgtaaccgatcacaccttaatgctttagctattgtttcctcaaaatcatgagttttgacttctcgatctgagttttctttttctctctttacgctcttcttcacctagctaccaatatatgaacgagcaggatcaagaatcgagaaattgatttgagctggcgaataagcagtggtgggatagggaattagtagatgcggcggcgatggaaggcggttacgagcaaggcggtggagcttctagatacttccataacctctttagaccggagattcaccaccaacagcttcaaccgcagggcgggatcaatcttatcgaccagcatcatcatcagcaccagcaacatcaacaacaacaacaaccgtcggatgattcaagagaatctgaccattcaaacaaagatcatcatcaacagggtcgacccgattcagacccgaatacatcaagctcagcaccgggaaaacgtccacgtggacgtccaccaggatctaagaacaaagccaagccaccgatcatagtaactcgtgatagccccaacgcgcttagatctcacgttcttgaagtatctcctggagctgacatagttgagagtgtttccacgtacgctaggaggagagggagaggcgtctccgttttaggaggaaacggcaccgtatctaacgtcactctccgtcagccagtcactcctggaaatggcggtggtgtgtccggaggaggaggagttgtgactttacatggaaggtttgagattctttcgctaacggggactgttttgccacctcctgcaccgcctggtgccggtggtttgtctatatttttagccggagggcaaggtcaggtggtcggaggaagcgttgtggctccccttattgcatcagctccggttatactaatggcggcttcgttctcaaatgcggttttcgagagactaccgattgaggaggaggaagaagaaggtggtggtggcggaggaggaggaggaggagggccaccgcagatgcaacaagctccatcagcatctccgccgtctggagtgaccggtcagggacagttaggaggtaatgtgggtggttatgggttttctggtgatcctcatttgcttggatggggagctggaacaccttcaagaccacctttttaattgaattttaatgtccggaaatttatgtgtttttatcatcttgaggagtcgtctttcctttgggatatttggtgtttaatgtttagttgatatgcatatttt

SEQ ID NO: 718 - protein, 311 aa, Arabidopsis thaliana
  G1067
MEGGYEQGGGASRYFHNLFRPEIHHQQLQPQGGINLIDQHHHQHQQHQQQQQPSDDSRESDHSNKDHHQQGRPDSDPNTSSSAPGKRPRGRPPGSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEEEEEGGGGGGGGGGGPPQMQQAPSASPPSGVTGQGQLGGNVGGYGFSGDPHLLGWGAGTPSRPPF

SEQ ID NO: 719 - DNA, 1606 bp, Arabidopsis thaliana
  G1068
gagagttgttagctagctcacacgctttcgcttaaaactcaaaaacctgcactttctcgtctattttctcggcattcgtaaaacagaaaagtgggtctccaagaaaattaccctaaattcacaaagattcatacttttctccacctccaatggattccagagagatccaccaccaacaacagcaacaacaacaacaacaacagcagcagcagcaacaacagcaacatctacaacaacagcaacaaccaccgccagggatgttaatgagtcaccacaattcctacaatcgaaaccctaacgccgccgccgctgttttaatgggtcacaacacctccacatctcaagctatgcatcaaagattaccttttggtggttctatgtcaccgcatcagcctcaacaacatcagtatcatcatcctcagcctcagcaacagatagatcagaagactcttgaatctcttggatttcctacttcgcctcttccttctgcttctaattcttacggtggtggaaatgaaggaggtggtggtggtgatagcgccggagctaatgctaactcttccgatccacctgctaaacggaacagaggacgtcctcctggctccggtaagaagcagctcgatgctttaggaggaacaggaggagttgggttcacgcctcatgtcattgaggttaaaacaggagaggacatagctacgaagatattggcgtttacgaaccaagggccacgcgcaatctgtattctctcagctacaggagctgtaactaatgtgatgcttcgtcaagctaacaatagcaatcctactggaactgttaagtatgagggccgatttgaaatcatttctctgtcaggttctttcttgaattctgagagtaatggtactgtgaccaaaactggtaacttgagtgtgtcgctggctggacacgaaggccggattgtgggtggatgtgttgatggaatgctagtagctggatcacaagtccaggtcattgtgggaagctttgtaccagatggaaggaagcagaaacaaagtgcggggcgtgctcagaatactccggagccagcttcagcaccagccaatatgttgagctttggtggtgttggtggaccgggaagccctcgatctcaaggacaacaacactcgagcgagtcatcagaggaaaacgaaagtaattctccgttgcaccgtagaagcaacaacaacaacagcaacaatcatgggatatttggaaactctacacctcaaccgcttcaccaaattcctatgcagatgtaccagaatctctggcctggcaacagtcctcaataaacagatggttcatgggtcaagatttgaccgggtttgcttctctgttccttttgacacatctctccatcagatttatctctataaagtagattgagctctcttactctctcatcttcttctcctttactatttctcttaaatttagctttggttttagataaatagagagagagagacatgttaagtaggtttcaaattcaatcttgtttagtttgtttcttagtagtttcttttgattgtgatgatcataaagacttgttctttttctcctatattcaacgaattatccactttaa

SEQ ID NO: 720 - protein, 386 aa, Arabidopsis thaliana
  G1068
MDSREIHHQQQQQQQQQQQQQQQQQHLQQQQQPPPGMLMSHHNSYNRNPNAAAAVLMGHNTSTSQAMHQRLPFGGSMSPHQPQQHQYHHPQPQQQIDQKTLESLGFPTSPLPSASNSYGGGNEGGGGGDSAGANANSSDPPAKRNRGRPPGSGKKQLDALGGTGGVGFTPHVIEVKTGEDIATKILAFTNQGPRAICILSATGAVTNVMLRQANNSNPTGTVKYEGRFEIISLSGSFLNSESNGTVTKTGNLSVSLAGHEGRIVGGCVDGMLVAGSQVQVIVGSFVPDGRKQKQSAGRAQNTPEPASAPANMLSFGGVGGPGSPRSQGQQHSSESSEENESNSPLHRRSNNNNSNNHGIFGNSTPQPLHQIPMQMYQNLWPGNSPQ

SEQ ID NO: 721 - DNA, 1116 bp, Arabidopsis thaliana
  G1069
ttggaaccctagaggcctttcaagcaaatcatcagggtaacaatttcttgatctttctttttagcgaatttccagtttttggtcaatcatggcaaacccttggtggacgaaccagagtggtttagcgggcatggtggaccattcggtctcctcaggccatcaccaaaaccatcaccaccaaagtcttcttaccaaaggagatcttggaatagccatgaatcagagccaagacaacgaccaagacgaagaagatgatcctagagaaggagccgttgaggtggtcaaccgtagaccaagaggtagaccaccaggatccaaaaacaaacccaaagctccaatctttgtgacaagagacagccccaacgcactccgtagccatgtcttggagatctccgacggcagtgacgtcgccgacacaatcgctcacttctcaagacgcaggcaacgcggcgtttgcgttctcagcgggacaggctcagtcgctaacgtcaccctccgccaagccgccgcaccaggaggtgtggtctctctccaaggcaggtttgaaatcttatctttaaccggtgctttcctccctggaccttccccacccgggtcaaccggtttaacggtttacttagccggggtccagggtcaggtcgttggaggtagcgttgtaggcccactcttagccatagggtcggtcatggtgattgctgctactttctctaacgctacttatgagagattgcccatggaagaagaggaagacggtggcggctcaagacagattcacggaggcggtgactcaccgcccagaatcggtagtaacctgcctgatctatcagggatggccgggccaggctacaatatgccgccgcatctgattccaaatggggctggtcagctagggcacgaaccatatacatgggtccacgcaagaccaccttactgactcagtgagccatttctatatataatggtctatataaataaatatatagatgaatataagcaagcaatttgaggtagtctattacaaagcttttgctctggttggaaaaataaataagtatcaaagctttgtttgttcttaatggaaatatagagcttgggaaggtagaaagagacgacatt

SEQ ID NO: 722 - protein, 281 aa, Arabidopsis thaliana
  G1069
MANPWWTNQSGLAGMVDHSVSSGHHQNHHHQSLLTKGDLGIAMNQSQDNDQDEEDDPREGAVEVVNRRPRGRPPGSKNKPKAPIFVTRDSPNALRSHVLEISDGSDVADTIAHFSRRRQRGVCVLSGTGSVANVTLRQAAAPGGVVSLQGRFEILSLTGAFLPGPSPPGSTGLTVYLAGVQGQVVGGSVVGPLLAIGSVMVIAATFSNATYERLPMEEEEDGGGSRQIHGGGDSPPRIGSNLPDLSGMAGPGYNMPPHLIPNGAGQLGHEPYTWVHARPPY

SEQ ID NO: 723 - DNA, 974 bp, Arabidopsis thaliana
  G1073
ccccccgacctgcctctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggtt

SEQ ID NO: 724 - protein, 270 aa, Arabidopsis thaliana
  G1073
MELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 725 - DNA, 1084 bp, Arabidopsis thaliana
  G1075
tttgtgtttggtgctggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattggctagctcataagaattgtttaatttggttattgtcatcaaatttgcccacatataaagcttctagcaaat

SEQ ID NO: 726 - protein, 285 aa, Arabidopsis thaliana
  G1075
MAGLDLGTTSRYVHNVDGGGGGQFTTDNHHEDDGGAGGNHHHHHHNHNHHQGLDLIASNDNSGLGGGGGGGSGDLVMRRPRGRPAGSKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDEHEEHLQSGGGGGGGNMYSEATGGGGGLPFFNLPMSMPQIGVESWQGNHAGAGRAPF

SEQ ID NO: 727 - DNA, 1342 bp, Arabidopsis thaliana
  G1076
attttagtcttcctataacttcttctcaatcctctctcatatcttttttcttagtttaaatttcaataaaatagaaaaaaacatatacaaatctacagagaagagaagctttattttaatcttgtgtgtgtgtgtgtgttttatataatttttattttttttcaaattaaaatctcttctttgcttttgatgtgggcatggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctgatgtgtatatattgataatcattatatatataccggcggagaagcttttccggcgaagaatttgcgagagtgaagaaaggttagaaaagcttttaatggactaatgaatttcaaattatcatcgtgatttcggacattgtcttgttcatcatgttaagcttaggtttattttttgtcgtttgtagaattttatgtttgaatccttttttttttctgtgaaactctattgtgttcgtctgcgaaggaaaaaaaaattctcaaaaaaaa

SEQ ID NO: 728 - protein, 292 aa, Arabidopsis thaliana
  G1076
MAGLDLGTAFRYVNHQLHRPDLHLHHNSSSDDVTPGAGMGHFTVDDEDNNNNHQGLDLASGGGSGSSGGGGGHGGGGDVVGRRPRGRPPGSKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEEDEQQQQLGGGSNGGGNLFPEVAAGGGGGLPFFNLPMNMQPNVQLPVEGWPGNSGGRGPF

SEQ ID NO: 729 - DNA, 803 bp, Arabidopsis thaliana
  G1087
actttctccggcgtcttaggctccatctcctcaactactttaccagaaccagacttcttccgatatatcccagatctttcctcttcctcttcttcttcatcatcctcttcattaaactgaaaatgactactctgattctcataaccattcctaacctctctatcatctaaattaggtccaggcatattctccaccatgaaaaaataatcccaagccatactatttgccggagaagcactcacaatctccggcgttgttttctccaatctcttcctcccattactcttcccaacattctccggcgttctcggttcctcctcctcctgagcagtgtctctaccactacccttaacttcctcttcctcctcttcatcttcttcctcttcctcaatcgccataccatctaaagtctgaacctttcgacctctaaccgccatagaaggcaaactaatcgcacgtttaatcggagaaggagagaatttaggcaaaggaggaggcggaggaggaagattctcaataggcggtggaggaggtggctgaggagaagccggatctacattgttacgactctgtttctcgtaatgttgttgatctaacaacacatcgtctaaagctttttgatcagattcgccatggccatagtcacttaaagcagcaccagtgtttttcaaagcaatagcgtaagcgaaatgaccggcggcgaatgctttgcttgcggaaactgcttctttgattacgtttcgtcgttctttgcatctagctactgcttcttcgttatcaaccctagattgagcacaacccat

SEQ ID NO: 730 - protein, 268 aa, Arabidopsis thaliana
  misc_feature (268)..(268): Xaa can be any naturally occurring amino acid
  G1087
MGCAQSRVDNEEAVARCKERRNVIKEAVSASKAFAAGHFAYAIALKNTGAALSDYGHGESDQKALDDVLLDQQHYEKQSRNNVDPASPQPPPPPPIENLPPPPPPLPKFSPSPIKRAISLPSMAVRGRKVQTLDGMAIEEEEEDEEEEEEVKGSGRDTAQEEEEPRTPENVGKSNGRKRLEKTTPEIVSASPANSMAWDYFFMVENMPGPNLDDREVRNGYENQSSHFQFNEEDDEEEEEEERSGIYRKKSGSGKVVEEMEPKTPEKX

SEQ ID NO: 731 - DNA, 2663 bp, Arabidopsis thaliana
  G1089
aagtaagagagcttcttaaggaagaagaagatgggttgtgctcaatcaaagatcgagaacgaagaagcagttactcgttgcaaagaacgaaaacaattgatgaaagacgccgtcactgctcgtaacgctttcgccgccgctcactcagcttacgctatggctcttaaaaacaccggagctgctctttccgattactctcacggcgagtttttagtctctaatcactcgtcttcctccgcagctgcagcaatcgcttctacttcttctcttcccactgctatatctcctcctcttccttcttccaccgctccggtttctaattcaaccgcttcttcttcctccgctgcggttcctcagccgattcctgatactcttcctcctcctcctcctccaccaccgcttcctcttcaacgtgctgctactatgccggagatgaacggtagatccggtggtggtcatgctggtagtggactcaacggaattgaagaagatggagccctagataacgatgatgatgacgatgatgatgatgatgactctgaaatggagaatcgtgatcgtttgattaggaaatcgagaagccgtggaggtagtactagaggaaataggacgacgattgaagatcatcatcttcaggaggagaaagctccgccacctccccctttggcgaattcgcggccaattccgccgccacgtcagcatcagcatcaacatcagcaacagcaacaacaacctttctacgattacttcttccctaatgttgagaatatgcctggaactactttagaagatactcctccacaaccacaaccacaaccaacaaggcctgtgcctcctcaaccacattcaccagtcgttactgaggatgacgaagatgaggaggaggaagaggaggaagaggaggaggaagaggagacggtgattgaacggaaaccactggtggaggaaagaccgaagagagtagaggaagtgacgattgaattggaaaaagttactaatttgagagggatgaagaagagtaaagggatagggattcccggagagaggagaggaatgcgaatgccggtgactgcgacgcatttggcgaatgtattcattgagcttgatgataatttcttgaaagcttctgaaagtgctcatgatgtttctaagatgcttgaagctactaggctccattaccattctaattttgcagataaccgaggacatattgatcactctgctagagtgatgcgtgtaattacatggaatagatcatttagaggaataccaaatgctgatgatgggaaagatgatgttgatttggaagagaatgaaactcatgctactgttcttgacaaattgctagcatgggaaaagaagctctatgacgaagtcaaggctggcgaactcatgaaaatcgagtaccagaaaaaggttgctcatttaaatcgggtgaagaaacgaggtggccactcggattcattagagagagctaaagcagcagtaagtcatttgcatacaagatatatagttgatatgcaatccatggactccacagtttcagaaatcaatcgtcttagggatgaacaactatacctaaagctcgttcaccttgttgaggcgatggggaagatgtgggaaatgatgcaaatacatcatcaaagacaagctgagatctcaaaggtgttgagatctctagatgtttcacaagcggtgaaagaaacaaatgatcatcatcacgaacgcaccatccagctcttggcagtggttcaagaatggcacacgcagttttgcaggatgatagatcatcagaaagaatacataaaagcacttggcggatggctaaagctaaatctcatccctatcgaaagcacactcaaggagaaagtatcttcgcctcctcgagttcccaatcccgcaatccaaaaactcctccacgcttggtatgaccgtttagacaaaatccccgacgaaatggctaaaagtgccataatcaatttcgcagcggttgtaagcacgataatgcagcagcaagaagacgagataagtctcagaaacaaatgcgaagagacaagaaaagaattgggaagaaaaattagacagtttgaggattggtaccacaaatacatccagaagagaggaccggaggggatgaatccggatgaagcggataacgatcataatgatgaggtcgctgtgaggcaattcaatgtagaacaaattaagaagaggttggaagaagaagaagaagcttaccatagacaaagccatcaagttagagagaagtcactggctagtcttcgaactcgcctccccgagctttttcaggcaatgtccgaggttgcgtattcatgttcggatatgtatagagctataacgtatgcgagtaagcggcaaagccaaagcgaacggcatcagaaacctagccagggacagagttcgtaagaactaatgtaagatcagagtaatgtcttcttcttctttgatcttgaatatttaagcacacacatacatacaacgtatagctaaatctttatcattgctttcttatattaaggttttggcttttgtaagaaggtttcttacatatgagattcatatagtgtttgattcttaaggaactgttctgttgagtaataagaaagttgtgtattgaaatagagttgcatttgttaattttg

SEQ ID NO: 732 - protein, 798 aa, Arabidopsis thaliana
  G1089
MGCAQSKIENEEAVTRCKERKQLMKDAVTARNAFAAAHSAYAMALKNTGAALSDYSHGEFLVSNHSSSSAAAAIASTSSLPTAISPPLPSSTAPVSNSTASSSSAAVPQPIPDTLPPPPPPPPLPLQRAATMPEMNGRSGGGHAGSGLNGIEEDGALDNDDDDDDDDDDSEMENRDRLIRKSRSRGGSTRGNRTTIEDHHLQEEKAPPPPPLANSRPIPPPRQHQHQHQQQQQQPFYDYFFPNVENMPGTTLEDTPPQPQPQPTRPVPPQPHSPVVTEDDEDEEEEEEEEEEEEETVIERKPLVEERPKRVEEVTIELEKVTNLRGMKKSKGIGIPGERRGMRMPVTATHLANVFIELDDNFLKASESAHDVSKMLEATRLHYHSNFADNRGHIDHSARVMRVITWNRSFRGIPNADDGKDDVDLEENETHATVLDKLLAWEKKLYDEVKAGELMKIEYQKKVAHLNRVKKRGGHSDSLERAKAAVSHLHTRYIVDMQSMDSTVSEINRLRDEQLYLKLVHLVEAMGKMWEMMQIHHQRQAEISKVLRSLDVSQAVKETNDHHHERTIQLLAVVQEWHTQFCRMIDHQKEYIKALGGWLKLNLIPIESTLKEKVSSPPRVPNPAIQKLLHAWYDRLDKIPDEMAKSAIINFAAVVSTIMQQQEDEISLRNKCEETRKELGRKIRQFEDWYHKYIQKRGPEGMNPDEADNDHNDEVAVRQFNVEQIKKRLEEEEEAYHRQSHQVREKSLASLRTRLPELFQAMSEVAYSCSDMYRAITYASKRQSQSERHQKPSQGQSS

SEQ ID NO: 733 - DNA, 838 bp, Arabidopsis thaliana
  G1090
aaactaattcgcacagttctatatacactcacaaacacacacacacacaatatagtgctactaaaataaccttgtattaattatggaaaacacttacgttggccaacgagattaccgcttcaacgttaaccagttgtcctacagaggcattcgtcggaggaaatggggcaaatgggtatcggagatccgagaacccggtaagaaaacaaggatttggcttggaagctacgagacggccgagatggctgcagcggcctacgatgctgcggctcttcacctccgaggacgtgggaccaatctcaactttccggaactcgtcgacagttttcctcggccggaaagctctagttcggagcacattcaagcggctgcacaagatgcagcacttatgtttaaaccaggtaggttgagtgaaccagctctcgagtctggtcaaggactttctcgagtaggattgtctccggatcagattcaagcgattaatgagtctccattagactcgccgaggatggggtggatgcaggatttggaagttgctgactacgaagaattatacggacaattttttggtcagcacgatagggatgagttttttgaaatgcagcaatttcagtccatatggaattctaataattgatatacgttcgcttaattgcttaaccatttgattttttttttaataatgtcatatcatcaaccaaggtttttcgattatattcagtaaagtataataaattttcgacccttactgtttttcttgggttcaatttgtaatctcttaacaatgatgatgtcataaataccaatatgattaattcaaattttcaaaaaaaaaaaa

SEQ ID NO: 734 - protein, 184 aa, Arabidopsis thaliana
  G1090
MENTYVGQRDYRFNVNQLSYRGIRRRKWGKWVSEIREPGKKTRIWLGSYETAEMAAAAYDAAALHLRGRGTNLNFPELVDSFPRPESSSSEHIQAAAQDAALMFKPGRLSEPALESGQGLSRVGLSPDQIQAINESPLDSPRMGWMQDLEVADYEELYGQFFGQHDRDEFFEMQQFQSIWNSNN

SEQ ID NO: 735 - DNA, 1279 bp, Arabidopsis thaliana
  G1091
ggtttttttttttggttctctgatctgaaacttgggtagaagaaaaacatggaggaagttgaagctgctaacagatcagctatagaaagctgtcatggagtgttaaatctcttgtcacaacgaaccagtgatcccaaatccttaacggttgaaacaggagaagtagtttccaagttcaaaagagtagcttctctgttaactagagggttaggccatggaaagtttaggagtaccaacaagtttaggtcatcttttcctcaacacatcttcttagagagtcctatttgctgcggtaatgatctaagtggtgattacactcaagttcttgcaccagagccacttcagatggttccagcttctgctgtttataatgaaatggagccaaaacaccaattgggtcatccttcattaatgcttagtcacaaaatgtgtgttgacaagtcgtttctggagttaaagccacctccttttcgtgctccttatcagttaatccacaaccaccagcagatagcttactccaggagtaatagcggtgtaaaccttaagtttgatggatctggtagtagttgctatactccgagtgtatcaaacggatcaagatcatttgtgtcatctcttagcatggatgctagtgtaacagactacgataggaactcgttccatttgaccggattgtcccgtgggtctgaccaacagcatacccggaagatgtgctctggtagtttgaaatgcggaagtcgaagcaaatgtcactgttccaagaaaaggaaactgagggtaaaacgatcaatcaaggtgcctgcaatcagtaacaagattgcagacattcctccagatgagtattcttggaggaagtatggacagaaaccgataaagggttcaccgcatccacggggatactataaatgcagcagtgtgagaggttgtccagcaaggaagcatgtggagcgatgtattgatgaaacttcaatgttaattgtaacttacgaaggcgagcataaccattcaagaatattgtcttcacaatcagctcacacttgatgatacagagtcaatatgtatgtccttttggcgtctactcttggatttgaagaaagaatgaatttgattcaagaaaccggtctttgtagctctgatttgcaattgtatatttccactctgacagaagttataagagcacttgtgaactcggattatgtggcagaggcagtaccaagaaacatcaacaatttggtttcaactgagctttttcttcaaaaaaaaaaaaaaaaaaaaaaaa

SEQ ID NO: 736 - protein, 330 aa, Arabidopsis thaliana
  G1091
MEEVEAANRSAIESCHGVLNLLSQRTSDPKSLTVETGEVVSKFKRVASLLTRGLGHGKFRSTNKFRSSFPQHIFLESPICCGNDLSGDYTQVLAPEPLQMVPASAVYNEMEPKHQLGHPSLMLSHKMCVDKSFLELKPPPFRAPYQLIHNHQQIAYSRSNSGVNLKFDGSGSSCYTPSVSNGSRSFVSSLSMDASVTDYDRNSFHLTGLSRGSDQQHTRKMCSGSLKCGSRSKCHCSKKRKLRVKRSIKVPAISNKIADIPPDEYSWRKYGQKPIKGSPHPRGYYKCSSVRGCPARKHVERCIDETSMLIVTYEGEHNHSRILSSQSAHT

SEQ ID NO: 737 - DNA, 1556 bp, Arabidopsis thaliana
  G1128
atggaggagagagaaggaactaacatcaacaacatcccaaccagttttggtctgaaacaacatgaaactcctcttcctcctcctggttacccaccacggtctgaaaaccctaatctttttccggtgggtcaatccagcacttcctccgccgccgccgcggtgaaaccttctgagaatgttgctcctccttttagcttaacaatgccggtggagaattcttcttctgagttgaagaagaagagagggagaccaagaaagtataaccctgacggctcactcgctgtgactctctctcctatgcctatctcatcctccgttccgttgacgtcggagtttggttctcggaaacgaggaagaggtcgaggaagaggcagaggaagaggacgaggacgtggacaaggacaaggaagcagagagcccaataacaacaacaacgacaacaattggctcaagaatcctcagatgttcgaatttaacaacaacactcctacttctggtggaggaggacctgctgaaattgtcagtccaagttttacacctcatgtgctcacagtaaatgccggtgaggatgtgacaatgaagataatgacattctctcaacaaggctcgcgtgctatttgtattctttcagcgaacggtcccatatccaatgttacacttcgtcaatctatgacatctggtggtactctcacttatgagggtcattttgagattctttctttgacgggttcgtttataccaagcgagagtggaggaacccgaagcagagctggtgggatgagtgtctctcttgcaggacaagatggtcgtgtctttggtggtggacttgctggtctctttattgccgctggtcctgttcaggtaatggtagggagttttatagcgggtcaggaggaatcgcagcagcagcagcagcagataaagaagcaaagaagggaaagactcgggatcccgacaacaacacaagcttctaatatctcattcggtggctcagcggaagatcctaaggctagatacgggctcaacaagcctgttgttattcagccaccaccggtgtctgcaccacctgtgtccttttcgcatgaaccaagtactaacaccgtccatggttactatgcaaataacacagctaaccatatcaaggatctcttctcttccctccctggagaagatagggaagaagatgaggatgatttagaaggtgaagatgatgaagaattcggaggccatagcgaatctgacaccgaggttccaagctgatgatcgatggaaagaatccgacatatatgtgttatgaatcttgagttgttttatttcggtgtcttcagatttttttagagcgtaatggtattttttttctttcagattgttagttgttaaagtcttaaacagagatatttcactaaaagttagggtttactagaggatgtaatctttagggttctttgacttgtgtctttcttttaatcctcagatggttgttgtaggcttgtagccaatcttagtgtgtgttcaaactctctccttcaatcaaactccccaatgacttcattttg

SEQ ID NO: 738 - protein, 419 aa, Arabidopsis thaliana
  G1128
MEEREGTNINNIPTSFGLKQHETPLPPPGYPPRSENPNLFPVGQSSTSSAAAAVKPSENVAPPFSLTMPVENSSSELKKKRGRPRKYNPDGSLAVTLSPMPISSSVPLTSEFGSRKRGRGRGRGRGRGRGRGQGQGSREPNNNNNDNNWLKNPQMFEFNNNTPTSGGGGPAEIVSPSFTPHVLTVNAGEDVTMKIMTFSQQGSRAICILSANGPISNVTLRQSMTSGGTLTYEGHFEILSLTGSFIPSESGGTRSRAGGMSVSLAGQDGRVFGGGLAGLFIAAGPVQVMVGSFIAGQEESQQQQQQIKKQRRERLGIPTTTQASNISFGGSAEDPKARYGLNKPVVIQPPPVSAPPVSFSHEPSTNTVHGYYANNTANHIKDLFSSLPGEDREEDEDDLEGEDDEEFGGHSESDTEVPS

SEQ ID NO: 739 - DNA, 1322 bp, Arabidopsis thaliana
  G1133
ttcaagaaagaatcaccaagtgttgcgttccacacatttgagcaacagcttccacaatcgtattgtattcctgtaaagttcccttggcttaaactgcaagagcatgcctcttgataccaaacagcagaaatggttgccattaggcttaaatcctcaagcttgtgtccaggacaaggcgactgagtatttccgtcctggaattccttttccggaactcggtaaagtttatgcagctgagcatcagtttcgctatttgcagccaccgttccaagccttattgtctagatatgatcagcagtcttgtggaaaacaagtttcatgtttgaatgggcgatctagcaacggtgctgctccagagggggcactcaagtcttctcggaaaagatttatagtattcgatcagtcgggagagcagactcgtttgttacaatgtggatttcctctgcggtttccttcttctatggatgcagagcgagggaacattctcggtgccctacacccagagaaagggtttagtaaagatcatgccattcaagaaaagatattgcaacatgaagatcatgaaaatggcgaagaagactcggaaatgcacgaagacactgaggaaatcaacgcgttactgtattctgatgatgacgataatgatgattgggaaagtgatgatgaagtaatgagcactggtcactctccattcacagttgaacaacaagcgtgcaacataacaacagaagagctggatgaaactgaaagcactgttgatggtccacttcttaaaagacagaaactactggaccattcgtacagagactcatcaccatcccttgtgggcaccactaaagtcaaaggcttatcagatgaaaaccttcctgaatcaaacatttcaagcaaacaagaaacgggttctggtttgagcgacgagcagtcaagaaaagacaagattcacaccgctctgagaatcctggagagtgtagttccaggggcaaagggaaaagaagctcttttactactagacgaagccattgattacctcaagttgctgaagcaaagcttaaactcatcaaagggtttgaataaccattggtgaaaaacctacaaccccttttgtcctattgataaggcatgtttggttggttaaagagaagacatgggacaaaagataatcaatgaggtaaaggactgatgaagaagattctctcaaattcattaacgtgggtttgaaacaattagaacacgcctggtgaccctagtgggaccgtatccactgttcatctagctggatcaatagtggtttacttttggatttggcatgctctctcaaaaaa

SEQ ID NO: 740 - protein, 326 aa, Arabidopsis thaliana
  G1133
MPLDTKQQKWLPLGLNPQACVQDKATEYFRPGIPFPELGKVYAAEHQFRYLQPPFQALLSRYDQQSCGKQVSCLNGRSSNGAAPEGALKSSRKRFIVFDQSGEQTRLLQCGFPLRFPSSMDAERGNILGALHPEKGFSKDHAIQEKILQHEDHENGEEDSEMHEDTEEINALLYSDDDDNDDWESDDEVMSTGHSPFTVEQQACNITTEELDETESTVDGPLLKRQKLLDHSYRDSSPSLVGTTKVKGLSDENLPESNISSKQETGSGLSDEQSRKDKIHTALRILESVVPGAKGKEALLLLDEAIDYLKLLKQSLNSSKGLNNHW

SEQ ID NO: 741 - DNA, 1064 bp, Arabidopsis thaliana
  G1134
taaagaaagagaaaaaaagctttcgtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgttgaaaagtatattatttgataaatggatgtaggtgtaatataaaatttttgtacaataatgaagaaagttaaaaagaattaatgaaaacatatattctttatgatataaaaaaaaaaa

SEQ ID NO: 742 - protein, 262 aa, Arabidopsis thaliana
  G1134
MQPTSVGSSGGGDDGGGRGGGGGLSRSGLSRIRSAPATWLEALLEEDEEESLKPNLGLTDLLTGNSNDLPTSRGSFEFPIPVEQGLYQQGGFHRQNSTPADFLSGSDGFIQSFGIQANYDYLSGNIDVSPGSKRSREMEALFSSPEFTSQMKGEQSSGQVPTGVSSMSDMNMENLMEDSVAFRVRAKRGCATHPRSIAERVRRTRISDRIRKLQELVPNMDKQTNTADMLEEAVEYVKVLQRQIQELTEEQKRCTCIPKEEQ

SEQ ID NO: 743 - DNA, 2220 bp, Arabidopsis thaliana
  G1135
tcgacgcatgtcctgcacttaacctaccaaaaacaatctctcctaataagagagaagaaagaaaaaaaattataactcagatattttcacacatatataaataaagttttgtggtgacgttattttacacgaaaaagctcaaccttgtatggaagtaattagctgctacctattactgattattcttcttcttcttctttcttccaatttcttgtcttcttttggtacaatttcttggctttctcttgtcaagttttcaccagtcacaagatttttgaggagccttgttttttccgagaatcttgttaatcatattgagagattaatggagagtaatatgcaaaacttgttggagaaattgaggcctcttgtgggtgcaagggcttgggattattgtgttctttggagactaaacgaagaccaaaggtttgtgaagtggatgggatgttgttgtggtgggacagaactcatagcggagaatggaacagaagagtttagctacggaggttgtagggatgttatgtttcatcatcctcggaccaaatcttgtgaatttctttcccatcttccagcttccatacctcttgattccgggatatatgcggagactcttctgactaaccagactggttggttgagtgagagctcagaaccaagttttatgcaggaaacaatctgtactagggttttgattcctataccgggaggactagtggagctctttgcgaccagacatgtcgctgaagatcagaacgtggtggattttgtaatgggacattgcaacatgttgatggacgattctgtaacgataaacatgatggtagcagacgaggtcgaatcgaagccgtacgggatgttatccggtgacatccagcaaaagggttccaaagaagaagatatgatgaatctcccttcgtcttacgatatctctgctgatcagatccgactcaatttcttgcctcagatgagtgattacgagacacaacacttgaagatgaagagtgattatcatcatcaagccttggggtatctcccagagaatggtaacaaggaaatgatgggtatgaacccatttaacacggtggaagaagatgggattccagtgattggagagcctagcttgcttgtgaatgaacagcaagttgttaacgataaggatatgaatgagaacggtagggtggattcagggtcggattgcagcgaccagattgatgatgaagatgatccaaagtacaagaagaagtcaggaaaaggatctcaagccaagaacctgatggctgagagacggaggaggaagaagctaaacgataggctttatgctctccggtcgcttgttcccaggataaccaagttggacagggcgtcgattcttggcgatgcaatcaactacgttaaggagttgcagaatgaggcaaaggagcttcaagacgagcttgaagagaactcagagactgaggatggatctaataggccacaaggagggatgagcctgaacgggacagtggtcactgggtttcacccggggctttcatgtaactccaacgttcctagcgtgaagcaagatgttgatcttgagaattccaatgataaaggacaagaaatggagccacaggtggacgtggctcagttagatggcagagagtttttcgtaaaggtgatttgcgaatacaaaccaggaggcttcacaaggctaatggaggcactggattctcttggactagaagtcacaaatgctaacacgactcgctacctcagcctggtctccaatgtcttcaaagtcgagaaaaatgataacgagatggtccaagctgaacacgtaaggaactcgttgctggaaataacccggaacacatctagaggatggcaagatgatcagatggctacaggctctatgcaaaacgaaaagaacgaagttgattatcaacactatgatgatcaccagcatcacaatggtcatcatcacccatttgatcaccagatgaatcagagcgctcatcatcatcaccaccaccaacacatcaaccattaccacaaccaataaggaccaattccccaaagctataaagatgtctgctttacaagcaaaagaaacattctgcatcaacaaactttgaagatcttttcatttcaagatatataaggataaaaggaatgtcagttcgagaacagttcctgtatccaataccaggaataaaccaaagcgaaacaactttacttaaa

SEQ ID NO: 744 - protein, 630 aa, Arabidopsis thaliana
  G1135
MEVISCYLLLIILLLLLSSNFLSSFGTISWLSLVKFSPVTRFLRSLVFSENLVNHIERLMESNMQNLLEKLRPLVGARAWDYCVLWRLNEDQRFVKWMGCCCGGTELIAENGTEEFSYGGCRDVMFHHPRTKSCEFLSHLPASIPLDSGIYAETLLTNQTGWLSESSEPSFMQETICTRVLIPIPGGLVELFATRHVAEDQNVVDFVMGHCNMLMDDSVTINMMVADEVESKPYGMLSGDIQQKGSKEEDMMNLPSSYDISADQIRLNFLPQMSDYETQHLKMKSDYHHQALGYLPENGNKEMMGMNPFNTVEEDGIPVIGEPSLLVNEQQVVNDKDMNENGRVDSGSDCSDQIDDEDDPKYKKKSGKGSQAKNLMAERRRRKKLNDRLYALRSLVPRITKLDRASILGDAINYVKELQNEAKELQDELEENSETEDGSNRPQGGMSLNGTVVTGFHPGLSCNSNVPSVKQDVDLENSNDKGQEMEPQVDVAQLDGREFFVKVICEYKPGGFTRLMEALDSLGLEVTNANTTRYLSLVSNVFKVEKNDNEMVQAEHVRNSLLEITRNTSRGWQDDQMATGSMQNEKNEVDYQHYDDHQHHNGHHHPFDHQMNQSAHHHHHHQHINHYHNQ

SEQ ID NO: 745 - DNA, 2215 bp, Arabidopsis thaliana
  G1136
caatcactaaacgccatttgcttagctttttccctcttttgatttttcctccctacacgtcacctctctcttcttctcaccggaaaaaagtcttcacctttcaccggaaaatatcaccttttcaaccggcgtatgttcacatgaacggcacaacatcatcaatcaacttcttgacctccgacgatgacgcgtcggcggcggctatggaagctttcattggaacaaaccaccactcatctctctttcctccaccaccacaacaaccacctcagcctcagttcaacgaagatactcttcaacaacgtctccaagctttaatagaatccgccggagaaaactggacttacgctatcttctggcagatctcacacgacttcgattcatccaccggagataacacagtgatcctcggctggggagatggttactacaaaggagaggaagataaagagaagaagaagaacaacaccaacacggcggagcaagagcatcggaaaagagtaatacgtgagcttaactcgttaatctccggcggaattggggtttccgatgaatcaaacgatgaagaagtaacagatactgaatggttcttcttagtttcgatgactcaaagcttcgttaacggtgttggtctccccggagaatctttcttaaactctcgtgtgatttggttatccgggtctggtgctttaaccgggtcgggttgtgaaagagcgggtcaaggtcagatttacgggttaaagacgatggtgtgtatcgcgactcaaaacggcgtcgttgagcttggttcgtcggaggttataagtcaaagctcagatctgatgcataaagttaacaacttgtttaatttcaacaacggtggtggaaacaatggtgttgaagcttcttcgtggggttttaatctgaatccagatcaaggagagaatgatccagctttgtggattagtgaaccgacgaacaccggaatcgaatctccggcgagggttaataatggtaataactcgaattctaattctaagtctgattctcatcaaatttctaagcttgagaagaatgatattagctctgtagagaatcagaatcgtcaaagttcgtgtcttgtcgagaaagatttgacctttcaaggtgggttgttgaaatctaatgagactttgagtttctgtggtaatgagagtagtaagaagagaacttcggtatctaaagggagtaataatgatgaagggatgctttcgtttagtactgtggttagatcagctgcgaatgattcggatcattctgatcttgaagcatctgttgttaaggaagcgattgttgttgagccaccggagaagaagccgaggaaacgggggaggaaaccggcgaatgggagagaagagccgttgaatcatgttgaagcagagaggcagagaagagagaagttaaaccagagattctactctttgagagctgttgttcctaacgtttcgaagatggataaagcttcgcttctcggagacgcgatttcgtatatcaatgagcttaagtcgaagctgcagcaagcggagtctgataaagaggagattcagaagaagctagatgggatgagtaaggaagggaataatgggaaaggttgcgggtcaagggcaaaagaacggaaaagttcgaatcaagattctacggcgagttctatagaaatggagattgatgttaagatcataggttgggatgtgatgatacgtgtacaatgcggcaagaaagatcatcccggtgctaggttcatggaagcacttaaggaattggatttggaagtgaatcatgcgagtttatccgttgtgaatgatttgatgattcaacaagctacggtgaagatggggagccaatttttcaatcatgaccagctcaaagttgctttgatgacgaaagtcggagaaaactattgaacaaagttggcatatcaaagaggggaaactagtgttttcatcgatgaaatgggatcgaatttagcgggtaatgtatggtcttttgtaaagtagtaagtactcattttgcatcactcgcttcatgttgttaaatgttgttgttcattaggagaacttgcttagttcttagcttagtgttatcataagccttaagtgagaaggaagttggagactagaagaccagagagagttagcgaaataataaaatctttggttgtacttgtatgtatatatatgtatggagtaagattaagtga

SEQ ID NO: 746 - protein, 592 aa, Arabidopsis thaliana
  G1136
MNGTTSSINFLTSDDDASAAAMEAFIGTNHHSSLFPPPPQQPPQPQFNEDTLQQRLQALIESAGENWTYAIFWQISHDFDSSTGDNTVILGWGDGYYKGEEDKEKKKNNTNTAEQEHRKRVIRELNSLISGGIGVSDESNDEEVTDTEWFFLVSMTQSFVNGVGLPGESFLNSRVIWLSGSGALTGSGCERAGQGQIYGLKTMVCIATQNGVVELGSSEVISQSSDLMHKVNNLFNFNNGGGNNGVEASSWGFNLNPDQGENDPALWISEPTNTGIESPARVNNGNNSNSNSKSDSHQISKLEKNDISSVENQNRQSSCLVEKDLTFQGGLLKSNETLSFCGNESSKKRTSVSKGSNNDEGMLSFSTVVRSAANDSDHSDLEASVVKEAIVVEPPEKKPRKRGRKPANGREEPLNHVEAERQRREKLNQRFYSLRAVVPNVSKMDKASLLGDAISYINELKSKLQQAESDKEEIQKKLDGMSKEGNNGKGCGSRAKERKSSNQDSTASSIEMEIDVKIIGWDVMIRVQCGKKDHPGARFMEALKELDLEVNHASLSVVNDLMIQQATVKMGSQFFNHDQLKVALMTKVGENY

SEQ ID NO: 747 - DNA, 1413 bp, Arabidopsis thaliana
  G1141
gtctttacaaaaagaaaagaaaaaagagacgctagaaagaacgcgaaagcttgcgaagaagatttgcttttgatcgacttaacacgaacaacaaacaacatctgcgtgataaagaagagatttttgcctaaataaagaagagattcgactctaatcctggagttatcattcacgatagattcttagattgcgactataaagaagaagatggctgtatatgaacaaaccggaaccgagcagccgaagaaaaggaaatctagggctcgagcaggtggtttaacggtggctgataggctaaagaagtggaaagagtacaacgagattgttgaagcttcggctgttaaagaaggagagaaaccgaaacgcaaagttcctgcgaaagggtcgaagaaaggttgtatgaagggtaaaggaggaccagataattctcactgtagttttagaggagttagacaaaggatttggggtaaatgggttgcagagattcgagaaccgaaaataggaactagactttggcttggtacttttcctaccgcggaaaaagctgcttccgcttatgatgaagcggctaccgctatgtacggttcattggctcgtcttaacttccctcagtctgttgggtctgagtttactagtacgtctagtcaatctgaggtgtgtacggttgaaaataaggcggttgtttgtggtgatgtttgtgtgaagcatgaagatactgattgtgaatctaatccatttagtcagattttagatgttagagaagagtcttgtggaaccaggccggacagttgcacggttggacatcaagatatgaattcttcgctgaattacgatttgctgttagagtttgagcagcagtattggggccaagttttgcaggagaaagagaaaccgaagcaggaagaagaggagatacagcaacagcaacaggaacagcaacagcaacagctgcaaccggatttgcttactgttgcagattacggttggccttggtctaatgatattgtaaatgatcagacttcttgggatcctaatgagtgctttgatattaatgaactccttggagatttgaatgaacctggtccccatcagagccaagaccaaaaccacgtaaattctggtagttatgatttgcatccgcttcatctcgagccacacgatggtcacgagttcaatggtttgagttctctggatatttgagagttctgaggcaatggtcctacaagactacaacataatctttggattgatcataggagaaacaagaaataggtgttaatgatctgattcacaatgaaaaaatatttaataactctatagtttttgttctttccttggatcatgaactgttgcttctcatctattgagttaatatagcgaatagcagagtttctctcataaaaaaaaaaaaaa

SEQ ID NO: 748 - protein, 330 aa, Arabidopsis thaliana
  G1141
MAVYEQTGTEQPKKRKSRARAGGLTVADRLKKWKEYNEIVEASAVKEGEKPKRKVPAKGSKKGCMKGKGGPDNSHCSFRGVRQRIWGKWVAEIREPKIGTRLWLGTFPTAEKAASAYDEAATAMYGSLARLNFPQSVGSEFTSTSSQSEVCTVENKAVVCGDVCVKHEDTDCESNPFSQILDVREESCGTRPDSCTVGHQDMNSSLNYDLLLEFEQQYWGQVLQEKEKPKQEEEEIQQQQQEQQQQQLQPDLLTVADYGWPWSNDIVNDQTSWDPNECFDINELLGDLNEPGPHQSQDQNHVNSGSYDLHPLHLEPHDGHEFNGLSSLDI

SEQ ID NO: 749 - DNA, 1357 bp, Arabidopsis thaliana
  G1145
gtgatttctctctgccatttccttcgatttgatttctgggttctcttcttctcgtctctcttctgcatgtttcgccactctaccttagaaaaaaggttactttcgcctccgatttaggctcgatttgatgaattcgtcgtcgtgtggctatttatcaaattgagcattagggtttctgatttgtgggttcagaattgtttttatctatctgtcttgttgttttttgtccgctacaaaagcctatggattctcagaggggtattgttgaacaagctaaatctcagtccttgaataggcaaagctctctttacagcttaacacttgatgaggttcaaaatcacttggggagttctggtaaagctctgggaagcatgaaccttgatgagcttttgaagagtgtctgttctgttgaagctaatcagccatcgtctatggctgtcaatggtggagcagctgctcaggagggtctttctcgccaggggagtttgactttgcctcgggatctcagcaaaaagactgttgatgaggtttggaaagacattcagcagaataagaatggaggtagtgctcatgagaggagggataagcagcctacacttggggaaatgacgcttgaagacctgttgttgaaagcaggagtggtcactgagactatccctggttcgaaccatgatggtcctgttggtggtggtagtgctggttcaggtgctggtttagggcaaaacattactcaagttggcccatggattcaatatcatcagctcccatcaatgccacagcctcaagcatttatgccctatccggtttcagatatgcaagcaatggtgtctcagtcttctttgatgggtggtttgtcagatacacaaactcctggaaggaagagggtagcttcaggagaagttgtagagaagactgtagagaggaggcagaagagaatgataaagaacagagagtctgctgctcgttcccgagctaggaaacaggcttacactcatgagctagagatcaaagtttcacggttagaagaagaaaacgaaagactcaggaagcaaaaggaggtggaaaaatcctcccaagtgtaccaccgcctgatcccaagcggcagctccgacggacaagctcggctcctttctgatctctaaactctttttgtctttttctttttttctcttctgtgtcggttcacttataaaaaagagaggaaaacagctttgtttctttgtacattccgtagactttcttgacttggagcaattctgttaactttaaaatattctcgagttattgtagtagcagactagcagcagtaatggttttcatgagtccgattgaaattcagagattgaacaggaaaaaa

SEQ ID NO: 750 - protein, 299 aa, Arabidopsis thaliana
  G1145
MDSQRGIVEQAKSQSLNRQSSLYSLTLDEVQNHLGSSGKALGSMNLDELLKSVCSVEANQPSSMAVNGGAAAQEGLSRQGSLTLPRDLSKKTVDEVWKDIQQNKNGGSAHERRDKQPTLGEMTLEDLLLKAGVVTETIPGSNHDGPVGGGSAGSGAGLGQNITQVGPWIQYHQLPSMPQPQAFMPYPVSDMQAMVSQSSLMGGLSDTQTPGRKRVASGEVVEKTVERRQKRMIKNRESAARSRARKQAYTHELEIKVSRLEEENERLRKQKEVEKSSQVYHRLIPSGSSDGQARLLSDL

SEQ ID NO: 751 - DNA, 2910 bp, Arabidopsis thaliana
  G1149
atgtcaaatcgtggtggtggtggtcacggcggcgctagtcgtggtcgaggaggtggacgaaggtctgaccagagacaagatcagtcttctggtcaagttgcttggccgggtttacaacaaagctacggtggtcgtggtggttctgtttccgccggtagaggtcgtggaaacgtcggaagaggtgaaaatactggagatctgacggcgacgcaagttccggttgcttctgctgtttctggcgggagaggtcgtggtaacatcggagatccgacgttttctgttgcgtcttcgtctaagacggtgtctgttgcttcttcatctaaagaggaaagtaagaatacggaggtttctgagaccatgtcgaaccttcagattacttcgacggagacgaaacctgaaatgacgtcacttcctccggcgtcatctaaagcggttacgtttccggtacggccaggacgtggtactttggggaagaaagtcatggttcgtgcgaatcatttccttgttcaagttgctgatcgtgatctctaccattacgatgtttcgatcaatcctgaggttatatcaaagacagtgaacagaaacgtgatgaaacttctggttaagaattataaagactctcacttgggagggaagtcaccagcgtatgatggaaggaaaagcctctatactgctggtccattaccttttgactcgaaagagtttgttgtgaatctggcggagaaaagagctgacggttcctctgggaaggacagaccgtttaaagttgctgtaaagaatgtgacaagcactgatctttatcagttgcaacagttccttgatcgtaagcaaagagaggctccatatgatactatccaagtgcttgatgttgttcttagggataagccctctaatgattatgtctctgttgggaggtcttttttccacactagtttgggaaaggacgcaagagatggtaggggtgagcttggagatggtattgagtactggagaggttatttccaaagtctaaggctgactcagatgggtttgtctctgaacattgacgtttcagcaagatcattttatgaaccgattgttgtcactgactttattagcaagtttctgaatataagggacttaaacaggccacttagagactcagatcgacttaaggtgaagaaagttttgaggacactgaaagttaagttgcttcactggaacggcacaaaaagtgccaaaattagtgggatttctagtctacccatcagggagctaaggttcactctggaggacaaatcagagaagacggttgttcaatattttgctgaaaaatataattatagagtgaaataccaggctctacctgctattcaaacagggagtgacacaagacccgtctacctaccaatggagctctgccaaattgacgaagggcaaagatacaccaaaaggctcaatgagaagcaagtgactgcattgctaaaagctacctgccaacgaccccctgatagagagaactcgatcaaaaacttggttgtgaaaaataattacaatgatgatctgagcaaggagtttgggatgtcagtgactacccaactagcctcgattgaagctcgtgtacttcccccaccgatgttgaagtaccatgacagtggtaaagagaaaatggtaaatccaaggctaggacagtggaacatgattgacaagaaaatggttaatggagcaaaagtcacttcttggacttgcgaatttaagcctcaacctgctattccgttcatctcttgtccccctgaacatattgaggaagctcttctcgatatccacaaaagggcacctggtctccaactgttgattgtaatattgcctgatgtgactggatcatatggaaaaataaaaaggatctgtgaaacagaattggggattgtctctcagtgttgccaacctagacaagttaataaactcaacaagcagtacatggaaaatgttgccttgaagatcaatgtcaagactgggggaaggaacactgttcttaatgatgctattagaagaaacatacctcttattactgatcgtccaaccatcatcatgggtgctgatgtgactcacccacagcctggagaggactcaagtccttctattgctgctgttgtggcctctatggactggcctgagataaacaaataccgaggattggtttctgctcaagctcatagggaagaaattattcaggacctgtataagctggttcaggatccacaacgtgggctagtccactctggtttgataagggaacatttcatagcattcaggagagctacaggccagatacctcaaaggatcatcttctatcgtgacggagtaagcgaagggcagtttagtcaggttctgctacatgagatgactgctatccgcaaggcttgtaactctctccaagagaattatgttcctcgtgttactttcgtgattgtccagaaacgtcaccacacacgtttgttccctgagcaacacgggaatcgtgatatgactgataagagtggcaatattcaaccaggtactgtcgtggacactaaaatctgtcaccctaatgaattcgacttctatttgaacagccatgctggtattcagggaacaagcaggccggcacattaccatgtacttctcgatgagaacggtttcaccgctgatcagttgcaaatgctcacaaacaacctctgctacacgtatgcgaggtgtacaaaatctgtgtcaattgtgccaccagcctactacgctcacttggctgcattccgtgcccgctactacatggagagtgagatgtctgatggaggttcgagcaggtccaggagctcaacaacaggtgtgggtcaagtcatttcgcagctcccagcaataaaagataacgtcaaggaggttatgttttattgctaa

SEQ ID NO: 752 - protein, 969 aa, Arabidopsis thaliana
  G1149
MSNRGGGGHGGASRGRGGGRRSDQRQDQSSGQVAWPGLQQSYGGRGGSVSAGRGRGNVGRGENTGDLTATQVPVASAVSGGRGRGNIGDPTFSVASSSKTVSVASSSKEESKNTEVSETMSNLQITSTETKPEMTSLPPASSKAVTFPVRPGRGTLGKKVMVRANHFLVQVADRDLYHYDVSINPEVISKTVNRNVMKLLVKNYKDSHLGGKSPAYDGRKSLYTAGPLPFDSKEFVVNLAEKRADGSSGKDRPFKVAVKNVTSTDLYQLQQFLDRKQREAPYDTIQVLDVVLRDKPSNDYVSVGRSFFHTSLGKDARDGRGELGDGIEYWRGYFQSLRLTQMGLSLNIDVSARSFYEPIVVTDFISKFLNIRDLNRPLRDSDRLKVKKVLRTLKVKLLHWNGTKSAKISGISSLPIRELRFTLEDKSEKTVVQYFAEKYNYRVKYQALPAIQTGSDTRPVYLPMELCQIDEGQRYTKRLNEKQVTALLKATCQRPPDRENSIKNLVVKNNYNDDLSKEFGMSVTTQLASIEARVLPPPMLKYHDSGKEKMVNPRLGQWNMIDKKMVNGAKVTSWTCEFKPQPAIPFISCPPEHIEEALLDIHKRAPGLQLLIVILPDVTGSYGKIKRICETELGIVSQCCQPRQVNKLNKQYMENVALKINVKTGGRNTVLNDAIRRNIPLITDRPTIIMGADVTHPQPGEDSSPSIAAVVASMDWPEINKYRGLVSAQAHREEIIQDLYKLVQDPQRGLVHSGLIREHFIAFRRATGQIPQRIIFYRDGVSEGQFSQVLLHEMTAIRKACNSLQENYVPRVTFVIVQKRHHTRLFPEQHGNRDMTDKSGNIQPGTVVDTKICHPNEFDFYLNSHAGIQGTSRPAHYHVLLDENGFTADQLQMLTNNLCYTYARCTKSVSIVPPAYYAHLAAFRARYYMESEMSDGGSSRSRSSTTGVGQVISQLPAIKDNVKEVMFYC

SEQ ID NO: 753 - DNA, 1239 bp, Arabidopsis thaliana
  G1181
ctcgatcttttaacccccattattacatattactccttcctacattattcttcttctgctttcgtgactttcaggggacacttttgtttttataacttacgcttaaaatcctatgaattcgccgccggttgacgcaatgattaccggagaatcatcgtcacaaagatctatcccaacgccgtttctcacaaaaacgtttaacctcgttgaagatagttccatcgacgatgttatctcatggaacgaagatggttcctctttcatcgtatggaatccgacagatttcgctaaagatttgcttcctaaacacttcaaacacaacaatttctctagtttcgttcgtcagctcaacacttacggattcaaaaaagttgtaccggatcgatgggagttttcaaacgatttctttaagagaggagaaaaacgtcttctccgtgagatccaacgtcggaaaataacaacgacgcatcaaacagttgttgctccttcgtcggaacaacgaaaccagacgatggttgtatcaccgtcaaattccggggaagataataataataatcaggtgatgtcttcgtctccgtcgtcgtggtattgtcatcaaacgaagacgactgggaatggtggtttatcagtggagttattggaagagaacgagaagcttcggagtcaaaacattcagctaaaccgtgagcttactcagatgaaatctatctgcgataatatctatagtctcatgtcgaattacgtcggatctcagcccactgatcggagttattctcccggaggtagtagtagtcaaccgatggagtttttaccggcgaagcggttttcggagatggagattgaagaagaagaagaagcgagtccgaggttgtttggtgttccgattgggttaaaacggacgagaagtgaaggtgttcaggtgaagacgacggcggtggttggggaaaattccgatgaggagacgccgtggttgagacattataatcgaaccaatcagagagtttgtaattaaaaacgaacggtttagatttgtggtgtagatatgtgcgcgaagtagacgattacagctttttaagacaagcagagcacgtgtcccatctgtttcaagaagtttctgcaatcttgacttcttcttttaacactttgtgttttttattatttaattaataacaataaatgttctttttcagttttgttttcttcaaaaatagttcggctgtttctagactttcctttttt

SEQ ID NO: 754 - protein, 299 aa, Arabidopsis thaliana
  G1181
MNSPPVDAMITGESSSQRSIPTPFLTKTFNLVEDSSIDDVISWNEDGSSFIVWNPTDFAKDLLPKHFKHNNFSSFVRQLNTYGFKKVVPDRWEFSNDFFKRGEKRLLREIQRRKITTTHQTVVAPSSEQRNQTMVVSPSNSGEDNNNNQVMSSSPSSWYCHQTKTTGNGGLSVELLEENEKLRSQNIQLNRELTQMKSICDNIYSLMSNYVGSQPTDRSYSPGGSSSQPMEFLPAKRFSEMEIEEEEEASPRLFGVPIGLKRTRSEGVQVKTTAVVGENSDEETPWLRHYNRTNQRVCN

SEQ ID NO: 755 - DNA, 309 bp, Arabidopsis thaliana
  G1183
atgtcgtggatgatccataattggatccaattatctcgtggagcaaaagccacaatagcttcatcgttggaatctggaagcgcttcaccgagaagttctgccgaaatcgatagaatttggcagacattacttggagtttatgaccgaactcaacttacatgtaagttttattgtatgtatatatatacatacaaagattatatctccgagtttggaatcgtctctcatcttgtttttgttgttgacgactgggctttagaagaattaaggagtcagagcaatgagaatgtggacatgagtattttgtga

SEQ ID NO: 756 - protein, 102 aa, Arabidopsis thaliana
  G1183
MSWMIHNWIQLSRGAKATIASSLESGSASPRSSAEIDRIWQTLLGVYDRTQLTCKFYCMYIYTYKDYISEFGIVSHLVFVVDDWALEELRSQSNENVDMSIL

SEQ ID NO: 757 - DNA, 1980 bp, Arabidopsis thaliana
  G1186
aagttgcaagtctttcatctctatgcacaaatggcgaaagagaacagtagtcatagccttgcagaagcaaagagaaagagactcacttggattctttgtgtaagtggactttgcatattgtcttatgttcttggatcttggcaaaccaacactgtcccaacttcttcctctgaggcttactcaagaatgggatgtgatgaaacatcaacaaccactcgggctcagactactcagactcaaacaaatccttcttctgacgatacttcttcctctttgtcttcctcagaaccagttgagttagatttcgaaagccatcacaaactcgagctgaagattacgaatcaaaccgtaaagtactttgagccatgtgacatgtctttgagtgagtacactccatgtgaagatcgagagagaggaagaagatttgataggaacatgatgaagtacagagagagacattgtccttctaaagatgagcttctttattgtctgattcctcctccaccaaactacaagattccattcaagtggcctcaaagtagagattatgcttggtacgacaacattccacacaaggagcttagtattgagaaagctatccagaactggattcaagtagaaggggaaagattcaggttccctggtggtggcacaatgtttccacgtggagctgatgcttacattgatgatattgctagactcattcctcttactgatggagccattagaacagctattgatacaggatgtggtgtggcgagttttggtgcatacttgttgaagagggatattgtggctatgtcatttgctccaagggacactcatgaagctcaagttcaatttgcgttggaacgtggagttcctgcgattatcgggattatgggatcaagaaggcttccttatccagctagagcttttgatcttgctcactgttctcgttgtttgattccttggtttcaaaatgatggtttgtacttgaccgaagtggaccgggttttaagaccgggcggttattggatcctttcgggtccaccgatcaactggaagaaatactggaaaggctgggaaagatcacaagaggatttgaagcaagagcaagattctatagaagatgcagcaagaagtctttgttggaagaaagttacagaaaagggtgatttatcaatttggcaaaagcctatcaatcacgttgagtgtaacaaactcaaacgagttcacaaaactcctcctctatgcagtaaatcagatttacccgattttgcttggtacaaagatttggaatcttgtgtaacaccattaccagaagcaaacagttcagacgaattcgcaggcggtgcattggaggattggccaaaccgagcttttgcggtgccacctaggataatcgggggaaccattccggacattaatgctgagaaattcagagaagacaatgaagtgtggaaggagagaatatcatattacaaacagataatgccagagctttcaagaggaagatttaggaacataatggacatgaatgcatacttgggaggatttgctgcggcaatgatgaaatatccatcttgggttatgaatgtggttcctgtggatgctgagaagcaaacgttaggggttatctttgaacgaggatttatagggacttatcaagattggtgtgaaggattctctacgtatccgagaacttatgatttgattcatgctggtggattgttcagcatttatgagaacaggtgtgatgttacattaatactacttgagatggatagaattttgagaccagaaggaaccgtggtgtttagagacactgtggaaatgttgacgaagatacaaagcataaccaatggaatgaggtggaagagtcggattttggatcatgagagaggtccttttaatcctgagaagatccttctcgctgtaaaatcctattggaccggtccttcttcttagctagttctagctttcttgaactctctactc

SEQ ID NO: 758 - protein, 639 aa, Arabidopsis thaliana
  G1186
MAKENSSHSLAEAKRKRLTWILCVSGLCILSYVLGSWQTNTVPTSSSEAYSRMGCDETSTTTRAQTTQTQTNPSSDDTSSSLSSSEPVELDFESHHKLELKITNQTVKYFEPCDMSLSEYTPCEDRERGRRFDRNMMKYRERHCPSKDELLYCLIPPPPNYKIPFKWPQSRDYAWYDNIPHKELSIEKAIQNWIQVEGERFRFPGGGTMFPRGADAYIDDIARLIPLTDGAIRTAIDTGCGVASFGAYLLKRDIVAMSFAPRDTHEAQVQFALERGVPAIIGIMGSRRLPYPARAFDLAHCSRCLIPWFQNDGLYLTEVDRVLRPGGYWILSGPPINWKKYWKGWERSQEDLKQEQDSIEDAARSLCWKKVTEKGDLSIWQKPINHVECNKLKRVHKTPPLCSKSDLPDFAWYKDLESCVTPLPEANSSDEFAGGALEDWPNRAFAVPPRIIGGTIPDINAEKFREDNEVWKERISYYKQIMPELSRGRFRNIMDMNAYLGGFAAAMMKYPSWVMNVVPVDAEKQTLGVIFERGFIGTYQDWCEGFSTYPRTYDLIHAGGLFSIYENRCDVTLILLEMDRILRPEGTVVFRDTVEMLTKIQSITNGMRWKSRILDHERGPFNPEKILLAVKSYWTGPSS

SEQ ID NO: 759 - DNA, 2324 bp, Arabidopsis thaliana
  G1190
tcctgtcccaaaaccaaaagacttgagagtgtgtctttagagagagatcttctctcttttatcttacgactctcacttcttatctcaaatctacttcaactctatttccagtctccacattttcccacaaatttcaactcttgttctcttcctccaaagtaaaaaacaaatcgttgcaagtgaggtttggttttggtgttatagaattatgaagagcgggaagcaatcttcgcaacctgaaaagggtacttccaggatcttgtcactgactgtcctgtttatcgcattttgcggtttctccttctacctcggtggtatattttgctctgagagagacaagattgtagccaaggatgtcacaaggacgactacaaaggctgtagcttcccctaaagaacctacagctactcctattcaaatcaaatccgtttctttcccggagtgcgggtcagagttccaagattacaccccgtgcaccgatccaaagaggtggaagaagtatggtgtccatcgcttaagtttcttggagcgtcattgtcctccggtatatgaaaagaatgagtgtttgattccaccaccagacgggtataaaccgcctataagatggcccaagagccgagaacagtgttggtacaggaacgtgccttatgattggatcaataagcaaaagtctaaccagcattggcttaagaaagaaggagataagttccatttccctggtggtggtaccatgttccctcgtggagttagtcactatgttgatttgatgcaagatctgattcctgaaatgaaagacggaacagtcaggaccgccattgatactggctgtggggttgcgagctggggaggcgatcttttggaccgtgggatactatcactctctcttgctccaagagataaccatgaagctcaggttcaatttgctcttgaacgtggaattcctgcgattctcgggatcatctctacgcaacgtctcccttttccttcaaatgcatttgatatggctcattgttcaagatgtcttattccctggacagaatttggtggaatctatttacttgagattcaccgtatagttcgacctggaggtttttgggttctttctggtccacctgtgaactataatagacgatggcgtggatggaacacaaccatggaagatcagaaatctgactacaacaagcttcagtcacttctaacctccatgtgtttcaaaaagtacgctcaaaaagatgacatagccgtgtggcagaaactctcagacaaatcttgctatgacaaaatcgctaagaacatggaagcttaccctcccaaatgtgacgacagtatagaacctgattctgcttggtacactccactccgtccttgcgtggttgccccgacacctaaagtcaagaagtctggtctcggatcaatcccaaaatggcccgagaggttacatgtcgcgcccgagagaatcggtgatgttcacggagggagtgcgaacagtttgaaacacgatgatggtaaatggaagaacagagttaagcattacaagaaagttttaccagctcttgggacagacaagataagaaatgttatggatatgaacactgtttatggaggtttctctgcggccctcattgaggatcccatttgggtcatgaacgttgtatcatcgtacagcgcaaattcgcttcctgttgtctttgatcgcggtctcatcgggacttaccacgactggtgcgaagctttctcaacgtatccaagaacatatgatcttcttcacctcgacagtctttttaccttggagagtcacaggtgtgagatgaagtacattttgctagagatggacaggatcttgcggccgagtggatatgttataatccgagaatcgagttatttcatggacgcaatcacaacgttagcgaaagggataaggtggagttgccggagagaggagactgagtatgcagtcaaaagtgagaagattctggtttgccagaaaaagctatggttttcgtcaaaccaaacctcttgatgagaccacctgtatcatagtgtttatcatctcctgtgatgcacactacagagagaaggatctagtcctttgagtccaagatatagctctataaacaatctcctttttttgttctctttaatttcttgggtatttcacggtatagattgatattatatattttttaattatatttttaatatatagatatattagtatgtggtttaaacactattattatcaaggtcttaaagatttgctttgcaagagttaaaaaatgttggagtaaggacctcttgattaataaattgactgacgcagcaaa

SEQ ID NO: 760 - protein, 603 aa, Arabidopsis thaliana
  G1190
MKSGKQSSQPEKGTSRILSLTVLFIAFCGFSFYLGGIFCSERDKIVAKDVTRTTTKAVASPKEPTATPIQIKSVSFPECGSEFQDYTPCTDPKRWKKYGVHRLSFLERHCPPVYEKNECLIPPPDGYKPPIRWPKSREQCWYRNVPYDWINKQKSNQHWLKKEGDKFHFPGGGTMFPRGVSHYVDLMQDLIPEMKDGTVRTAIDTGCGVASWGGDLLDRGILSLSLAPRDNHEAQVQFALERGIPAILGIISTQRLPFPSNAFDMAHCSRCLIPWTEFGGIYLLEIHRIVRPGGFWVLSGPPVNYNRRWRGWNTTMEDQKSDYNKLQSLLTSMCFKKYAQKDDIAVWQKLSDKSCYDKIAKNMEAYPPKCDDSIEPDSAWYTPLRPCVVAPTPKVKKSGLGSIPKWPERLHVAPERIGDVHGGSANSLKHDDGKWKNRVKHYKKVLPALGTDKIRNVMDMNTVYGGFSAALIEDPIWVMNVVSSYSANSLPVVFDRGLIGTYHDWCEAFSTYPRTYDLLHLDSLFTLESHRCEMKYILLEMDRILRPSGYVIIRESSYFMDAITTLAKGIRWSCRREETEYAVKSEKILVCQKKLWFSSNQTS

SEQ ID NO: 761 - DNA, 1071 bp, Arabidopsis thaliana
  G1197
cagccgagaaaataaaagaaacgaagaaaagtttgttcctttgtggggatcaaagaagaatgtactcggcgattcggtcttcgcttcctctagatggcagcttgggagactactctgacggaaccaatcttcccatcgacgcttgtctggtcctaaccactgaccccaagcctcgccttcgttggacctctgagctccatgaaagattcgttgacgccgtcactcagctcggcggacccgacaaagcaacgcctaaaactataatgagaacaatgggagtgaagggtctcactctttaccatctcaaatctcatcttcagaaattccgcttggggaggcaatcttgtaaagaatcaattgacaactctaaggatgtttcttgtgttgcggagagtcaggacactggttcatcttcaacatcatccttaagattggctgctcaagaacagaacgagagttaccaggtcactgaagctttgcgtgcccagatggaagtccaaagaagactacacgagcaactagaggtgcaaaggcgactccagttaaggatcgaggcacaagggaagtacctgcaatcaattctagagaaagcttgcaaggctatagaggagcaagctgttgcatttgctgggttagaggcagctagagaagagctttcagagctagccataaaggcctccatcaccaatgggtgccaaggaacaacaagcaccttcgacacaaccaaaatgatgattccatccttatccgagcttgcagtagcaatagagcacaagaacaactgttcagcagagagctctctgacttccagcactgtaggaagtccggtatcagctgcgttgatgaagaagagacaacgaggagtgtttggaaatggagatagtgtggttgttggtcatgatgctggatgggttatgcctagtagtagcattggatgaagttagcaagagagagagagagagcgagaccagattttagcttatttaattttgctatgttgtatttaactctaaactctgtcatcaaacttgtcttagcgtctatgtatatatttgttgaatctaaaaaaaa

SEQ ID NO: 762 - protein, 292 aa, Arabidopsis thaliana
  G1197
MYSAIRSSLPLDGSLGDYSDGTNLPIDACLVLTTDPKPRLRWTSELHERFVDAVTQLGGPDKATPKTIMRTMGVKGLTLYHLKSHLQKFRLGRQSCKESIDNSKDVSCVAESQDTGSSSTSSLRLAAQEQNESYQVTEALRAQMEVQRRLHEQLEVQRRLQLRIEAQGKYLQSILEKACKAIEEQAVAFAGLEAAREELSELAIKASITNGCQGTTSTFDTTKMMIPSLSELAVAIEHKNNCSAESSLTSSTVGSPVSAALMKKRQRGVFGNGDSVVVGHDAGWVMPSSSIG

SEQ ID NO: 763 - DNA, 1780 bp, Arabidopsis thaliana
  G1198
tcttttcaaattccaatcatttgatcaactaatcaagaattaattataagactttgcaatctctctccctctccctctccctagctagttctctcttgtgtttcttaactcgagcttctctcaatagtgattatcatctttttcatcatttcaagatttaatgtgttttgcagaaaagagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttcctttaaagttgtactagagaaaagataggatcttccttcg

SEQ ID NO: 764 - protein, 481 aa, Arabidopsis thaliana
  G1198
MANHRMSEATNHNHNHHLPYSLIHGLNNNHPSSGFINQDGSSSFDFGELEEAIVLQGVKYRNEEAKPPLLGGGGGATTLEMFPSWPIRTHQTLPTESSKSGGESSDSGSANFSGKAESQQPESPMSSKHHLMLQPHHNNMANSSSTSGLPSTSRTLAPPKPSEDKRKATTSGKQLDAKTLRRLAQNREAARKSRLRKKAYVQQLESSRIKLSQLEQELQRARSQGLFMGGCGPPGPNITSGAAIFDMEYGRWLEDDNRHMSEIRTGLQAHLSDNDLRLIVDGYIAHFDEIFRLKAVAAKADVFHLIIGTWMSPAERCFIWMAGFRPSDLIKILVSQMDLLTEQQLMGIYSLQHSSQQAEEALSQGLEQLQQSLIDTLAASPVIDGMQQMAVALGKISNLEGFIRQADNLRQQTVHQLRRILTVRQAARCFLVIGEYYGRLRALSSLWLSRPRETLMSDETSCQTTTDLQIVQSSRNHFSNF

SEQ ID NO: 765 - DNA, 1374 bp, Arabidopsis thaliana
  misc_feature (1144)..(1144): n is a, c, g, or t
  misc_feature (1209)..(1209): n is a, c, g, or t
  misc_feature (1212)..(1212): n is a, c, g, or t
  misc_feature (1238)..(1238): n is a, c, g, or t
  misc_feature (1254)..(1254): n is a, c, g, or t
  misc_feature (1260)..(1261): n is a, c, g, or t
  misc_feature (1296)..(1296): n is a, c, g, or t
  misc_feature (1322)..(1322): n is a, c, g, or t
  misc_feature (1325)..(1325): n is a, c, g, or t
  misc_feature (1360)..(1360): n is a, c, g, or t
  G1211
tgaaacctagatttctgcaactgaattcctaattcgaaaaagaatggagggttcgtcgtcgacgatagcaaggaagacatgggaactagagaacagcattctaacagtagactcacctgattcaacctccgacaacatcttctactacgacgatacttcacagactaggttccagcaagagaaaccgtgggagaatgatcctcactactttaaacgagtcaagatctcagcgctcgctcttcttaagatggtggttcacgctcgctctggtggtacaattgaaataatgggtcttatgcaaggtaagaccgatggtgatactatcattgttatggatgcttttgctttaccagtggaaggtactgagacaagggttaatgctcaggatgatgcttatgagtacatggttgagtattcacagaccaacaagctcgcggggcggctggagaatgttgttggatggtatcactctcaccctggatatggatgctggctctccggtattgatgtttctacgcagacgcttaaccaacagcatcaggagccatttttagctgttgttattgatcccacaaggactgtttcagctggtaaggttgagattggtgctttcagaacatactctaaaggatataagcctccagatgaacctgtttctgagtatcaaactattcctttaaataagattgaggactttggtgttcactgcaaacagtactattcattagatgtcacttatttcaagtcatctcttgattctcaccttctggatctactatggaacaagtactgggtgaacactctttcttcttctccactgctgggtaatggagactatgttgctggacaaatatcagacttagctgagaagcttgagcaagccgagagtcatctggttcagtctcgctttggaggagttgtgccatcatcccttcataagaaaaaagaagatgagtctcaactaactaagataactcgggatagcgcaaagataactgtggaacaggtccatggactaatgtcgcaggtcataaaagatgaattattcaactcaatgcgtcagtccaacaacaaatctcccactgactcgtcggatccagaccctatgattacatattgaagttgctcttcttttggtttctanttttggattgacccatcatttgttgtcctttcatttattttctgttgtgtaaagaattataatgncgncgcgaattcgcggccgctaaaaaaanacaggaaattgaaaanaattcnnccattccaacatctttatttaatattatctcctcnattatataatattcaaacatccctantancttcatttgaccgtccccctccctcccgtgttgcnttggtgctggcccc

SEQ ID NO: 766 - protein, 358 aa, Arabidopsis thaliana
  G1211
MEGSSSTIARKTWELENSILTVDSPDSTSDNIFYYDDTSQTRFQQEKPWENDPHYFKRVKISALALLKMVVHARSGGTIEIMGLMQGKTDGDTIIVMDAFALPVEGTETRVNAQDDAYEYMVEYSQTNKLAGRLENVVGWYHSHPGYGCWLSGIDVSTQTLNQQHQEPFLAVVIDPTRTVSAGKVEIGAFRTYSKGYKPPDEPVSEYQTIPLNKIEDFGVHCKQYYSLDVTYFKSSLDSHLLDLLWNKYWVNTLSSSPLLGNGDYVAGQISDLAEKLEQAESHLVQSRFGGVVPSSLHKKKEDESQLTKITRDSAKITVEQVHGLMSQVIKDELFNSMRQSNNKSPTDSSDPDPMITY

SEQ ID NO: 767 - DNA, 1104 bp, Arabidopsis thaliana
  G1212
acgactaatcaattcatctgattatggagagactacagagaatcttcggagctggtggcggtttaggtcacgcatcgcctgattctccgactctcgatacatcggagcaggtttacatctcttctctcgctctcctcaagatgcttaagcacggaagagctggtgttcctatggaagtcatgggattgatgcttggagagtttgtggatgaatacactgttagggttgtggatgtttttgcgatgcctcagagtggtactggtgttagtgttgaagctgttgatcatgttttccagactaatatgctcgacatgcttaaacagaccggaagacctgagatggtggttggttggtatcattcacatcctggattcggctgctggctttctggggttgacattaatactcaacagagttttgaagctttgaatcagcgagctgtagcagtggtggtagatccgattcagagtgtgaaaggaaaggtggtgattgatgcgttccgctccataaatccacagaccattatgcttgggcaggaaccccgtcaaacaacatcgaaccttgggcacttgaacaaaccatcgatccaggctttgattcacgggttgaacagacactattactcaatagcaatcaactataggaagaacgagcttgaggagaagatgttactcaacctccacaagaagaaatggacagatggtctgacgctaagacgctttgacacccactccaagaccaacgaacagacggtccaggagatgttgagcttggctgctaaatataacaaggcggttcaagaggaggacgagttgtcaccagagaagctggcaattgtgaatgtgggaagacaagatgcaaagaagcatctggaagaacatgtctcgaacctcatgtcatccaacattgttcagacactaggcactatgctcgacactgttgtcttctagagagcttacttctccagccgcttcaagtcattgagctttgttcttctgcatctctttggcttctactgaatgttctctttttatctgctagctttttacaaggttgtactgtactatgtgatttcgttcgttaagggcagggatcgatttcaaa

SEQ ID NO: 768 - protein, 308 aa, Arabidopsis thaliana
  G1212
MERLQRIFGAGGGLGHASPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRRFDTHSKTNEQTVQEMLSLAAKYNKAVQEEDELSPEKLAIVNVGRQDAKKHLEEHVSNLMSSNIVQTLGTMLDTVVF

SEQ ID NO: 769 - DNA, 2337 bp, Arabidopsis thaliana
  G1216
tgtggcgtttcacagagagagaaagaaataggagattgtttttgcttgtggtgagagaagatcgcatcgtgtgggtagcgtttcaaacaagtaaaataataaaaagaataaaaagtttccgtcactttctcgaggaagaaggggttttggtgtgagtcctttctttgcgtttgtcttttcattttccgatctcgtaattgtcgtgttattcgccggaaaagttaaagattcagatttaaaggttgggaattacattcacagaatttcgttgattggtgtgataataagccattgatcaacaatcttcttttgtggcaatcacataatcgtgttatgcattctgagaaatggtgtcgcataagtgtgtagaagaatttggatacgcaagctacctggtaccttccaatgcaagagcacccagatccgcccggaagaggcgcagtatcgagaagaggataagtaaagaagatgataatatgtgtgcaattgatctattggccaccgtagctggacacttgtcatttgagagtgggagttctctcatgtctattgacaaactgattgaagatcatcgtgtaaaggaggaattcccggaggaagaaaaacctctaatgccagtagctttatccccttatcggggatctttgagtccctgcggattcagttctgtgataaatggcaaagtagagaatgaggtagatggttttagttactctggtggtagtgatgcttgtcaagtcgggaacttcagtcaagatgtaaaaccggatatcgatggtgatgcagtagttctggatgcgagacctaatgttgtagttagtttaggtagtagtagtagaaccgaagtgccatcaattgggaactgtgtttcccatggcgttcgggatgatgtaaatttgtttagtagagatgatgatgaaaacttttccaagtacattcacccgcgtgttacaaaacattcacctaggactgtacctcgtattggggacagaagaatcaggaagatattggcttctagacattggaaaggaggttcaaggcattcagatacgaaaccgtggagaaattattacttgcaccagcagaggagctatcctatcaagaaaaggaaaaactttgaccacatatctgattccgttactgatgattaccgtatgcgtactaagatgcatagaggtagtagaaaaggtcaaggggcatcctttgtggcaagcgactcccatgtgaaactacggatcaagtcgttcagggtgcctgagcttttcatagagattccagaaactgctactgttggctcattgaagagaatggtgatggaagcagtgagcactttactgagtgatggacaccgagttggtctgatggttcaggggaagaaagtccgtgacgataacaaaacccttcatcagactggtatctctcaggataactcccacctggactctcttgattttagccttgaacccagctcagaaatgcctcaactgttaactagtcacccgttgggacatgcttgtgaggagctgctacctgtgtgccaagctactaaaatagacaatgtgttggaatctgaccatcatgactcagcattattcccatctgactcattaggcaacaataatgtgacagaagattctaaagctatgatttctgtggcgctcaacgaattgtcttctcaatcacaaccaccttcccggaaatctagaagaagtgaacagcagcagcagcaggctgcacaacgcagaattcgtcgacctttctcagttgctgaagtagaagcacttgttcaagcagttgagaaactcggtactggaaggtggagagatgttaagctttgtgctttcgaggatgctgaccaccgcacttacgtagatctcaaggataaatggaaaacgctggtccacacggctaagatatctccacaacagaggagaggagagccagtgccgcaggaacttctaaaccgagtcttgaacgcccatggctactggacgcagcaacagatgcagcagctgcagcagaatgtgaacaagctggagcaggagacacagtctcaaacgacagagggtctgttacttctctaaatgaatctgctgcagccttggaggtcgtctctcctttgtgtattactactactattgatgattatgtaagattctgacatagatgcaaagatttggtcttttactttggtttgatttttttaacttttctcaatgtaaagtttttaactggaataaggtttctctgaccagtttagggcttttagaggatctgttgtacatcttttgtgacattctcattctctttacatatttcttatctagactttttaaa

SEQ ID NO: 770 - protein, 578 aa, Arabidopsis thaliana
  G1216
MVSHKCVEEFGYASYLVPSNARAPRSARKRRSIEKRISKEDDNMCAIDLLATVAGHLSFESGSSLMSIDKLIEDHRVKEEFPEEEKPLMPVALSPYRGSLSPCGFSSVINGKVENEVDGFSYSGGSDACQVGNFSQDVKPDIDGDAVVLDARPNVVVSLGSSSRTEVPSIGNCVSHGVRDDVNLFSRDDDENFSKYIHPRVTKHSPRTVPRIGDRRIRKILASRHWKGGSRHSDTKPWRNYYLHQQRSYPIKKRKNFDHISDSVTDDYRMRTKMHRGSRKGQGASFVASDSHVKLRIKSFRVPELFIEIPETATVGSLKRMVMEAVSTLLSDGHRVGLMVQGKKVRDDNKTLHQTGISQDNSHLDSLDFSLEPSSEMPQLLTSHPLGHACEELLPVCQATKIDNVLESDHHDSALFPSDSLGNNNVTEDSKAMISVALNELSSQSQPPSRKSRRSEQQQQQAAQRRIRRPFSVAEVEALVQAVEKLGTGRWRDVKLCAFEDADHRTYVDLKDKWKTLVHTAKISPQQRRGEPVPQELLNRVLNAHGYWTQQQMQQLQQNVNKLEQETQSQTTEGLLLL

SEQ ID NO: 771 - DNA, 2559 bp, Arabidopsis thaliana
  G1218
acccattgcacggtctctctctactctcaaacttcaaaaagctttggctttttagattcacaggaaagaaccctcaaaacacacaaaaagctggtgatttttgcattgcaccgattcgcctccatcgattttggacattcttgaattctccctccaagtattcctgtgaaattgaccggaaagttccttcctttttcaatttccggtaaaaaggaaagtaattgggtactgtagacttccttctagggcttgtgaactttctaatccttcagaaaaccctcgaattcgaaaaatttgctgcgagattgataaatgactagttaaagatttgaactttgatttctgggtttgcgattttattcaaatggagagatctagatccaagagaaactaccactatgaccaagactatgacggagattccatgcctaggtctaaacctcgctacaacaataattaccactttggtggtggcggcggaggaaataacagataccgtggcggcggcggtggtggaggtggaaatggccggccatcgaagtctcatcctgaaacgatggcaacaacgacttatcgaatcctctgtcacgacgctaaagcaggaggtgttattggtaaatccgggacaattatcaaatctataaggcaacacaccggcgcgtggattaacgtgcacgagctagttcctggagatgcagagcgtatcattgagatttctgataatcgtaggcgtgaccctgatgggagaatgccgtctttctctcctgctcaagaggctttgtttagtgttcatgacaggattttggagagtgaagctcagtttggttatggtggacctccgccggaagaggaggaggattacggtggagttagacctggtggagggagagttgtgactagattagtggtttctaggatgcatgttggttgtttgttgggtaaaggtgggaagattattgagcagatgaggattgaaactaagactcatattcggattcttccaagagaaagtaacttacctcgttgtgtttcactctctgaagagattgttcagattgtaggtgaactaaatgcagtgaaaaacgctttagccattgtatcatctcgtctaagggagagtcagcatcgtgatcggagtaatttccaagggcgttcacattcaccagaacggtcgtttgcagctgcgggggatgattacatgccacagctaagaagacaatcatccgataggtttcctcgtggtaattttagaaataacaacttcagttctcgccagtccaactatgcagaagaagctccagcagttccagttggtgagaatgtctactccgaagagcttgtgttccagattctctgcccagctgacaagattgttcgggttgttggggaatcgcaaggaataattgatttgcttcagaacgagatcggcgtggacgttagagtatctgacccagttgctggatctgatgaacagataatcaccatttcttcggaagaggcacctgatgatccatttttccctgctcaagaagccttgttgcacattcaaactcagatcatagatcttattccggataaagataatttaataacaacaagattacttgtcccatctagagactctatatgtttggaagggaaagcaggatcagtatctgagatatcacgattaactggaacaagcgtacaaattctagctagggaagaaattccccgatgtgcttctatcaatgatgttgttatacagattactggcgagatcagagctgctcgggaagcacttgttgaattaacattactattgaggagtcatatgttcaaggagctctctcaaaaggagacaccaccagcttccacatccacaactggccctctcgaaggtgttgcaggagtaatggaggtagcttcatcaaataacacaattcaatctcgtgaaggtcctactagttcgaatctgaacttgcagcaagttagcacaatcttgccacagtttaaggaaggtttcggatcagttgcaaaggcgggtgaaagtgaacaccgggaagaggttcctgtcacgacaagcagaatggcggtaccacttgttactagaagcactcttgaagttgtcttaccagaggcggttgttcctaagctcgttacgaaatcaagaaacaagcttgcacaaatcagtgagtggtctggagctagtgtaaccatagttgaagacagaccagaagaaacacagaatatcattcgaatttcgggtacacccgagcaagcagagagagctcagagtttgcttcaaggcttcattttgagcatacaagaggatggaccgtgaacttggaccagatcatcagtcaacacagagatgaagatcaagaaactgagaaatgtggagttatgtatgacttgttgaatattaggatttcagtaagcagtagtttagatgaacattccacattttgaccatcactctttggtttctatgttgtctattagtcttctttggttacattggtctgtaacttatttaaaaaagtcattaaagtttaatccgaatgactaatcattaaa

SEQ ID NO: 772 - protein, 652 aa, Arabidopsis thaliana
  G1218
MERSRSKRNYHYDQDYDGDSMPRSKPRYNNNYHFGGGGGGNNRYRGGGGGGGGNGRPSKSHPETMATTTYRILCHDAKAGGVIGKSGTIIKSIRQHTGAWINVHELVPGDAERIIEISDNRRRDPDGRMPSFSPAQEALFSVHDRILESEAQFGYGGPPPEEEEDYGGVRPGGGRVVTRLVVSRMHVGCLLGKGGKIIEQMRIETKTHIRILPRESNLPRCVSLSEEIVQIVGELNAVKNALAIVSSRLRESQHRDRSNFQGRSHSPERSFAAAGDDYMPQLRRQSSDRFPRGNFRNNNFSSRQSNYAEEAPAVPVGENVYSEELVFQILCPADKIVRVVGESQGIIDLLQNEIGVDVRVSDPVAGSDEQIITISSEEAPDDPFFPAQEALLHIQTQIIDLIPDKDNLITTRLLVPSRDSICLEGKAGSVSEISRLTGTSVQILAREEIPRCASINDVVIQITGEIRAAREALVELTLLLRSHMFKELSQKETPPASTSTTGPLEGVAGVMEVASSNNTIQSREGPTSSNLNLQQVSTILPQFKEGFGSVAKAGESEHREEVPVTTSRMAVPLVTRSTLEVVLPEAVVPKLVTKSRNKLAQISEWSGASVTIVEDRPEETQNIIRISGTPEQAERAQSLLQGFILSIQEDGP

SEQ ID NO: 773 - DNA, 651 bp, Arabidopsis thaliana
  G1222
atgctggctggcctagcaacatgtggtttcatgatgaacatagtctcgagagcttcagatctgacacaagacttcaagacaggttacctcactttatcatctccaaagtcaatgtttgtgagccaagtgattggaacagcaatgggttgtgtggtatctccttgcgttttctggctattctataaagcatttgatgatttaggcctcccaaacactgaataccatactccatttgctaccgtatatcgaagcatggctaaactaggagtaccaagagaatgtctcgttctatgctacgtgttcttcggtgtggcgattctcgtaaacatagtaaaagatagtctccatagcaaatggggaaggttcattccactttccatggcaatggctataccgtttttcttgggactttactttgcaattgaaatgtgtgtgggaagtttgatactttttatctgggaaagagtagatgcagccaaggctgaagcttttgggacagcggtggcttcttgtttgatatgcagagatggcacttggtctaagccaagctcagtgctcgctgtagccgcagttaatcctcctgtttgcatgaagtttctctcttctcaaacaaattcaaaagtcgacaacattctgcaaggatccacttaa

SEQ ID NO: 774 - protein, 216 aa, Arabidopsis thaliana
  G1222
MLAGLATCGFMMNIVSRASDLTQDFKTGYLTLSSPKSMFVSQVIGTAMGCVVSPCVFWLFYKAFDDLGLPNTEYHTPFATVYRSMAKLGVPRECLVLCYVFFGVAILVNIVKDSLHSKWGRFIPLSMAMAIPFFLGLYFAIEMCVGSLILFIWERVDAAKAEAFGTAVASCLICRDGTWSKPSSVLAVAAVNPPVCMKFLSSQTNSKVDNILQGST

SEQ ID NO: 775 - DNA, 1196 bp, Arabidopsis thaliana
  G1228
gcatttataattactcactcatcttcttttcattacattacataccaaacaagagctctcaaatggaaaggtttcaaggacacatcaacccctgtttcttcgatcgaaaaccggatgtgagaagcctcgaggttcaaggatttgcagaggctcaaagctttgctttcaaagaaaaagaggaagaaagcttacaagatacagttccatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgaggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctctcaggcatttcgtcgaacgacctgtggacaactcttgaagatcaaacttgtatccccaaaatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaagatggaagatgagtgcgacttagagtcagccgacgagattacggcggctgttcatcggattttcgatattccgacaatttgattaaacacatataattccaaaaatattaacagctgacaaaatggtatctttgcggcc

SEQ ID NO: 776 - protein, 358 aa, Arabidopsis thaliana
  G1228
MERFQGHINPCFFDRKPDVRSLEVQGFAEAQSFAFKEKEEESLQDTVPFLQMLQSEDPSSFFSIKEPNFLTLLSLQTLKEPWELERYLSLEDSQFHSPVQSETNRFMEGANQAVSSQEIPFSQANMTLPSSTSSPLSAHSRRKRKINHLLPQEMTREKRKRRKTKPSKNNEEIENQRINHIAVERNRRRQMNEHINSLRALLPPSYIQRGDQASIVGGAINYVKVLEQIIQSLESQKRTQQQSNSEVVENALNHLSGISSNDLWTTLEDQTCIPKIEATVIQNHVSLKVQCEKKQGQLLKGIISLEKLKLTVLHLNITTSSHSSVSYSFNLKMEDECDLESADEITAAVHRIFDIPTI

SEQ ID NO: 777 - DNA, 1264 bp, Arabidopsis thaliana
  G1232
gctctctcttctcaatttccccaaatgaaataaattcctccgaaagtttatagatttcactctcccccgaactatacaaaattccctcaaaaggaaaaactaaaaagccgatcttggcttttttgtttctgagtgcatctcgatacttggaagcattctttggtgaggctgattcattctcatcttgtgaaagtctttggcttttgaagcaatactatggaaggaattcagcatcctatacctcgcactgtcgaagaggtttttagcgactttcgtggtcgtagagctggtctcatcaaggctctctctactgatgtacagaagttttaccatcagtgtgaccctgagaaggaaaacttgtgtctttatggacttccaaatgagacatgggaggttaatcttcccgttgaggaggtccctcctgagcttcctgaaccagcgttaggcatcaatttcgcaagggacggaatgcaagaaaaagactggatttctttggttgcagttcacagtgattcatggcttatctctgttgcattttactttggtgcacgtttcggatttggcaagaatgagaggaagaggctcttccagatgataaatgatctcccaaccattttcgaggttgtaactggcaatgcaaagcaatccaaggatcaatctgctaaccacaacagtagcagaagcaaatctagtggtggcaagcctcgtcattctgaatctcacactaaggcttcaaagatgtcccctccaccaagaaaagaagatgagagcggagatgaggatgaagatgacgagcaaggtgctgtttgtggtgcgtgtggcgacaactatggaggagatgagttctggatatgttgtgatgcttgcgagaaatggttccatgggaaatgcgtgaagatcacaccagcaaaggctgagcatatcaaacattacaaatgcccaagttgcactaccagcaagaaaatgaaagcctgaaagtgataataacattagagcctgtgaaagaggaaaacgttttcacagtttaagaagacagtacaagagtttagctgtgggaagaagaagaaacaaaaggcttctgattgcgtagttttaatgggattgagacagcttacagttagtaatgtctctttctcttttcttttctttttttttgctgttaatgttaaaatgttatgactaatttgtcttaagtttctgagaaaattctgtcttttaagcactctctagtctatgtcaagtggtttcttcttctcggtaaaaa

SEQ ID NO: 778 - protein, 252 aa, Arabidopsis thaliana
  G1232
MEGIQHPIPRTVEEVFSDFRGRRAGLIKALSTDVQKFYHQCDPEKENLCLYGLPNETWEVNLPVEEVPPELPEPALGINFARDGMQEKDWISLVAVHSDSWLISVAFYFGARFGFGKNERKRLFQMINDLPTIFEVVTGNAKQSKDQSANHNSSRSKSSGGKPRHSESHTKASKMSPPPRKEDESGDEDEDDEQGAVCGACGDNYGGDEFWICCDACEKWFHGKCVKITPAKAEHIKHYKCPSCTTSKKMKA

SEQ ID NO: 779 - DNA, 1057 bp, Arabidopsis thaliana
  G1233
gcatcgggtctcaaaaaccattgatacagacatcgatccttgtcaactagtactgatctataaatcttataaaaatctgtagagatatggccgccgcagccgtttcctctaaccctcgcaccgttgaagagatcttcaaagattattccgctcgtcgtgccgctcttcttcgtgctctcactaaagatgttgatgatttttactctcaatgcgatccggaaaaggagaatttgtgtttgtacggacaccctaatgagtcatgggaagtgaatctaccagcagaggaagtgcctccggagctacctgagcctgctcttggtatcaatttcgctagagatggtatgcagaggaaagattggctttctcttgttgctgttcacagtgattgttggttgctctctgtttctttctactttggagcccgtcttaatcgcaatgagaggaagcggttattcagtctgatcaacgatctcccaactctcttcgatgtagtgactggtaggaaagccatgaaagacaacaagccaagctcggactcaggaagcaaatccagaaatggcactaagagatcaatagacgggcagacaaagagctcaacaccgaaactaatggaagagagctatgaggaggaggaagaagaagacgagcatggagacactctctgtggaagctgtggaggtcattacacaaatgaggagttctggatttgctgtgatgtttgtgaacgttggtaccatggaaaatgcgtcaagataactccggctaaagcagagagcatcaagcagtataaatgcccgccttgctgtgcaaagaaaggaagacagtgatgctgatcaattgatgatgatgatgatgatgatctctcagagagactctggttctcatgttttaatcaatatgttaatcaactttttttcttttcttctctttttttctttaaccttcttaattttaaagcatacaaaactctctctttagatctcaagaaagggatttcaagaagttgagggagagagtagcaaactgtttgaataatattattattattcatattaaa

SEQ ID NO: 780 - protein, 246 aa, Arabidopsis thaliana
  G1233
MAAAAVSSNPRTVEEIFKDYSARRAALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKAMKDNKPSSDSGSKSRNGTKRSIDGQTKSSTPKLMEESYEEEEEEDEHGDTLCGSCGGHYTNEEFWICCDVCERWYHGKCVKITPAKAESIKQYKCPPCCAKKGRQ

SEQ ID NO: 781 - DNA, 1186 bp, Arabidopsis thaliana
  misc_feature (659)..(659): n is a, c, g, or t
  misc_feature (662)..(663): n is a, c, g, or t
  misc_feature (685)..(685): n is a, c, g, or t
  G1237
cgggttgacagtgagatgggatctgctgtgacttgggtcagaagtggttcaatggcaagtgtgtgaagatcactccagctagagctgagcatatcaaacaggacaagtgcccttcatgcagcaacaaaagagctcgagcttaaaaatgttgtattgtagagaatagcctgtagtgacaactctcactaccctcgatctgtctttatttggctagtcttttagctcgttattggccataacagcttgggcctatttctctgtataattggtttgattttgcaactgagaaaaaaaaggaaactctttaactgaatttgtggttagcttcaaaccaagaggaaacataacaattcttaattcggatacagcaatatactctagaagtctcgaaatcatcactaaccctatctggaacaattatgttagggttctcagaacctgaggtaacttgtgatgcttctctagcaatctagcaatagtctcaactctcaattgggagtgtaacgaaactgaagatcacatcaacaaaatcttgacacattttatagtaaattcaaaataaaacataaacatttcggacacatgaaaacaaacaaaaaacaataacaagaagtcttgaagcaaacaaatttagaaaggatagccaacacttgagagcnccnnatttaaagagaagaaatgaacnccgatccctagttcactatgcccggtctctcacgaactgaatccggcgtagttttcataacgaaaccttaatcccttaacaattccattaccccttaccccccttacccgagaagacactacccttccctaagtcagttcccatctcccctgcgaaaagaaatagcccgttactcgcttaacttcccggttcctcctggcgagaatcatccccccccaatttttatgagactacaacttcctaaggcaggtttttatcttcgacaaaattgttttcaagaaaattttgaatactccaaaatctcgatcttccccctccctggcgccgcaccgggcgtttttcctccggcggatcctccatacccaccccctgcgaagaccaactcttgcaccgcgttcgccgcggtggcccctatatccggggaaactcgctcccgctattatatccacagagtggcctcctctatcccgagacacaataaacctcttctgcgcgcccccc

SEQ ID NO: 782 - protein, 250 aa, Arabidopsis thaliana
  G1237
MEGGAALYNPRTVEEVFKDFKGRRTAIVKALTTDVQEFYQQCDPEKENLCLYGLPNEEWEVNLPAEEVPPELPEPALGINFARDGLSEKEWLSLVAIHSDAWLLSVSFYFGSRFSFHKEERKRLFNMINDVPTIFEVVTGMAKAKDKSSAANQNGNKSKSNSKVRTSEGKSSKTKQPKEEDEEIDEDDEDDHGETLCGACGDSDGADEFWICCDLCEKWFHGKCVKITPARAEHIKQYKCPSCSNKRARA

SEQ ID NO: 783 - DNA, 710 bp, Arabidopsis thaliana
  G1240
tcttttctttttgtttcattttcttatctcctcacactcttcgaacaaggaagaaccctaatctcaagatgaatagggagaagttgatgaagatggctaataccgtccgcactggcggaaagggtactgtcagaagaaagaagaaggctgtgcacaagaccaatacaactgatgacaagaggcttcaaagcactcttaagagaattggagttaactccattcccgctattgaagaagttaacatctttaaggatgatgttgttattcagttcatcaaccctaaggttcaagcttcaattgctgcaaacacatgggttgttagcggttctcctcagaccaaaaaattgcaagatatccttcctcagatcatcagccaacttggaccagacaacatggacaacctgaagaagctagcagaacagttccagaaacaggcttctggtgaaggtaatgccgcctcagcaaccatacaagaagaggatgatgacgatgtcccagagcttgttggagagacattcgaaactgctgctgaagagaaagcaccagctgctgctgcttcttcttagagagaaaagagcgagaccacatccaaaaaaaaaccgcactttgatttttacatatctttataatatgtttgttcgctcgatcctttttgtagtttccgaccagaatcttgttttccatctaatgacttaaggtttttatccaaa

SEQ ID NO: 784 - protein, 165 aa, Arabidopsis thaliana
  G1240
MNREKLMKMANTVRTGGKGTVRRKKKAVHKTNTTDDKRLQSTLKRIGVNSIPAIEEVNIFKDDVVIQFINPKVQASIAANTWVVSGSPQTKKLQDILPQIISQLGPDNMDNLKKLAEQFQKQASGEGNAASATIQEEDDDDVPELVGETFETAAEEKAPAAAASS

SEQ ID NO: 785 - DNA, 838 bp, Arabidopsis thaliana
  G1241
tacccttcgaccaacgaagaaccctagaaatcgattaacaagatgaatagggaaaagttgatgaagatggctaacactgtccgcactggcggaaaggggacagtaagaagaaagaagaaggctgttcacaagaccactacaaccgatgacaagaggctccagagcactcttaagagagttggagtcaattccattcccgccattgaagaagttaacatttttaaggatgatgtagtcattcagttcattaaccctaaagttcaagcttcaattgctgctaacacatgggttgtgagtggtacaccacagacgaaaaaattgcaagacattcttcctcagattatcagccaacttggaccagataacttggacaacctgaagaagctagcagagcaattccagaaacaagctccaggtgcaggtgatgtcccagcaacaatccaagaagaggacgatgatgatgatgtcccagatcttgtagtgggagagactttcgagacccctgctactgaagaggctcccaaagctgctgcttcttagaggaggaggaagaagaaggagaagagctcacctgcaaaacccatcataaaaatgtttgtcgctcgacctcttctgagcactgtcagattcttgttttctctaatgcttgcgaacagaaagacttggttttattatcacttgatgctttttggtccgaacagcaattttccttttattaaggttagatcgctttttgtttaccacctgttcaaatgagtactactatgtcctgtcgcttcatacacttcttgcaacacagtcctttgttttgagtcaacgatgtcttgagatgaacaaa

SEQ ID NO: 786 - protein, 165 aa, Arabidopsis thaliana
  G1241
MNREKLMKMANTVRTGGKGTVRRKKKAVHKTTTTDDKRLQSTLKRVGVNSIPAIEEVNIFKDDVVIQFINPKVQASIAANTWVVSGTPQTKKLQDILPQIISQLGPDNLDNLKKLAEQFQKQAPGAGDVPATIQEEDDDDDVPDLVVGETFETPATEEAPKAAAS

SEQ ID NO: 787 - DNA, 2481 bp, Arabidopsis thaliana
  G1242
gcgccgagacttttcagcaccaactatcggcttcttatcacgggaaccccccttcagaataatctccatgaattgtgggcccttctcaattttcttctccctgaggtttttagttcagcagaaacttttgacgagtggtttcaaatttctggtgaaaacgaccagcaagaagttgttcaacaacttcacaaggttctgcgaccatttcttcttcggaggttaaaatcagatgtagagaaaggcttacctccaaaaaaggagacaatactcaaagttggcatgtctcaaatgcaaaaacagtactacaaggctttactgcagaaggatcttgaagtggttaatggtggtggagaacgcaaacgtctgttgaacatagcaatgcaattgcggaaatgctgcaatcacccttatctcttccagggtgcggagcctggtcccccatatactacaggagatcaccttgtaacaaacgcaggtaagatggttctcttagataaattgctacctaagttgaaggatcgagattcaagggttctgatattttctcagatgacaaggcttttggatattctcgaggattacctaatgtatcgtggttaccagtactgccgtattgatggaaatactggtggtgacgaacgagatgcttccatagaagcctataacaagccaggaagtgagaaattcgttttcttgttatccactagagctggaggacttggtatcaatcttgctactgcagatgttgtgatcctctatgatagtgactggaaccctcaagttgacttgcaagctcaggatcgtgcacataggattggtcaaaaaaaagaagttcaagtgttccggttctgcaccgagaatgctattgaggctaaagtcattgagagagcttacaagaagttggcacttgatgctctggttattcagcaagggagattggcagaacagaaaactgttaataaggatgagttgcttcaaatggtgagatatggtgctgaaatggtgtttagttctaaagatagcacaattacggatgaggatattgacagaatcattgccaaaggagaagaggcaacggctgaacttgatgccaagatgaagaaatttactgaagatgcaatacagtttaaaatggatgacagtgctgacttttatgattttgacgatgacaacaaggatgagagcaaggtggattttaaaaagattgtgagtgaaaattggaatgatccaccaaaaagagagagaaagcgcaactactctgaagttgaatacttcaagcaaacgttgcgacaaggtgctccagctaaacctaaagagcctagaattccacgcatgccccaattgcatgattttcagttctttaacattcagaggctgactgagctgtatgaaaaagaagtgcgataccttatgcaagcacatcagaaaactcaaatgaaagacacaattgaggttgatgaacctgaagaagttggagatcccttaactgctgaagaagtggaagaaaaggagctattgctggaagagggtttctcaacatggagcagaagagacttcaatgccttcattagggcttgtgagaagtatggccggaacgacataaagagtattgcctctgagatggaagggaaaactgaggaagaggttgaacgatatgctcaagttttccaagtgcgatataaagagctgaatgattacgacagaatcatcaagaatattgagagaggggaagcaagaatctctaggaaagatgaaatcatgaaagctattgggaagaaactggatcgctacagaaacccgtggctggaactgaagattcaatatggtcagaacaaagggaagctgtacaatgaagagtgcgaccgtttcatgatatgcatggtccataaacttgggtatggaaactgggatgagctaaaggcagcgtttcggacatcccccttgtttaggtttgactggtttgtaaaatcccgcacaactcaggaacttgcaaggagatgtgacacactaatcaggttgattgagaaagagaatcaagaatttgatgagagagagaggcaagcccgaaaagagaagaagctttcaaagagtgcaacgccatcaaaacgaccttcgggtaggcaagcaaatgagagcccttcatctcttctgaagaaacgaaagcagctgtcaatggatgattatggaaagcgtaggaaataagaaggcttgtgttgaatccatcactaagtaatcagaaagatttatgatcacttctaggtttgattccgaatcggagaattagttagaagaagctccttagagacaaggatctaatattttgtacccgcaagcatcactgcattgtctccgacttctcttatttcttcaacgtgtattttactctattttgtttgtagaaatattcaccacattcctagtagtgcgtttttagtaaatctcaaatgaacttttgtggtcggatttgaacaaaaaaaaaaa

SEQ ID NO: 788 - protein, 640 aa, Arabidopsis thaliana
  G1242
MSQMQKQYYKALLQKDLEVVNGGGERKRLLNIAMQLRKCCNHPYLFQGAEPGPPYTTGDHLVTNAGKMVLLDKLLPKLKDRDSRVLIFSQMTRLLDILEDYLMYRGYQYCRIDGNTGGDERDASIEAYNKPGSEKFVFLLSTRAGGLGINLATADVVILYDSDWNPQVDLQAQDRAHRIGQKKEVQVFRFCTENAIEAKVIERAYKKLALDALVIQQGRLAEQKTVNKDELLQMVRYGAEMVFSSKDSTITDEDIDRIIAKGEEATAELDAKMKKFTEDAIQFKMDDSADFYDFDDDNKDESKVDFKKIVSENWNDPPKRERKRNYSEVEYFKQTLRQGAPAKPKEPRIPRMPQLHDFQFFNIQRLTELYEKEVRYLMQAHQKTQMKDTIEVDEPEEVGDPLTAEEVEEKELLLEEGFSTWSRRDFNAFIRACEKYGRNDIKSIASEMEGKTEEEVERYAQVFQVRYKELNDYDRIIKNIERGEARISRKDEIMKAIGKKLDRYRNPWLELKIQYGQNKGKLYNEECDRFMICMVHKLGYGNWDELKAAFRTSPLFRFDWFVKSRTTQELARRCDTLIRLIEKENQEFDERERQARKEKKLSKSATPSKRPSGRQANESPSSLLKKRKQLSMDDYGKRRK

SEQ ID NO: 789 - DNA, 3174 bp, Arabidopsis thaliana
  G1243
atggcgagaaattcgaattccgatgaggctttctcgtcagaggaggaagaagagcgggttaaggataatgaagaagaagatgaggaggagctcgaggctgttgctcgttcttctggctccgacgatgacgaagtagccgccgccgacgaatcaccagtctccgacggagaggctgctcccgtagaagatgattacgaggacgaagaagatgaggaaaaagctgaaatcagcaaacgtgagaaagccagacttaaagagatgcagaagttgaagaagcagaagattcaagagatgctggagtcgcagaatgcttccattgacgcggatatgaacaataagggaaaagggagactgaagtatcttctgcagcaaactgagttatttgcccactttgctaaaagtgatggatcttcttctcagaagaaggcaaaaggaaggggacgtcatgcttccaaaataactgaagaggaggaagacgaagagtatctaaaggaagaagaggatggcttaactggatctggaaacacacggttactcacacagccctcttgtattcaagggaagatgagagattaccaattagctggtttgaactggctcattcgtctttatgagaatggcataaatggaattcttgctgatgaaatgggtctggggaagacgcttcaaacgatttctttgttggcatatcttcatgaatacaggggaatcaatggtccccatatggtggttgctccaaaatcaacacttggtaattggatgaacgaaattcgccggttttgtcctgtcctacgtgctgtgaagttccttggtaatcctgaggagaggagacatattcgagaagacctgctagttgctgggaaatttgatatttgtgtcacaagctttgagatggccatcaaagagaagacagcacttcgtcggtttagctggcgttatattatcattgatgaagcgcatcgaatcaagaacgagaattcactcctttctaaaaccatgagactttttagcaccaattatcggcttcttatcacggggaccccccttcagaataatctccatgaactgtgggctcttctaaattttcttctgcctgagatttttagttcagcagagacttttgatgaatggtttcaaatttctggtgagaatgaccagcaagaagttgtgcaacaactgcacaaggttcttcgaccatttcttcttcgaagactaaagtcagatgttgagaaaggtttgccaccgaagaaggagaccatacttaaagttggtatgtctcagatgcaaaagcaatactacaaggctttactgcagaaggatcttgaagcggttaatgctggtggagaacgcaaacgtctgctaaacattgcaatgcaactgcgtaaatgctgcaatcacccctatctcttccagggtgcagaacctggtcccccatataccacaggagatcaccttataacaaatgctggtaagatggttctcttggataaattgcttcctaagttgaaagaacgtgattcaagggtgctgatattttctcagatgacaagacttttggatattcttgaggactatttaatgtatcgtggttacttgtattgccgtattgatggaaacactggtggtgacgaacgagatgcctccatagaagcctacaacaagccaggaagtgagaaatttgttttcttgttatctactagagctggagggcttggtatcaatcttgctactgcagatgttgtgatcctttacgatagtgattggaacccacaagtcgacttgcaagctcaggatcgtgcccataggattggtcaaaaaaaagaagttcaagtgtttcgattctgcactgagtctgctattgaggagaaagtgattgaaagagcttacaagaagttagcacttgatgctctggttattcaacaagggagattggcagaacagaaaagtaagtctgtcaataaggatgagttgcttcaaatggtaagatatggtgctgagatggtgttcagttctaaagatagcacaatcacagacgaggatattgatagaatcattgccaaaggagaagaggcaacagctgaacttgatgctaagatgaagaaattcacagaagatgctatacagtttaaaatggatgacagtgctgacttctatgattttgatgatgacaataaggatgaaaacaagctcgattttaaaaagattgtaagcgacaattggaatgatccccccaagcgggagagaaagcgcaactactctgaatctgagtactttaagcaaacattgcggcaaggtgctccagctaaacctaaagagcctagaattccgcgcatgccccagttgcacgatttccagttctttaacattcagagattgaccgagttgtatgaaaaggaagtacgttatctcatgcaaacacatcagaaaaatcagttgaaagacacaattgatgttgaagaaccagaaggtggggatcccttaactactgaagaagtagaagaaaaggagggattattggaggagggtttctcaacatggagcagaagagattttaatactttcctcagggcttgtgagaagtatggccgcaacgacataaaaagcattgcctctgagatggaagggaaaacagaggaagaagttgaaagatatgccaaagtatttaaagagcggtacaaggagctgaacgactatgatagaatcattaagaacattgagaggggagaggcaaggatctctaggaaagacgaaatcatgaaggccatagggaagaaactggatcgctacagaaacccttggctggaactgaagattcaatatggtcagaacaaaggcaagctgtacaatgaagagtgtgaccgtttcatgatctgcatgattcacaaacttggttatgggaattgggatgagctaaaggcagcatttaggacatcgtctgtgttcaggtttgactggtttgtgaaatcccgcacgagtcaggaacttgcaagaagatgcgacactctgattcgactgatcgagaaagagaaccaggagtttgatgaaagagagaggcaagcccgcaaagagaagaagctcgcgaagagtgcaacaccatcaaagcgacctttaggaagacaagcaagtgagagtccttcatcgacgaagaagcggaagcacctgtcgatgagatga

SEQ ID NO: 790 - protein, 1057 aa, Arabidopsis thaliana
  G1243
MARNSNSDEAFSSEEEEERVKDNEEEDEEELEAVARSSGSDDDEVAAADESPVSDGEAAPVEDDYEDEEDEEKAEISKREKARLKEMQKLKKQKIQEMLESQNASIDADMNNKGKGRLKYLLQQTELFAHFAKSDGSSSQKKAKGRGRHASKITEEEEDEEYLKEEEDGLTGSGNTRLLTQPSCIQGKMRDYQLAGLNWLIRLYENGINGILADEMGLGKTLQTISLLAYLHEYRGINGPHMVVAPKSTLGNWMNEIRRFCPVLRAVKFLGNPEERRHIREDLLVAGKFDICVTSFEMAIKEKTALRRFSWRYIIIDEAHRIKNENSLLSKTMRLFSTNYRLLITGTPLQNNLHELWALLNFLLPEIFSSAETFDEWFQISGENDQQEVVQQLHKVLRPFLLRRLKSDVEKGLPPKKETILKVGMSQMQKQYYKALLQKDLEAVNAGGERKRLLNIAMQLRKCCNHPYLFQGAEPGPPYTTGDHLITNAGKMVLLDKLLPKLKERDSRVLIFSQMTRLLDILEDYLMYRGYLYCRIDGNTGGDERDASIEAYNKPGSEKFVFLLSTRAGGLGINLATADVVILYDSDWNPQVDLQAQDRAHRIGQKKEVQVFRFCTESAIEEKVIERAYKKLALDALVIQQGRLAEQKSKSVNKDELLQMVRYGAEMVFSSKDSTITDEDIDRIIAKGEEATAELDAKMKKFTEDAIQFKMDDSADFYDFDDDNKDENKLDFKKIVSDNWNDPPKRERKRNYSESEYFKQTLRQGAPAKPKEPRIPRMPQLHDFQFFNIQRLTELYEKEVRYLMQTHQKNQLKDTIDVEEPEGGDPLTTEEVEEKEGLLEEGFSTWSRRDFNTFLRACEKYGRNDIKSIASEMEGKTEEEVERYAKVFKERYKELNDYDRIIKNIERGEARISRKDEIMKAIGKKLDRYRNPWLELKIQYGQNKGKLYNEECDRFMICMIHKLGYGNWDELKAAFRTSSVFRFDWFVKSRTSQELARRCDTLIRLIEKENQEFDERERQARKEKKLAKSATPSKRPLGRQASESPSSTKKRKHLSMR

SEQ ID NO: 791 - DNA, 738 bp, Arabidopsis thaliana
  G1249
tcgaccgttcttctcaatctcaccaatcggtttaagctgaaaacccgaattagcaaaatcttcgttcgggctgttttggttaatccggtttacatgttttctcattgctcattttcattttcccgccgtgacagagcgcgtaaatctcaaaaccctaaaaatgtcgaacatatacaattcattaccttaatcagattttctcaacagaatcaaaatcaaaatccatggaggaagaagaaggatcaatccgaccagagtttccaatcggaagagtaaagaagataatgaaactggacaaagacatcaacaaaatcaactcagaagctcttcacgtcatcacttactccaccgaactcttcctccacttcctcgccgagaaatctgctgttgttacggcggagaagaagcgtaagactgttaatctcgatcatttaagaatcgccgtgaaaagacaccaacctactagtgatttcctcttagactcgcttccgttgccggctcagcctgtcaaacataccaaatcggtttccgacaagaagattccggcgccgccaattgggactcgtcgtatcgatgatttcttcagtaaagggaaagcaaagactgattcagcctaaagtaaaatttctcattttgttcacaattgcaaattttactctgttctcaaatcaaaatcttgttttgctaaaagtgtagtgagaatgtatggatcatgaggaacttttataggaagcggcc

SEQ ID NO: 792 - protein, 130 aa, Arabidopsis thaliana
  G1249
MEEEEGSIRPEFPIGRVKKIMKLDKDINKINSEALHVITYSTELFLHFLAEKSAVVTAEKKRKTVNLDHLRIAVKRHQPTSDFLLDSLPLPAQPVKHTKSVSDKKIPAPPIGTRRIDDFFSKGKAKTDSA

SEQ ID NO: 793 - DNA, 1538 bp, Arabidopsis thaliana
  G1255
cagctcaaactctctaggactacactaaatctaactttttgcagagagcaaaagattcaataattgagattgatctcaaaaccaaagctctcgtgctcttgtcgttgatgttggttgtgtagactttgtatacaatgatgaaaagtttggcgaatgctgttggagcgaagacggcgagggcttgcgacagctgcgtgaagagacgtgcacggtggtactgcgcggccgacgatgcttttctttgccagtcttgcgacagtttggtccattcagcaaaccctcttgctcgccgccacgagagagtccgtttgaagacggctagcccggcggtcgtaaagcatagcaaccactcatcagcttctcctccacatgaggtcgccacgtggcatcacgggtttactcgtaaagctcgaacgccacgtggctctggtaagaaaaacaattcgtcgatatttcatgacttggttcctgatattagtattgaggatcagacagacaactatgagcttgaagagcagctgatctgtcaagtgccggttctagatccgttggtgtctgagcagttcttgaacgatgtcgttgagcccaagatcgagtttcctatgatcagaagtggtttgatgatcgaggaggaggaagacaacgctgaaagttgtcttaatggatttttcccgaccgacatggagcttgaggagtttgctgctgacgtggagactctgctcggtcgcgggttagacacggagtcgtatgccatggaggagctagggttatctaattcagagatgttcaaaatcgaaaaagatgagattgaagaagaagtagaagagataaaagccatgagcatggatatatttgatgatgatcgaaaagacgtggatggaacagtaccgtttgagctaagctttgattacgagtcgtcacacaagacgtccgaagaagaggtaatgaagaacgttgaaagtagtggtgaatgtgttgttaaggtgaaagaggaagaacataagaatgttctgatgctaagattaaactatgactcggtgatatccacttggggaggtcaaggtccaccgtggagttcaggagagccaccggaacgagacatggacatcagcggttggccagccttttccatggtggagaatggaggagaaagtactcatcagaagcaatacgttggtggatgtttaccatcaagtgggtttggagatggaggtagagaagctagagtttcgagatacagagagaagaggaggacaaggttgttttctaagaagatacggtacgaggtacgtaaattgaatgcagagaaaagaccacgaatgaaaggaagattcgtgaagagagcctcgctcgctgctgctgcttcaccattaggtgttaattactgaatagttaatatctattcatgttatatctcactttacaaatttcggtgaatcttttttcttctgaaacaacagaagttattttggcacttaattgtgctttgaggacttgtatgtacatagaagtaaccaataataatgtgacttttacta

SEQ ID NO: 794 - protein, 416 aa, Arabidopsis thaliana
  G1255
MKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 795 - DNA, 1140 bp, Arabidopsis thaliana
  G1258
gctcatatccatcattctctctgatctcaagaaataatctcaaatctcttacactcatagtcttcaagcaacttctcagattcagctcttatggatcatttgttacaacaccaggatgtttttgggaattataacaaagcaagagaagcaatgggactatcatattcatcaaacccaacaccgttagataacgaccagaagaaaccttctcctgcaacggctgtgacaaggccacagcctccggagctagctctcaggtgtccacgttgcgactcaacaaacacaaagttttgttactacaacaactacagtctcactcagcctcgctacttctgcaaatcatgccggagatattggactaaaggtggaactctaaggaacatccccgtgggtggaggctgccggaaaaacaaacgatccacatcttcggctgcaagaagcctcagaaccactccagaaccggcgtcccacgacgggaaagtcttctcggcggcaggttttaatgggtatagtaacaatgaacatattgatctgagcttagcctttgccttgctgaacaaacaacatccggggagttcttcacagctagggtttcattcagaactcggtagctctcatcagtctgacatggaaggtatgtttgggacaagccaacaaaaagagaacgctacttatgcgtttggtaacgggagcagcggtttgggtgatccaagcagagtcttatggggatttccatggcagatgaatggagagagctttggaatgatgaacataggaggaggtggtggtcatgtagatcagattgattcagggagagagatgtggaccaatatgaactacattaattctggtgctttaatgtagttcaaaattaaaaccccaatattatttgggttttgatttagggtttgaatttcatgttttttaatgggagtagaaaagggtggtagctattttatgaaatggttaaggaagtatagatatattagggcttcttcaaagagtttcaaacttgcaaaatggggttggggtagttcttgttttcgatttctgatctaaattgttgagtttctttatttgtatgttcactatgtttaaatgaaacatttcctttgttgttctaaaaaaaaaaaaaaaaaa

SEQ ID NO: 796 - protein, 257 aa, Arabidopsis thaliana
  G1258
MDHLLQHQDVFGNYNKAREAMGLSYSSNPTPLDNDQKKPSPATAVTRPQPPELALRCPRCDSTNTKFCYYNNYSLTQPRYFCKSCRRYWTKGGTLRNIPVGGGCRKNKRSTSSAARSLRTTPEPASHDGKVFSAAGFNGYSNNEHIDLSLAFALLNKQHPGSSSQLGFHSELGSSHQSDMEGMFGTSQQKENATYAFGNGSSGLGDPSRVLWGFPWQMNGESFGMMNIGGGGGHVDQIDSGREMWTNMNYINSGALM

SEQ ID NO: 797 - DNA, 1340 bp, Arabidopsis thaliana
  G1261
ggatgacgcacaatcccactatccttcgcaagacccttcctctatataaggaagttcatttcatttggagaggacacgctgacaagctgactctagcagatctggtaccgtcgacccacgcgtccgaaaagatcaacttcttcttcttaccaaaactgtcggcgtcgtctcctctaagctcctcccatggaagcagaagaaggtcatcagcgtgaccgcctctgcgactattgcgactcctccgtggctcttgtctactgcaaagctgactccgccaagctctgcctcgcctgcgacaagcaagtccacgtcgccaaccaactcttcgccaaacacttcaggtcacttctctgcgactcctgcaacgaatctccctcttcccttttctgcgagactgaaaggtctgttctttgccagaactgcgactggcaacaccacaccgcctcttcctcccttcatagccgcagaccctttgaaggatttaccggctgtccctccgtgcctgagttgctggccatcgttggcctcgatgacctcactctcgattccggattgctttgggagtcacctgagatcgttagcctcaacgaccttattgtttcgggcgggtcgggtactcataacttccgggccacggatgttcctcctctgcctaagaatcgtcacgccacctgcgggaaatacaaagatgagatgatccgacagctccgtggactatccagatctgagcctggttgtctgaaatttgaaaccccagatgctgagatcgatgccgggttccaattcctagcgccggatttgttttctacatgcgagctggagagtggactgaaatggttcgatcagcaagatcatgaggactttccatattgctctctgctaaagaacttgtcggagtcagatgagaaacctgagaatgtagaccgagagtcatcggtgatggttcccgtttccggctgcttaaaccgatgtgaggaagagactgtgatggttccggttatcactagtacaaggtcgatgacacatgagatcaacagtcttgagaggaactctgctctctctcgctacaaagaaaagaagaagtctcgaaggtacgagaaacacatcaggtatgaatcacgcaaggttcgtgcagaaagcaggacaagaatcaggggacgtttcgccaaggcagcagatccatgaatgatgatgaggttactttgataatcaaaaatcttttgtattaatcgaatcatatagtgtgtatgatcagataagtttttgtattctaagcttaggagttatcactgtatatcgaccacactctcaaaattgtcacttaagaatagtttttttaa

SEQ ID NO: 798 - protein, 332 aa, Arabidopsis thaliana
  G1261
MEAEEGHQRDRLCDYCDSSVALVYCKADSAKLCLACDKQVHVANQLFAKHFRSLLCDSCNESPSSLFCETERSVLCQNCDWQHHTASSSLHSRRPFEGFTGCPSVPELLAIVGLDDLTLDSGLLWESPEIVSLNDLIVSGGSGTHNFRATDVPPLPKNRHATCGKYKDEMIRQLRGLSRSEPGCLKFETPDAEIDAGFQFLAPDLFSTCELESGLKWFDQQDHEDFPYCSLLKNLSESDEKPENVDRESSVMVPVSGCLNRCEEETVMVPVITSTRSMTHEINSLERNSALSRYKEKKKSRRYEKHIRYESRKVRAESRTRIRGRFAKAADP

SEQ ID NO: 799 - DNA, 859 bp, Arabidopsis thaliana
  G1266
caatccactaacgatccctaaccgaaaacagagtagtcaagaaacagagtattttttctacatggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagtaccttgaggagcttttggggtcttctgaaaatagtgggacttggtgaaagattaggatttgtattagggaccttaagtttgaagtggttgattaattttaaccctaatatgttttttgtttgcttaaatatttgattctattgagaaacatcgaaaacagtttgtatgtacttttgtgatacttggcg

SEQ ID NO: 800 - protein, 218 aa, Arabidopsis thaliana
  G1266
MDPFLIQSPFSGFSPEYSIGSSPDSFSSSSSNNYSLPFNENDSEEMFLYGLIEQSTQQTYIDSDSQDLPIKSVSSRKSEKSYRGVRRRPWGKFAAEIRDSTRNGIRVWLGTFESAEEAALAYDQAAFSMRGSSAILNFSAERVQESLSEIKYTYEDGCSPVVALKRKHSMRRRMTNKKTKDSDFDHRSVKLDNVVVFEDLGEQYLEELLGSSENSGTW

SEQ ID NO: 801 - DNA, 1072 bp, Arabidopsis thaliana
  misc_feature (46)..(46): n is a, c, g, or t
  misc_feature (61)..(61): n is a, c, g, or t
  misc_feature (63)..(63): n is a, c, g, or t
  G1267
aagtagagaataataatcacatcaagattgtttataaccctccccntaatcaccttcttantnaccaccctctccggctctcaacagaacaacaacaaaaaaacagcttccgttgtcctgttccggcgaaatcggacggtcgagatcaatcatgcatcgtagagcagcaattcaagaatcggatgacgaagaagatgagacttacaacgacgtcgttcctgaatctccttcttcttgtgaagactcaaagatctcaaaaccaactccaaagaaaaggaggaacgtagagaagagagttgtctcagttccgatagctgacgtggaaggatctaagagcagaggcgaagtatatccaccgtccgattcatgggcctggagaaagtacggacaaaaaccgatcaaaggctcgccttatcccaggggatattacagatgtagtagctcaaaaggatgtccggcgaggaagcaggtggagagaagccgtgtggacccttctaagcttatgattacttacgcctgcgaccacaatcaccctttcccttcctcctccgctaacaccaaatcccaccaccgctcctccgtcgtcctcaaaaccgcaaagaaagaggaagaatacgaagaggaggaagaagaactaaccgtcaccgccgcagaggaaccaccggcgggacttgatctaagccacgtagactcaccgttgctattaggcggctgctacagcgaaatcggagagttcgggtggttctacgacgcgtcgatctcatcatcatctggttcttcgaatttcctcgacgtaactctagagagaggtttttcagtaggccaagaggaagatgagtctttgttcggtgatctcggtgatttacctgattgcgcctccgtgttccgccgtgggactgttgcgacggaggagcaacatcgaagatgtgattttggcgccattcctttctgtgatagttctagatgagtttgtgtgtgtagccaaaaccaaaagaaaaaaacacaatttttttattttccactgtaaaggtgtatcaatggtggattcatttttttaaaaaaaaaaaaaaaa

SEQ ID NO: 802 - protein, 271 aa, Arabidopsis thaliana
  G1267
MHRRAAIQESDDEEDETYNDVVPESPSSCEDSKISKPTPKKRRNVEKRVVSVPIADVEGSKSRGEVYPPSDSWAWRKYGQKPIKGSPYPRGYYRCSSSKGCPARKQVERSRVDPSKLMITYACDHNHPFPSSSANTKSHHRSSVVLKTAKKEEEYEEEEEELTVTAAEEPPAGLDLSHVDSPLLLGGCYSEIGEFGWFYDASISSSSGSSNFLDVTLERGFSVGQEEDESLFGDLGDLPDCASVFRRGTVATEEQHRRCDFGAIPFCDSSR

SEQ ID NO: 803 - DNA, 1166 bp, Arabidopsis thaliana
  G1269
aacaattctctctctctttattcttcttcttcagcttcagatttcagatcttaaatcttcaagtcttcttcttcttcttctgcaaccatggctatgcaggaacgttgtgagagtttatgttctgatgaacttatatcttcctcagatgccttttacctcaagacaagaaagccttataccatcactaaacaaagagagaaatggacagaagcagagcatgagaagtttgtagaagcattgaaactctatggcagagcttggagacgaatcgaagaacatgttggaacaaaaactgcagttcagattcgaagccatgcgcagaagttctttactaaggttgctcgcgattttggtgttagctctgagtccattgagatcccgcctccaaggccaaagagaaagccgatgcatccttaccctagaaagcttgtgattcctgatgcaaaagagatggtatacgctgaactaaccggatccaagctgattcaggatgaagataaccgatctccaacatcggttttatcagctcatggctcagatggattaggttccattggttcaaattcacctaactcttcttcagctgagttatcatctcacacagaggaatcattgtctctagaagcagagaccaaacagagccttaagctctttggaaaaacttttgtagttggtgattacaactcttcaatgagttgtgatgattctgaagatggcaagaagaagctatactcagaaacacagtctcttcaatgttcttcttctacttcagaaaacgctgaaacagaagtggtagtgtcggagttcaaaagaagtgagagatcagctttctctcagttaaaatcgtcggtgactgagatgaacaacatgagagggttcatgccttacaaaaagagagtaaaggtggaagaaaacattgacaatgtaaaattatcatatcctttgtggtgaagtgttcgtttgtgtcaagtcagttgtgtaaactcttttgatctcaacatcagattatgtgtataatgtcagagtattagggaaagtttttttggattagattcgtaagatcactccaaagtttcgtgtctttccatataaccagttagaaattgagatccttgtacttaaacatttttatttgatcaatcaaatcttcttgatgaaaaaaaaaa

SEQ ID NO: 804 - protein, 287 aa, Arabidopsis thaliana
  G1269
MAMQERCESLCSDELISSSDAFYLKTRKPYTITKQREKWTEAEHEKFVEALKLYGRAWRRIEEHVGTKTAVQIRSHAQKFFTKVARDFGVSSESIEIPPPRPKRKPMHPYPRKLVIPDAKEMVYAELTGSKLIQDEDNRSPTSVLSAHGSDGLGSIGSNSPNSSSAELSSHTEESLSLEAETKQSLKLFGKTFVVGDYNSSMSCDDSEDGKKKLYSETQSLQCSSSTSENAETEVVVSEFKRSERSAFSQLKSSVTEMNNMRGFMPYKKRVKVEENIDNVKLSYPLW

SEQ ID NO: 805 - DNA, 585 bp, Arabidopsis thaliana
  G1274
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 806 - protein, 194 aa, Arabidopsis thaliana
  G1274
MNISQNPSPNFTYFSDENFINPFMDNNDFSNLMFFDIDEGGNNGLIEEEISSPTSIVSSETFTGESGGSGSATTLSKKESTNRGSKESDQTKETGHRVAFRTRSKIDVMDDGFKWRKYGKKSVKNNINKRNYYKCSSEGCSVKKRVERDGDDAAYVITTYEGVHNHESLSNVYYNEMVLSYDHDNWNQHSLLRS

SEQ ID NO: 807 - DNA, 748 bp, Arabidopsis thaliana
  G1275
ccaagaaaagggaagatcacgcattcttataggcgtaattcgtaaatagtggtgagtatgaatgatgcagacacaaacttggggagtagtttcagcgatgatactcactctgtgttcgagtttccggagctagacttgtcagatgaatggatggatgatgatcttgtgtctgcggtttccgggatgaatcagtcttatggttatcagactagtgatgttgctggtgctttattctcaggttcttctagctgtttcagtcatcctgaatctccaagtaccaaaacttatgttgctgctacagccactgcttctgccgacaaccaaaacaagaaagaaaagaaaaaaattaaagggagagttgcgttcaagacacggtccgaggtggaagtgcttgacgacgggttcaagtggagaaagtatgggaagaagatggtgaagaacagcccacatccaagaaactactacaaatgttcagttgatggctgtcccgtgaagaaaagggttgaacgagacagagatgatccgagctttgtgataacaacttacgagggttcccacaatcactcaagcatgaactaagactcgaactaaggctcaaggcgaccatgctatattcagcacatcttattttctatggttacgaacgatacttaaaactgcttctagttctttatatccattgtaaactggttgcaggttcacaaattttgagaggtttatgacattctaaatctgtagtacttatata

SEQ ID NO: 808 - protein, 173 aa, Arabidopsis thaliana
  G1275
MNDADTNLGSSFSDDTHSVFEFPELDLSDEWMDDDLVSAVSGMNQSYGYQTSDVAGALFSGSSSCFSHPESPSTKTYVAATATASADNQNKKEKKKIKGRVAFKTRSEVEVLDDGFKWRKYGKKMVKNSPHPRNYYKCSVDGCPVKKRVERDRDDPSFVITTYEGSHNHSSMN

SEQ ID NO: 809 - DNA, 911 bp, Arabidopsis thaliana
  G1277
attctaaagtcctcctctcggaaagtaagagactcaacttccgagccgccatggacgccggagtagcagtaaaagctgacgtggcagtcaaaatgaagagagaaagaccattcaaagggatcagaatgagaaaatgggggaaatgggttgcggagattcgagaacccaacaagcgttcaagactttggctcggctcttactctactcccgaagcggcggcgcgtgcatacgacacggctgtcttttacctcagaggaccaactgctacgctcaacttcccggagcttctgccgtgtacctccgccgaggatatgtcagcggcaacgatcaggaaaaaggcgacggaggtgggagctcaagtagatgcgataggggcgacggtggtgcagaacaacaaacgccgccgcgtttttagtcaaaagcgtgactttggcggcgggttattagagcttgttgacttgaacaagttacctgacccggaaaatctcgatgatgatttggtgggaaaatagactgaaaaataataataaaatatcttacaatggtggctgtagctatcgtacgcggaatgcttgggcttgtgttatatgactacgtggttacggaaagattcctctgtttcgtcattgtattaaaatttaatcccacaagtcaaacatactgtacattattcttaatttagtattttcttattaatatctatcatttgtttggtgaacaccagaatattagactattaatgtaacgagtttttaatatttcgatcataataacaccaagctagttaaaggttaatatcttgttacgaagtcttgagtaagttcaattgtcatatatatgtaacggaagaggttcgttcgggtcccaagtgaagtggatcaaaggtgacttcacataaaaaataaaaaaaa

SEQ ID NO: 810 - protein, 153 aa, Arabidopsis thaliana
  G1277
MDAGVAVKADVAVKMKRERPFKGIRMRKWGKWVAEIREPNKRSRLWLGSYSTPEAAARAYDTAVFYLRGPTATLNFPELLPCTSAEDMSAATIRKKATEVGAQVDAIGATVVQNNKRRRVFSQKRDFGGGLLELVDLNKLPDPENLDDDLVGK

SEQ ID NO: 811 - DNA, 1334 bp, Arabidopsis thaliana
  G1278
ggcgattgggtaagcgatgcacatcgtcttctctgtcgatgatttgaccgaatccttctggcctgttcccgctccggcgccgtcgccgggatcgtcatcgactccgtcaccgacgcagaacgtggcggatgggatgactcgaagtcaatcggagtgggcgttccacaggcttatcaatgagttgtctggttccgattcgagccctacgactaacacaatcgagagatcacctccaccggttcagtctctttcgagattagaagaaaccgttgacgaaaccgaagatgttgttgagattcagaaaccgcagaatcatcgacggctccctgttgatgatcaagggaagaatcggaatcgtgctccgtcgtctgatccggttgattcttcagctcctgttgttgttgatcctaatcagtatcatgcgattcttaagagcaagctcgagcttgcttgcgctgctgttgctcgtcgtgtgggaactgtgaaaccggaagattcgagtgcttcagctagcaatcaaaaacaagctcaaggctccattgtggcacaaacctcacctggtgcttcatctgttagattttctcccacaacaagcacgcaaaagaaacctgatgttccagccagacaaactagtatttcatcacgagatgattctgatgacgatgatcttgatggagacgcagataatggagatcctactgatgtgaagcgtgctaggaggatgctctcaaaccgagaatccgctaggcgctctaggagaagaaagcaagaacaaatgaatgaatttgatacacaggtaggccaattaagagccgagcattcaactttaattaatcgtcttagtgacatgaatcataagtatgatgcagctgctgttgacaacagaattctaagagctgatatcgaaactttgagaacaaaggttaagatggcagaggaaactgtgaaaagagtgacaggagtgaaccctttgcattggtcaagaccaaacatgggcataccattcagcaacacaccgagtgcttcctctagtattccgccaaactctaaccacattttgaaaccagcaaattcaagtaccaacaccagtgctggtttagcacaaaatcagagagtggagacggcaaattttttgccggaacaggtgaaccgtgaaggcatgcagaatccatttgctcctgattttaatctgtatgaaaccctaccccattggaatcccaagcattaaccagaaaaagagtcattggttttgtgattttgattgaggtaactattgtctgtatttttatttactgtatgactcagcgacggtaaactcttaatattatatatat

SEQ ID NO: 812 - protein, 403 aa, Arabidopsis thaliana
  G1278
MHIVFSVDDLTESFWPVPAPAPSPGSSSTPSPTQNVADGMTRSQSEWAFHRLINELSGSDSSPTTNTIERSPPPVQSLSRLEETVDETEDVVEIQKPQNHRRLPVDDQGKNRNRAPSSDPVDSSAPVVVDPNQYHAILKSKLELACAAVARRVGTVKPEDSSASASNQKQAQGSIVAQTSPGASSVRFSPTTSTQKKPDVPARQTSISSRDDSDDDDLDGDADNGDPTDVKRARRMLSNRESARRSRRRKQEQMNEFDTQVGQLRAEHSTLINRLSDMNHKYDAAAVDNRILRADIETLRTKVKMAEETVKRVTGVNPLHWSRPNMGIPFSNTPSASSSIPPNSNHILKPANSSTNTSAGLAQNQRVETANFLPEQVNREGMQNPFAPDFNLYETLPHWNPKH

SEQ ID NO: 813 - DNA, 2083 bp, Arabidopsis thaliana
  G1290
aattccactgttattagactcttgactctgttttgtttcccgccgatctcgtgatgatggccaccaccaccaccaccaccaccgctagattctctgattcatacgagttcagcaacacaagcggcaatagcttcttcgccgccgagtcatctcttgattatccgacggaatttctcacgccaccggaggtatcagctcttaaacttctgtctaactgcctcgagtctgttttcgactcgccggagacgttctacagcgatgctaagctagttctcgccggcggccgggaagtttcttttcaccgttgtattctttccgcgagaattcctgtcttcaaaagcgctttagccaccgtgaaggaacaaaaatcctccaccaccgtgaagctccagctgaaagagatcgccagagattacgaagtcggctttgactcggttgtggcggttttggcgtatgtttacagcggcagagtgaggtccccgccgaagggagcttctgcttgcgtagacgacgattgttgccacgtggcttgccggtcaaaggtggatttcatggtggaggttctttatctgtctttcgttttccagattcaagaattagttactctgtatgagaggcagttcttggaaattgtagacaaagttgtagtcgaagacatcttggttatattcaagcttgatactctatgtggtacaacatacaagaagcttttggatagatgcatagaaattatcgtgaagtctgatatagaactagttagtcttgagaagtctttacctcaacacattttcaagcaaatcatagacatccgcgaagcgctctgtctagagccacctaaactagaaaggcatgtcaagaacatatacaaggcgctagactcagatgatgttgagcttgtcaagatgcttttgctagaaggacacaccaatctcgatgaggcgtatgctcttcattttgctatcgctcactgcgctgtgaagaccgcgtatgatctcctcgagcttgagcttgcggatgttaaccttagaaatccgaggggatacactgtgcttcatgttgctgcgatgcggaaggagccgaagttgataatatctttgttaatgaaaggggcaaatattttagacacaacattggatggtagaaccgctttagtgattgtaaaacgactcactaaagcggatgactacaaaactagtacggaggacggtacgccttctctgaaaggcggattatgcatagaggtacttgagcatgaacaaaaactagaatatttgtcgcctatagaggcttcactttctcttccagtaactccagaggagttgaggatgaggttgctctattatgaaaaccgagttgcacttgctcgacttctctttccagtggaaactgaaactgtacagggtattgccaaattggaggaaacatgcgagtttacagcttctagtctcgagcctgatcatcacattggtgaaaagcggacatcactagacctaaatatggcgccgttccaaatccatgagaagcatttgagtagactaagagcactttgtaaaaccgtggaactggggaaacgctacttcaaacgatgttcgcttgatcactttatggatactgaggacttgaatcatcttgctagcgtagaagaagatactcctgagaaacggctacaaaagaagcaaaggtacatggaactacaagagactctgatgaagacctttagtgaggacaaggaggaatgtggaaagtcttccacaccgaaaccaacctctgcggtgaggtctaatagaaaactctctcaccggcgcctaaaagtggacaaacgggattttttgaaacgaccttacgggaacggggattaaggaatgggaaatcatattccatttcactcccacaactaaaaatgatgtatgtcctatatcatgatgtttcgtgagtttcaaataaattgaaacgtacatatatcagtttttcatctacgtgactgcgttgtatagttttcgttcttcacttagcatcatgtgtattctagctccaagtgcgtttcaaacaaatatagttatttttagccaattatatatacggt

SEQ ID NO: 814 - protein, 601 aa, Arabidopsis thaliana
  G1290
MMATTTTTTTARFSDSYEFSNTSGNSFFAAESSLDYPTEFLTPPEVSALKLLSNCLESVFDSPETFYSDAKLVLAGGREVSFHRCILSARIPVFKSALATVKEQKSSTTVKLQLKEIARDYEVGFDSVVAVLAYVYSGRVRSPPKGASACVDDDCCHVACRSKVDFMVEVLYLSFVFQIQELVTLYERQFLEIVDKVVVEDILVIFKLDTLCGTTYKKLLDRCIEIIVKSDIELVSLEKSLPQHIFKQIIDIREALCLEPPKLERHVKNIYKALDSDDVELVKMLLLEGHTNLDEAYALHFAIAHCAVKTAYDLLELELADVNLRNPRGYTVLHVAAMRKEPKLIISLLMKGANILDTTLDGRTALVIVKRLTKADDYKTSTEDGTPSLKGGLCIEVLEHEQKLEYLSPIEASLSLPVTPEELRMRLLYYENRVALARLLFPVETETVQGIAKLEETCEFTASSLEPDHHIGEKRTSLDLNMAPFQIHEKHLSRLRALCKTVELGKRYFKRCSLDHFMDTEDLNHLASVEEDTPEKRLQKKQRYMELQETLMKTFSEDKEECGKSSTPKPTSAVRSNRKLSHRRLKVDKRDFLKRPYGNGD

SEQ ID NO: 815 - DNA, 1000 bp, Arabidopsis thaliana
  G1300
gtcttcttcaattattctattccctctgagagattctctctgcgtttcttagatcgagcgagcgaagcgagagatcatggaaggtggagctgctctctacaatcctcgaactgtcgaagaagttttcaaggatttcaaaggtcgtcgtactgccattgtcaaagctctcaccaccgatgttcaagagttttaccaacaatgtgaccctgagaaggagaatctttgcttgtatgggttaccgaatgaagaatgggaagtgaatttaccagctgaagaagtgcctcctgagttaccagagccagctcttggtattaactttgctagggatgggctctctgaaaaggaatggctttcgcttgttgctattcacagtgacgcttggttactgtctgtctcgttttactttggctcaaggttttctttccacaaggaagagaggaagcgtttgttcaacatgatcaatgatgttcctactatatttgaagtagtgactggaatggctaaagcaaaggacaagtcatctgctgcaaatcaaaacggaaacaaatccaagtctaactctaaagttagaacttcagagggaaaaagctcaaagaccaagcagccaaaagaggaggacgaagaaatagatgaagatgatgaggatgaccacggggaaaccctttgtggagcctgtggagacagtgatggtgctgatgaattctggatctgctgtgacctttgtgagaagtggttccatggcaagtgtgtgaagatcactccagctagagctgagcatatcaaacaatacaagtgcccttcatgcagcaacaaaagagctcgagcttaaaaatgttgtattgtagagaatagcctgtagtgacaactctcactaccctcgatctgtctttatttggctagtcttttagctcgttattggccataacagcttgggcctatttctctgtataattggtttgattttgcaactgagaaaaaaaaggaaactctttaactgaaa

SEQ ID NO: 816 - protein, 250 aa, Arabidopsis thaliana; identical to SEQ ID NO: 782
  G1300

SEQ ID NO: 817 - DNA, 978 bp, Arabidopsis thaliana
  G1304
atggggcgatcaccatgttgcgatgagaatggtctaaagaaagggccatggacacaagaggaggatgataaactgatagatcacattcaaaaacatggccatggcagctggagagctcttccaaagcaagccggtttaaaccgatgcggaaagagttgtagattaagatggaccaactacttgagacctgacatcaagagaggaaatttcactgaagaggaagaacaaactattatcaacctccattcccttcttggaaacaagtggtcgtcgatagccggtaatcttcctggaagaacggacaatgaaataaaaaactattggaacacacatttgagaaagaaacttctccaaatggggattgatccggtgacccataggccaagaaccgaccatctaaacgttttagcagctctcccgcagcttatagccgccgcaaatttcaacagcctcttgaatctcaaccaaaatgtgcaactggatgcaacaactcttgctaaagctcaactgctacacactatgattcaagtccttagcaccaataacaacaccaccaatccttctttttcttcatcaactatgcaaaacagtaacaccaatctctttggccaagcttcttacttagagaaccaaaatctttttggtcagtctcaaaacttctctcacattcttgaggatgagaatttgatggtcaaaacccaaattattgataaccctttggactctttttcttcccccatacaacccggttttcaagatgatcataattcactccctctattggttccggcgtctcctgaagaatctaaagaaactcaaaggatgatcaagaacaaagacatcgtcgattaccatcatcatgatgcttcaaacccttcatcatcaaactcaacgtttacacaagatcatcatcacccatggtgtgacactattgatgatggagcaagtgattctttttggaaagagataatagagtaa

SEQ ID NO: 818 - protein, 325 aa, Arabidopsis thaliana
  G1304
MGRSPCCDENGLKKGPWTQEEDDKLIDHIQKHGHGSWRALPKQAGLNRCGKSCRLRWTNYLRPDIKRGNFTEEEEQTIINLHSLLGNKWSSIAGNLPGRTDNEIKNYWNTHLRKKLLQMGIDPVTHRPRTDHLNVLAALPQLIAAANFNSLLNLNQNVQLDATTLAKAQLLHTMIQVLSTNNNTTNPSFSSSTMQNSNTNLFGQASYLENQNLFGQSQNFSHILEDENLMVKTQIIDNPLDSFSSPIQPGFQDDHNSLPLLVPASPEESKETQRMIKNKDIVDYHHHDASNPSSSNSTFTQDHHHPWCDTIDDGASDSFWKEIIE

SEQ ID NO: 819 - DNA, 720 bp, Arabidopsis thaliana
  G1305
atggggaatagaagagcaccatgctgtgacaaaagccaagtgaagagagggccatggagtgatgaagaaagtgaaagactcagatcttttatcctcaaaaatggtcatcaaaattggcgatctcttcccaaactcgctggattgatgagatgcggaaagagttgtcgtctaagatggataaactatctgagaccaggtctcaaacgaggcaacttcaccaaggaggaggaagataccattatccaccttcaccaagcttatggaaacaagtggtctaagatcgcatccaacttcccgggaaggacagacaacgagatcaagaatgtatggaacactcatctcaagaagcggttggtgaagaggagcatttcatcatcatcatccgatgttaccaatcattcagtgtcttctacctcttcttcctcttcctcaatctcgtcagtcttgcaggacgttattattaagagtgagaggcctaaccaggaagaggagtttggggaaatcttggtggagcaaatggcatgtggatttgaggtggatgcaccacaatcactagaatgtctctttgacgatagccaggttcctcctcctatatctaaaccagactcactacaaacccatgggaagtcatcagatcacgaattttggagccgactgattgaaccagggttcgatgattacaatgagtggctcattttcttggataaccaaacttgctag

SEQ ID NO: 820 - protein, 239 aa, Arabidopsis thaliana
  G1305
MGNRRAPCCDKSQVKRGPWSDEESERLRSFILKNGHQNWRSLPKLAGLMRCGKSCRLRWINYLRPGLKRGNFTKEEEDTIIHLHQAYGNKWSKIASNFPGRTDNEIKNVWNTHLKKRLVKRSISSSSSDVTNHSVSSTSSSSSSISSVLQDVIIKSERPNQEEEFGEILVEQMACGFEVDAPQSLECLFDDSQVPPPISKPDSLQTHGKSSDHEFWSRLIEPGFDDYNEWLIFLDNQTC

SEQ ID NO: 821 - DNA, 994 bp, Arabidopsis thaliana
  misc_feature (13)..(13): n is a, c, g, or t
  misc_feature (15)..(15): n is a, c, g, or t
  misc_feature (17)..(17): n is a, c, g, or t
  misc_feature (20)..(20): n is a, c, g, or t
  misc_feature (23)..(23): n is a, c, g, or t
  misc_feature (38)..(40): n is a, c, g, or t
  misc_feature (42)..(42): n is a, c, g, or t
  misc_feature (44)..(44): n is a, c, g, or t
  misc_feature (60)..(60): n is a, c, g, or t
  misc_feature (70)..(70): n is a, c, g, or t
  misc_feature (72)..(72): n is a, c, g, or t
  misc_feature (78)..(78): n is a, c, g, or t
  misc_feature (93)..(93): n is a, c, g, or t
  misc_feature (96)..(96): n is a, c, g, or t
  misc_feature (101)..(101): n is a, c, g, or t
  misc_feature (103)..(104): n is a, c, g, or t
  misc_feature (108)..(108): n is a, c, g, or t
  misc_feature (110)..(110): n is a, c, g, or t
  misc_feature (117)..(117): n is a, c, g, or t
  G1307
cccttattgggcntnancgnccncccggcaggtctagnnntnancgcccgcgtccttctnccattttacncncttgcngcccacccttgtatntcnttttntnngtgntntttttcntgagggggcaacggaaaaaagaatgggaagagcaccatgttgtgagaaaatgggggtgaagagaggaccatggactcctgaagaagatcaaatcttgatcaattatattcatctttatggtcattctaattggcgagctctcccaaaacacgcaggtttacttagatgtgggaaaagttgcagacttggttggatcaattatcttagaccagacattaaacgtggcaatttcactcctcaagaagaacaaactattatcaatctgcatgaaagcttaggcaacagatggtctgcgattgctgcaaaattgccgggacgaaccgacaatgaaataaaaaatgtttggcacactcatttgaagaaaagactcagcaaaaatctaaacaatggcggagacaccaaagacgttaacggaattaacgagaccacaaatgaagacaaaggatctgtgatagtcgacacagcctctttacaacaattttctaatagtattacaacatttgatatttcaaatgataacaaggacgatattatgtcgtacgaggatatttctgccttgatagatgatagtttttggtcggacgtcatatcggtagataattcgaataagaatgagaagaagatagaggattgggaaggattgatcgatagaaatagtaaaaaatgtagctatagtaattctaagttgtataatgatgacatggagttttggtttgatgttttcactagtaatcgtagaattgaggaattttccgacatacccgagttttaattttgattttgattttgtgttgtttttgtcgttaagactttgaaagtctttttgtaatccaaatgaataaattccttttctttttaaaaaaaaaaaaaaaaaaaa

SEQ ID NO: 822 - protein, 249 aa, Arabidopsis thaliana
  G1307
MGRAPCCEKMGVKRGPWTPEEDQILINYIHLYGHSNWRALPKHAGLLRCGKSCRLGWINYLRPDIKRGNFTPQEEQTIINLHESLGNRWSAIAAKLPGRTDNEIKNVWHTHLKKRLSKNLNNGGDTKDVNGINETTNEDKGSVIVDTASLQQFSNSITTFDISNDNKDDIMSYEDISALIDDSFWSDVISVDNSNKNEKKIEDWEGLIDRNSKKCSYSNSKLYNDDMEFWFDVFTSNRRIEEFSDIPEF

SEQ ID NO: 823 - DNA, 1292 bp, Arabidopsis thaliana
  misc_feature (11)..(11): n is a, c, g, or t
  G1308
ctttgattccnatcttcttctcttaattttcactttgggctttctctgtctctcctattatgagtctaaaagtctactagctgttcaatagttttgtctttctgtgtttctcttcttcaaaaccgaaagaaattcaaaaagagtctttcgctgcttgttagtggggtgaggaacaaatgggaagaacaccttgttgtgacaagattggtttgaagaaaggtccttggacgcctgaagaagatgaggttcttgttgcgcatatcaagaaaaatggacatggaagctggagaacacttcctaaacttgctggtttacttcgctgtgggaagagttgcaggctgagatggacaaactatctgagaccagacataaagagaggtcctttcactgctgatgaagagaaacttgttatccagcttcatgccattctcggcaacaggtgggctgctattgcagcacagcttccaggaagaacagacaacgagatcaagaacttatggaacactcatttgaagaaacgtcttttatctatgggtcttgatcccagaactcatgagccattaccttcatatgggttagctaaacaagctccatcttcaccaacaactcgccacatggctcaatgggaaagtgctagggttgaagctgaggcaaggctttctagagaatcaatgctctttagcccttctttttactctggtgtagtaaaaactgaatgtgatcacttcttacgcatttggaattccgagattggtgaagctttcaggaatctcgctccattagatgaatcaactattactagtcaaagcccttgctcgagggcaacatcgacctcatctgcacttctgaagagctcaacaaattcttggggagggaaagaggttactgtggcgattcatggctcagattattctccatattcaaatgatcttgaagatgattcaacagactctgctcttcaacttctgcttgatttccctataagcgatgatgatatgagcttcttggaagagaacattgacagctactcacaggctcctcctattggtcttgtttccatggtttccaaattctagtcttatgagagcctaatatctaagaaaaagattcaaactttgcttccttttggtttttagtgatgataagtagggatatagtatctatgtaaatcagcattagttagttgaagtacttaatcaaccctttcttttatgatttgatcatgtttgagaaaattgcagaacattaaacaattaaccattcaaaaaaaaaaaaaaaaaaaaaaaaaaaaa

SEQ ID NO: 824 - protein, 299 aa, Arabidopsis thaliana
  G1308
MGRTPCCDKIGLKKGPWTPEEDEVLVAHIKKNGHGSWRTLPKLAGLLRCGKSCRLRWTNYLRPDIKRGPFTADEEKLVIQLHAILGNRWAAIAAQLPGRTDNEIKNLWNTHLKKRLLSMGLDPRTHEPLPSYGLAKQAPSSPTTRHMAQWESARVEAEARLSRESMLFSPSFYSGVVKTECDHFLRIWNSEIGEAFRNLAPLDESTITSQSPCSRATSTSSALLKSSTNSWGGKEVTVAIHGSDYSPYSNDLEDDSTDSALQLLLDFPISDDDMSFLEENIDSYSQAPPIGLVSMVSKF

SEQ ID NO: 825 - DNA, 912 bp, Arabidopsis thaliana
  G1309
cgtcgacctcttaattaagacgacttgagagagaaagaaagatacgtggaagatgaccaaatctggagagagaccaaaacagagacagaggaaagggttatggtcacctgaagaagaccagaagctcaagagtttcatcctctctcgtggccatgcttgctggaccactgttcccatcctagctggattgcaaaggaatgggaaaagctgcagattaaggtggattaattacctaagaccaggactaaagagggggtcgtttagtgaagaagaagaagagaccatcttgactttacattcttccttgggtaacaagtggtctcggattgcaaaatatttaccgggaagaacagacaacgagattaagaactattggcattcctatctgaagaagagatggctcaaatctcaaccacaactcaaaagccaaatatcagacctcacagaatctccttcttcactactttcttgcgggaaaagaaatctggaaaccgaaaccctagatcacgtgatctccttccagaaattttcagagaatccaacttcatcaccatccaaagaaagcaacaacaacatgatcatgaacaacagtaataacttgcctaaactgttcttctctgagtggatcagttcttcaaatccacacatcgattactcctctgcttttacagattccaagcacattaatgaaactcaagatcaaatcaatgaagaggaagtgatgatgatcaataacaacaactactcttcacttgaggatgtcatgctccgtacagattttttgcagcctgatcatgaatatgcaaattattattcttctggagatttcttcatcaacagtgaccaaaattatgtctaagaagagtgaatatgatcgtaagaggaacataagctagttacttgtgttacagc

SEQ ID NO: 826 - protein, 268 aa, Arabidopsis thaliana
  G1309
MTKSGERPKQRQRKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKRWLKSQPQLKSQISDLTESPSSLLSCGKRNLETETLDHVISFQKFSENPTSSPSKESNNNMIMNNSNNLPKLFFSEWISSSNPHIDYSSAFTDSKHINETQDQINEEEVMMINNNNYSSLEDVMLRTDFLQPDHEYANYYSSGDFFINSDQNYV

SEQ ID NO: 827 - DNA, 800 bp, Arabidopsis thaliana
  G1311
aagtataataacacaaagaaacagagtaaaagaaagaaaaatggattttaagaaggaagaaacacttcgtagagggccatggctcgaagaagaagacgaacggctagtgaaggtcattagtcttttgggagaacgtcgttgggattctttagcaatagtttccggtttgaagaggagtggtaagagttgcaggctaaggtggatgaactatctgaatccgactctgaagcgtggaccgatgagtcaagaagaagagagaatcatctttcagctccatgctctatggggtaacaagtggtcgaagattgcgagaagattacccggtaggactgataacgagataaagaactattggagaactcattatagaaagaaacaggaagctcaaaactatggaaagctctttgagtggagaggaaatacaggagaagaattgttgcacaagtataaggaaacagagatcactaggacaaagacgacgtctcaagaacatggttttgttgaagttgtgagcatggaaagtggtaaagaagccaacggtggtgttggtggaagagaaagcttcggtgttatgaaatcaccgtatgaaaatcggatttcggattggatatcagagatttctactgaccagagtgaagcaaatctttcagaagatcacagcagcaatagctgcagtgagaacaatattaacattggtacttggtggtttcaagagactagggactttgaggagttttcatgttctctatggtcataattctaaagttggtttatttactttttaaaaaaaaaaaaaaaaa

SEQ ID NO: 828 - protein, 238 aa, Arabidopsis thaliana
  G1311
MDFKKEETLRRGPWLEEEDERLVKVISLLGERRWDSLAIVSGLKRSGKSCRLRWMNYLNPTLKRGPMSQEEERIIFQLHALWGNKWSKIARRLPGRTDNEIKNYWRTHYRKKQEAQNYGKLFEWRGNTGEELLHKYKETEITRTKTTSQEHGFVEVVSMESGKEANGGVGGRESFGVMKSPYENRISDWISEISTDQSEANLSEDHSSNSCSENNINIGTWWFQETRDFEEFSCSLWS

SEQ ID NO: 829 - DNA, 1356 bp, Arabidopsis thaliana
  G1313
atgagttacacgagcactgacagtgaccataatgagtcaccagctgctgatgataatggaagtgactgcagaagtagatgggatggtcatgctctcaagaaaggcccttggagttcagctgaagatgatattcttattgactatgtgaataagcatggtgagggtaactggaatgctgtgcagaaacacaccagcttgtttcgttgtggtaaaagctgtcgtctaagatgggctaatcatctgaggccaaatttgaagaaaggagcttttagtcaagaagaagaacagcttatcgttgaattgcatgccaagatgggtaatagatgggcacgtatggctgcacatttgcctggccgaacggataatgagataaagaattattggaacactcgtatcaagaggcgacaacgagctggtttgccactttatcctcctgagatgcatgttgaggcacttgagtggagtcaagagtatgccaagagtagagttatgggagaagatagaagacatcaagatttcttgcagctggggagttgtgaatctaatgtcttctttgatactcttaattttaccgacatggtacctggtacttttgatctagcagatatgactgcctacaaaaatatgggtaactgtgcaagttctcctcgatatgaaaacttcatgacaccaacaatcccctcctcgaagcgactttgggaatctgagttgttgtatcctgggtgtagcagtaccataaagcaagaattctcgtcgcctgaacaattccggaacacatctccacaaacgatttccaaaacttgcagcttctcagttccttgtgatgttgagcatcctctctatggaaaccgacattcacctgttatgattccagatagccatacccctacggatggcattgttccttattctaagcccttatatggggcagtgaagctggagctcccttcattccaatattcagaaacaacatttgaccagtggaagaaatcgtcatctcctccacactctgatctccttgatccctttgatacttacattcagtctccaccaccaccaacggggggagaagagtcagatttatattcaaattttgatactggtctgctcgatatgttgcttctggaagccaagatcagaaataatagtacaaagaacaatttgtacaggagctgcgcttcaactattccatcagctgatcttggccaggttactgtatcccaaactaaatccgaggagtttgacaattcccttaagagcttcttggttcattccgaaatgtccacacaaaatgcagatgaaactccaccaagtgagttactattcaccttaccatcacttgaaatagtttgttga

SEQ ID NO: 830 - protein, 451 aa, Arabidopsis thaliana
  G1313
MSYTSTDSDHNESPAADDNGSDCRSRWDGHALKKGPWSSAEDDILIDYVNKHGEGNWNAVQKHTSLFRCGKSCRLRWANHLRPNLKKGAFSQEEEQLIVELHAKMGNRWARMAAHLPGRTDNEIKNYWNTRIKRRQRAGLPLYPPEMHVEALEWSQEYAKSRVMGEDRRHQDFLQLGSCESNVFFDTLNFTDMVPGTFDLADMTAYKNMGNCASSPRYENFMTPTIPSSKRLWESELLYPGCSSTIKQEFSSPEQFRNTSPQTISKTCSFSVPCDVEHPLYGNRHSPVMIPDSHTPTDGIVPYSKPLYGAVKLELPSFQYSETTFDQWKKSSSPPHSDLLDPFDTYIQSPPPPTGGEESDLYSNFDTGLLDMLLLEAKIRNNSTKNNLYRSCASTIPSADLGQVTVSQTKSEEFDNSLKSFLVHSEMSTQNADETPPSELLFTLPSLEIVC

SEQ ID NO: 831 - DNA, 990 bp, Arabidopsis thaliana
  G1314
atgggaagagctccgtgttgcgacaagacaaaagtgaagcgagggccttggtcgcctgaagaagactctaaacttagagattacattgaaaagtatggtaatggtggaaattggatctctttccccctcaaagccggtttgaggagatgtgggaagagttgtagactgaggtggctaaactatttgagaccaaacataaagcatggtgacttctctgaggaagaagacaggatcatttttagtctcttcgctgccataggaagcaggtggtcaataatagcagctcatctaccgggacgaacagacaacgacataaaaaactattggaacacaaagctaaggaagaaactcttgtcttcttcctctgattcatcatcatcagccatggcttctccttatctaaaccctatttctcaggatgtgaaaagaccaacctcaccaacaacaatcccatcttcttcttacaatccgtatgctgaaaaccctaatcaatacccaacaaaatccctcatctccagcatcaatggcttcgaagctggtgacaaacagataatttcctatattaaccctaattatcctcaagatctctatctctcggacagcaacaacaacacctcgaacgcaaatggtttcttgctcaaccacaatatgtgtgatcagtacaagaaccacaccagtttttcttcagacgtcaatgggataagatcagagattatgatgaagcaagaagagataatgatgatgatgatgatagaccaccacattgaccagaggacaaaagggtacaatggggaattcacacaagggtattataattactacaatgggcatggggatttgaagcaaatgattagtggaacaggcactaattctaacataaacatgggtggttcaggttcatcttctagttcgataagcaacctagctgagaacaaaagcagtggtagcctcctactagaatacaaatgcttgccctatttctactcctag

SEQ ID NO: 832 - protein, 329 aa, Arabidopsis thaliana
  G1314
MGRAPCCDKTKVKRGPWSPEEDSKLRDYIEKYGNGGNWISFPLKAGLRRCGKSCRLRWLNYLRPNIKHGDFSEEEDRIIFSLFAAIGSRWSIIAAHLPGRTDNDIKNYWNTKLRKKLLSSSSDSSSSAMASPYLNPISQDVKRPTSPTTIPSSSYNPYAENPNQYPTKSLISSINGFEAGDKQIISYINPNYPQDLYLSDSNNNTSNANGFLLNHNMCDQYKNHTSFSSDVNGIRSEIMMKQEEIMMMMMIDHHIDQRTKGYNGEFTQGYYNYYNGHGDLKQMISGTGTNSNINMGGSGSSSSSISNLAENKSSGSLLLEYKCLPYFYS

SEQ ID NO: 833 - DNA, 1011 bp, Arabidopsis thaliana
  G1315
tttttcttttcccttcttctctttcaaaaaacaaaacaaagatatctcaaccggaacacttagaccaagagagacagatagagagatgggtagggctccatgttgtgacaaggcaaatgtgaagagaggtccatggtctcctgaagaagacgcaaagcttaaagattacatcgagaaacaaggaactggtggcaattggattgctctccctcacaaagctggtttaaggagatgtgcgaagagttgcagactgagatggttaaattatttgagaccaaacataagacatggagatttcactgaagaagaagacaatattatctacagcctctttgcctccattggaagcaggtggtcagtaatagcagctcacttgcaaggtagaactgataatgacatcaagaactattggaacactaagctcaagaagaagctcatagccaccatggctcctcctccacatcaccacttagccattgctacatcatcatcatcagcatccccatcatcatcatcacattacaacatgatcaatagtcttcttccgtataacccatcaacaaaccaacttctcacacctcatcagggtatcatgatgacaatgatgggccaacaacaacaactattttatcaagaagacatgggcaatttggtaaattctccaaacagaaacaatctcataatgagccatcaagaagacaaccaagagcaaagtacaaacaagggaataatgttgttgagtgatgtaagaagtgggtcgagtacaacaagtacagtaacaagagtgaagatggaacatcgtgatcatgatgatcatcatcatcatgaagaagatgagagatcaatgacctcggtagtgatggaagattatggaatggaggagatcaagcaattaataagtagtagttgtacgagtagtaacaatagcttgtggtttgacgaaaacaagacggaggataagttcatgttgtactactgatctcgagtaccaactttgatttaatctccaaa

SEQ ID NO: 834 - protein, 297 aa, Arabidopsis thaliana
  G1315
MGRAPCCDKANVKRGPWSPEEDAKLKDYIEKQGTGGNWIALPHKAGLRRCAKSCRLRWLNYLRPNIRHGDFTEEEDNIIYSLFASIGSRWSVIAAHLQGRTDNDIKNYWNTKLKKKLIATMAPPPHHHLAIATSSSSASPSSSSHYNMINSLLPYNPSTNQLLTPHQGIMMTMMGQQQQLFYQEDMGNLVNSPNRNNLIMSHQEDNQEQSTNKGIMLLSDVRSGSSTTSTVTRVKMEHRDHDDHHHHEEDERSMTSVVMEDYGMEEIKQLISSSCTSSNNSLWFDENKTEDKFMLYY

SEQ ID NO: 835 - DNA, 976 bp, Arabidopsis thaliana
  G1316
ctctcttgtttatatttttgactaactcaagctctctcggttttgctttaattcagcattagttatatgtgtgatttattagcttgccttagaaaaatttcaatggggagaaaaccgtgctgtgacaaaattggattgaagagaggtccatggactatagaagaagatcatagactcatgaacttcattcttaacaatggcatccactgctggagaattgtccccaaactcgcaggtttgttgagatgcgggaagagctgtagattgagatggatcaattatttgagacccgatctcaagagaggtggtttcactgatgctgaagaagatcggattatggaacttcactctcaacttggcaaccggtggtctaaaattgcctcgcatttctctggtcgaacggataacgagatcaaaaaccactggaatacgaagatcaagaagaagatgaaacatcttgggttggatccggctacgcacaaaccgatgaatgatattactcatcaaaccgatcctaatcaagataaaaaaccaaatatgtgttctaccatcaatgaaggagaagagatcaaggatcaaactccaaaagatgatgttatcacagaaacaacaaaaacattaatgttatctgataatgatgaggaacttgtggcgaaaaactgcaaaatcctatgtgcagaagaagtagacttggaatctctatttgaaacgcaatgcaatgagatatcctcttcgtctttctcttcactatgtagtaatatttcaagaagtgaatcttcctcatatcttgcagaagattcgatctctttagagcaatgggacttggatatgacggatccttttgtaccatgggacctcttcgccaatcttgatgataatcttttcctcttatgatgaatgtactataacattgtaatataatatatctatataattatcgcaagtaattagcagtttcttttaaaaaaaaaaaaaa

SEQ ID NO: 836 - protein, 275 aa, Arabidopsis thaliana
  G1316
MCDLLACLRKISMGRKPCCDKIGLKRGPWTIEEDHRLMNFILNNGIHCWRIVPKLAGLLRCGKSCRLRWINYLRPDLKRGGFTDAEEDRIMELHSQLGNRWSKIASHFSGRTDNEIKNHWNTKIKKKMKHLGLDPATHKPMNDITHQTDPNQDKKPNMCSTINEGEEIKDQTPKDDVITETTKTLMLSDNDEELVAKNCKILCAEEVDLESLFETQCNEISSSSFSSLCSNISRSESSSYLAEDSISLEQWDLDMTDPFVPWDLFANLDDNLFLL

SEQ ID NO: 837 - DNA, 849 bp, Arabidopsis thaliana
  G1317
atgggaagatcaccttgttgtgataaaaatggagtgaagaagggaccatggactgctgaggaggatcagaaactcatcgattatattcgatttcatggtcctggcaattggcgtacgctccccaaaaatgctggactccatagatgtggaaaaagctgccgtcttcgatggaccaattatctaagaccggacatcaagagaggaagattctcgttcgaggaagaagaaactatcattcagctacacagtgttatgggaaacaagtggtcagcaatagccgctcgtctaccagggaggaccgataacgaaataaaaaaccattggaacactcacatccgcaagagacttgtaaggagtggtatcgaccctgttactcattctccacgccttgatcttcttgatttgtcctcacttttgagtgcacttttcaaccagccaaacttttcagcagttgcaacacatgcgtcttctcttcttaatcctgatgtattgaggttggcctctctactactgccacttcaaaaccctaatccagtttacccatcgaacctcgaccaaaatcttcaaactccaaatacatcatcagaatcgtctcaaccacaagctgagactagtacagtcccaacaaactatgaaacttcatcattggagcctatgaacgcaagactcgacgacgttggtcttgcagatgtattaccacctttgtcagagagttttgacttagactcgctcatgtcaacgccaatgtcttctccacgacaaaatagcattgaagcagaaaccaactccagcactttcttcgactttggaattccggaagatttcatcttagatgactttatgttttaa

SEQ ID NO: 838 - protein, 282 aa, Arabidopsis thaliana
  G1317
MGRSPCCDKNGVKKGPWTAEEDQKLIDYIRFHGPGNWRTLPKNAGLHRCGKSCRLRWTNYLRPDIKRGRFSFEEEETIIQLHSVMGNKWSAIAARLPGRTDNEIKNHWNTHIRKRLVRSGIDPVTHSPRLDLLDLSSLLSALFNQPNFSAVATHASSLLNPDVLRLASLLLPLQNPNPVYPSNLDQNLQTPNTSSESSQPQAETSTVPTNYETSSLEPMNARLDDVGLADVLPPLSESFDLDSLMSTPMSSPRQNSIEAETNSSTFFDFGIPEDFILDDFMF

SEQ ID NO: 839 - DNA, 1142 bp, Arabidopsis thaliana
  G1319
catcaatacattaccaagaaaccagagtttttcttcattgttcttttccacagcattgcaacatgaagagacattcttgttgttacaaacaaaagctgagaaaaggtctttggtctcctgaagaagatgagaaacttctcaattacattaccaaacatggccatggttgctggagttctgtccctaaactcgcaggtctcgagagatgtggaaagagctgtagactcagatggatcaattacttaagacctgatttaaagagaggagctttctcttcagaggaacagaatctcattgtcgagcttcatgctgttcttggaaacagatggtcgcaaattgctgcgaggcttcccgggagaaccgacaacgagataaagaacttgtggaattcgtgcattaagaagaagctgatgaagaaaggcattgaccctattacacataaacccctctccgaggttggtaaagaaacaaacagaagcgacaataacaattccacaagtttttcctcagaaactaatcaagacttgtttgtcaagaaaacgtctgattttgccgagtattctgcgtttcagaaagaagaatccaactctgtttcactcagaaattcgctctcttccatgatcccaacgcaattcaacatcgacgatggttctgtctcaaatgcgggttttgatacacaagtatgcgtgaaaccctcgattattcttcttcctcctccaaacaacacttcaagcactgtctctggacaggatcatgtaaacgtgtcagagcctaattgtgaatcaaacagtggaaccacaagccacctcaacaatcccggtatggaagaaatgaaatggtccgaggagtacctaaacgaatcgttattctctacccaagtttacgtgaaatcagagacggatttcaactccaacattgcctttccttggagccaaagccaagcttgtgacgtattccccaaggatcttcagagaatggccttctcttttggtggtcagaccctttagtttctttttcttatcagatttagacatattgatacgtgtaatgaatggatcaaatgttctatttggccatacgttaaaaaaataaaaaagcacaatcctttcctgaaaaaaaaaaaaaaaaaaaaaaaaaaaaaa

SEQ ID NO: 840 - protein, 314 aa, Arabidopsis thaliana
  G1319
MKRHSCCYKQKLRKGLWSPEEDEKLLNYITKHGHGCWSSVPKLAGLERCGKSCRLRWINYLRPDLKRGAFSSEEQNLIVELHAVLGNRWSQIAARLPGRTDNEIKNLWNSCIKKKLMKKGIDPITHKPLSEVGKETNRSDNNNSTSFSSETNQDLFVKKTSDFAEYSAFQKEESNSVSLRNSLSSMIPTQFNIDDGSVSNAGFDTQVCVKPSIILLPPPNNTSSTVSGQDHVNVSEPNCESNSGTTSHLNNPGMEEMKWSEEYLNESLFSTQVYVKSETDFNSNIAFPWSQSQACDVFPKDLQRMAFSFGGQTL

SEQ ID NO: 841 - DNA, 1011 bp, Arabidopsis thaliana
  G1322
aaagttattgatagtttctgttacttattaatttttaaggttatgtgtattattaccaattggaggactatatagtcgcaagtctcaaccctataaaagaaaacattcgtcgatcatcttcccgcctcgagtatctctctctctctctctcttctctgttttctttattgattgcatagacaaaaatacacacatacacaacagaaagaaagatggagacgacgatgaagaagaaagggagagtgaaagcgacaataacgtcacagaaagaagaagaaggaacagtgagaaaaggaccttggactatggaagaagatttcatcctctttaattacatccttaatcatggtgaaggtctttggaactctgtcgccaaagcctctggtctaaaacgtactggaaaaagttgtcggctccggtggctgaactatctccgaccagatgtgcggcgagggaacataaccgaagaagaacagcttttgatcattcagcttcatgctaagcttggaaacaggtggtcgaagattgcgaagcatcttccgggaagaacggacaacgagataaagaacttctggaggacaaagattcagagacacatgaaagtgtcatcggaaaatatgatgaatcatcaacatcattgttcgggaaactcacagagctcggggatgacgacgcaaggcagctccggcaaagccatagacacggctgagagcttctctcaggcgaagacgacgacgtttaatgtggtggaacaacagtcaaacgagaattactggaacgttgaagatctgtggcccgtccacttgcttaatggtgaccaccatgtgatttaagatatatatatagacctcctatacatttatatgccccagctgggtttttttgtatggtacgttatttggtttttctattgctgaaatgtcgttgcatttaatttacatacgaaaagtgcattaaatcattaaatcttcaatacatatggaggtggtgtttgagtaaaaaaaaaaaaaa

SEQ ID NO: 842 - protein, 206 aa, Arabidopsis thaliana
  G1322
METTMKKKGRVKATITSQKEEEGTVRKGPWTMEEDFILFNYILNHGEGLWNSVAKASGLKRTGKSCRLRWLNYLRPDVRRGNITEEEQLLIIQLHAKLGNRWSKIAKHLPGRTDNEIKNFWRTKIQRHMKVSSENMMNHQHHCSGNSQSSGMTTQGSSGKAIDTAESFSQAKTTTFNVVEQQSNENYWNVEDLWPVHLLNGDHHVI

SEQ ID NO: 843 - DNA, 1088 bp, Arabidopsis thaliana
  G1323
aagagggaatctcaaaagtgtgtgtctgtgagagaggagagagagaatatgggcaaaggaagagcaccatgttgtgacaaaaccaaagtgaagagaggaccatggagccatgatgaagacttgaaactcatctctttcattcacaagaatggtcatgagaattggagatctctcccaaagcaagctggattgttgaggtgtggcaagagttgtcgtctgcgatggattaattacctcagacctgatgtgaaacgtggcaatttcagtgcagaggaagaagacaccatcatcaaacttcaccagagctttggtaacaagtggtcgaagattgcttctaagctgcctggaagaacagacaatgagatcaagaatgtgtggcatacacatctcaagaaaagattgagctcggaaactaaccttaatgccgatgaagcgggttcaaaaggttctttgaatgaagaagagaactctcaagagtcatctccaaatgcttcaatgtcttttgctggttccaacatttcaagcaaagacgatgatgcacagataagtcaaatgtttgagcacattctaacttatagcgagtttacggggatgttacaagaggtagacaaaccagagctgctggagatgccttttgatttagatcctgacatttggagtttcatagatggttcagactcattccaacaaccagagaacagagctcttcaagagtctgaagaagatgaagttgataaatggtttaagcacctggaaagcgaactcgggttagaagaaaacgataaccaacaacaacaacagcataaacagggaacagaagatgaacattcatcatcactcttggagagttacgagctcctcatacattaatgaagccataaagcaagtcattttcaccttgaaaatggaattattagctaacttattggcattattagtatataagcaagatcagataggcgcatgtagtagcaacaacgaagaaacgtcgaattgtagacaaaatgtagatattacagagttgaaagattgtattttgcaaatgattgctttgtagtgaaatcaagttatcacaaaaaaaaaaaaaa

SEQ ID NO: 844 - protein, 273 aa, Arabidopsis thaliana
  G1323
MGKGRAPCCDKTKVKRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKKRLSSETNLNADEAGSKGSLNEEENSQESSPNASMSFAGSNISSKDDDAQISQMFEHILTYSEFTGMLQEVDKPELLEMPFDLDPDIWSFIDGSDSFQQPENRALQESEEDEVDKWFKHLESELGLEENDNQQQQQHKQGTEDEHSSSLLESYELLIH

SEQ ID NO: 845 - DNA, 1137 bp, Arabidopsis thaliana
  G1324
cgaaaacaccacaaaccaaatatcattaagtaattaggaaacttaaactaagtatggaaaattcgatgaagaagaagaagagcttcaaagaaagtgaagatgaagaactaagaagagggccttggactttggaggaagacacacttctcacaaattacatcctccataacggtgagggtcgttggaatcacgtcgccaaatgtgctgggctaaagagaactgggaaaagttgtagattgagatggttgaattacttgaaacccgacataagacgagggaatcttactcctcaagaacagcttttgatccttgagcttcactctaaatggggtaataggtggtccaagattgcacagtacttgccaggaagaacggataacgagatcaagaactattggagaacaagagttcaaaaacaagctcgtcaactcaacatcgaatctaacagcgacaagttctttgacgctgttcgtagtttttgggtccctagattgatcgagaagatggaacaaaactcatccactactactacttattgttgtccccaaaacaacaacaacaactctcttcttcttccttctcaatctcacgactctttaagtatgcaaaaagatatagattactcgggtttcagcaacatagacggttcttcttcaacttctacttgcatgtctcatctaacaacagttccacactttatggatcaaagcaacaccaatatcatcgatggctcgatgtgtttccatgaaggcaatgttcaagaattcggaggatatgttcctggcatggaggattacatggtaaactcggacatctcaatggaatgtcacgtggcggatggttattcagcgtacgaggatgttacacaagatcccatgtggaatgtggatgacatttggcagtttagggagtaattaagtcgtcaagagatgagatggtagagcctaccactacggttctattatatggactaatatacttcttttgcttaactaagcaaaaagtttcgaaccttttacccatattatctcgggttggagactagaacatgttaaatttgtatcttctttgttgcgagtacttactaagtcattggataaatatttataatgatagtttcttgtacaaaaaaaaaaa

SEQ ID NO: 846 - protein, 286 aa, Arabidopsis thaliana
  G1324
MENSMKKKKSFKESEDEELRRGPWTLEEDTLLTNYILHNGEGRWNHVAKCAGLKRTGKSCRLRWLNYLKPDIRRGNLTPQEQLLILELHSKWGNRWSKIAQYLPGRTDNEIKNYWRTRVQKQARQLNIESNSDKFFDAVRSFWVPRLIEKMEQNSSTTTTYCCPQNNNNNSLLLPSQSHDSLSMQKDIDYSGFSNIDGSSSTSTCMSHLTTVPHFMDQSNTNIIDGSMCFHEGNVQEFGGYVPGMEDYMVNSDISMECHVADGYSAYEDVTQDPMWNVDDIWQFRE

SEQ ID NO: 847 - DNA, 1662 bp, Arabidopsis thaliana
  G1325
atgagttacacgacggcgactgctgatagtgatgatggtatgcactccagcatccataatgaatcaccagctcctgatagtattagcaatggctgcagaagtagagggaaaagaagtgtcctgaagaaaggaccatggacttcaactgaagacgggattttaattgattatgtaaagaagcacggcgagggtaactggaatgctgtgcagaaacacactagcctggcccgttgtggtaaaagctgtcgtctgagatgggctaatcatctgaggccaaacttgaagaaaggagcatttagccaagaagaagaacagctcattgttgaaatgcacgccaagatgggaaataaatgggcacagatggctgaacatttacctggtcgaacagataatgagataaagaattattggaacactcgtatcaagaggagacaacgagcaggcttaccactttaccctcctgaaatctatgttgatgaccttcattggagcgaagagtatacaaagagtaatatcataagagtagatagaagaagaagacatcaagatttcttgcagttggggaattctaaagataatgtcttatttgacgatctaaattttgctgctagcttgttacctgccgcttctgacctatcagatttggttgcatgcaacatgctaggaactggcgcaagttcttcccggtatgagagctacatgccaccaatattgccttccccaaagcaaatctgggaatctggatctcggtttcccatgtgcagcagtaacataaagcatgaattccaatcgccggaacactttcagaatacggctgtacagaagaatcccagatcttgcagtatctcgccttgtgatgttgatcatcatccttatgaaaaccaacattcgtctcatatgatgatggttcctgatagccatacagttacgtatggcatgcatcctacttctaagcccttgtttggggcagtgaagctggagctcccttcattccaatattcagaaactagtgcatttgatcagtggaagacgactccgtcacctccacactcagatctccttgactctgttgatgcctatattcaatctccaccaccatcgcaggtagaggagtcagattgtttctcttcatgcgacaccggcctactagatatgttacttcatgaggccaagatcaaaactagtgcgaagcacagtttgttgatgtcatcaccccagaagagtttcagttcaactacttgcacgaccaatgttactcagaatgtaccacgtggcagcgaaaacctgatcaaatcaggagaatatgaagattcccaaaagtatttgggtcgctccgagattacaagtccctcgcaacttagtgcaggtggtttttcatcagcttttgcagggaatgttgtaaagacagaagagttggatcaggtttgggaaccaaagagagttgatataacacggcctgatgttttacttgcgtcgagctggcttgaccaaggctgttatggcattgttagtgacacaagcagcatgagtgatgcgcttgcacttcttggtggtgacgacattgggaacagttacgtgactgttgggtcatcatcaggtcaagcaccacgaggcgtcgggtcttatggatggaccaatatgcctcctgtttggtcgctgtaa

SEQ ID NO: 848 - protein, 553 aa, Arabidopsis thaliana
  G1325
MSYTTATADSDDGMHSSIHNESPAPDSISNGCRSRGKRSVLKKGPWTSTEDGILIDYVKKHGEGNWNAVQKHTSLARCGKSCRLRWANHLRPNLKKGAFSQEEEQLIVEMHAKMGNKWAQMAEHLPGRTDNEIKNYWNTRIKRRQRAGLPLYPPEIYVDDLHWSEEYTKSNIIRVDRRRRHQDFLQLGNSKDNVLFDDLNFAASLLPAASDLSDLVACNMLGTGASSSRYESYMPPILPSPKQIWESGSRFPMCSSNIKHEFQSPEHFQNTAVQKNPRSCSISPCDVDHHPYENQHSSHMMMVPDSHTVTYGMHPTSKPLFGAVKLELPSFQYSETSAFDQWKTTPSPPHSDLLDSVDAYIQSPPPSQVEESDCFSSCDTGLLDMLLHEAKIKTSAKHSLLMSSPQKSFSSTTCTTNVTQNVPRGSENLIKSGEYEDSQKYLGRSEITSPSQLSAGGFSSAFAGNVVKTEELDQVWEPKRVDITRPDVLLASSWLDQGCYGIVSDTSSMSDALALLGGDDIGNSYVTVGSSSGQAPRGVGSYGWTNMPPVWSL

SEQ ID NO: 849 - DNA, 880 bp, Arabidopsis thaliana
  G1326
cgacggtacggtggagatagagatagcatccatggagatgtctagaggaagcaacagttttgacaataagaagcctagttgccaaagaggtcactggagacctgttgaagatgacaatctccggcaactcgttgaacaatacggtcccaagaactggaattttattgctcaacatctctatggaagatcagggaaaagctgtagattaagatggtacaaccaacttgatccaaacatcaccaagaaacccttcaccgaggaggaagaagagagactgcttaaagctcatcggatccaagggaatcgttgggcctccatagcccgactgttccccgggaggaccgacaacgctgtcaaaaaccattttcatgtcatcatggctagacgcaaacgggaaaacttctcttccacagctacttctacgttcaaccaaacttggcatactgttttgagccctagttctagtcttacaaggctaaatagatcccatttcgggctatggaggtatcgaaaggataagagttgcggtctctggccttactcttttgtttcaccacctacgaatggtcaatttggatcttcatctgtctctaacgtacaccacgaaatttatcttgagaggagaaagtcgaaagagttggtggatcctcagaattacacatttcatgcagccacaccagatcataagatgacttcaaatgaagatggaccatccatgggagatgatggtgagaagaacgatgttactttcattgattttcttggtgttggattagcttcttaggttataacatcacaagtcaaagcttttaagggtttctatcattagggttaggcatcattttcagccttttgcttccttaaactctcatatggatct

SEQ ID NO: 850 - protein, 250 aa, Arabidopsis thaliana
  G1326
MEMSRGSNSFDNKKPSCQRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKRENFSSTATSTFNQTWHTVLSPSSSLTRLNRSHFGLWRYRKDKSCGLWPYSFVSPPTNGQFGSSSVSNVHHEIYLERRKSKELVDPQNYTFHAATPDHKMTSNEDGPSMGDDGEKNDVTFIDFLGVGLAS

SEQ ID NO: 851 - DNA, 891 bp, Arabidopsis thaliana
  G1327
atggggaaaggaagagcaccatgctgcgacaagaacaaagtgaagagagggccatggagccctcaagaagatctcactctcatcacttttattcaaaaacatggccatcaaaactggagatctcttcccaagcttgctggattgttgagatgtgggaaaagttgccgactaagatggataaactatctgagaccggacgtgaagcgaggcaactttagcaaaaaggaggaagatgctatcattcactaccatcaaacccttggaaacaagtggtcaaagatcgcgtccttcttgccgggaagaactgacaacgagatcaaaaacgtgtggaacacgcatctcaagaaacgactcactccatcttcttcttcttcatccctctctagcactcatgaccaaagcacaaaagcagatcatgacaagaactgtgacggggctcaagaagaaatacattcagggttaaatgagagccaaaactcagctacttcgtcacatcaccaaggcgagtgtatgcacacaaaaccagagcttcatgaggttaatggactcaacgagatccagttcctgctcgaccatgatgactttgatgatataacctctgagtttcttcaggataacgatatcttatttccgctagactctcttcttcataaccaccaaactcacatttcaacccaagaaatgactcgagaggtaaccaaatcgcaatcatttgatcatcctcaaccggatatcccatgcggatttgaagacacaaacgaagaatccgacttgaggagacagctggttgaatcaaccacacctaacaatgagtacgacgagtggttcaacttcattgacaaccaaacttactttgatgattttaatttcgtcggagaagtatgtctatga

SEQ ID NO: 852 - protein, 296 aa, Arabidopsis thaliana
  G1327
MGKGRAPCCDKNKVKRGPWSPQEDLTLITFIQKHGHQNWRSLPKLAGLLRCGKSCRLRWINYLRPDVKRGNFSKKEEDAIIHYHQTLGNKWSKIASFLPGRTDNEIKNVWNTHLKKRLTPSSSSSSLSSTHDQSTKADHDKNCDGAQEEIHSGLNESQNSATSSHHQGECMHTKPELHEVNGLNEIQFLLDHDDFDDITSEFLQDNDILFPLDSLLHNHQTHISTQEMTREVTKSQSFDHPQPDIPCGFEDTNEESDLRRQLVESTTPNNEYDEWFNFIDNQTYFDDFNFVGEVCL

SEQ ID NO: 853 - DNA, 1161 bp, Arabidopsis thaliana
  G1328
aattcaatcactatatttttttaaaaacatttgacttcatcgatcggttaacaattaatcaaaaagatgggacgatcaccatgttgtgagaagaagaatggtctcaagaaaggaccatggactcctgaggaggatcaaaagctcattgattatatcaatatacatggttatggaaattggagaactcttcccaagaatgctgggttacaaagatgtggtaagagttgtcgtctccggtggaccaactatctccgaccagatattaagcgtggaagattctcttttgaagaagaagaaaccattattcaacttcacagcatcatgggaaacaagtggtctgcgattgcggctcgtttgcctggaagaacagacaacgagatcaaaaactattggaacactcacatcagaaaaagacttctaaagatgggaatcgacccggttacacacactccacgtcttgatcttctcgatatctcctccattctcagctcatctatctacaactcttcgcatcatcatcatcatcatcatcaacaacatatgaacatgtcgaggctcatgatgagtgatggtaatcatcaaccattggttaaccccgagatactcaaactcgcaacctctctcttttcaaaccaaaaccaccccaacaacacacacgagaacaacacggttaaccaaaccgaagtaaaccaataccaaaccggttacaacatgcctggtaatgaagaattacaatcttggttccctatcatggatcaattcacgaatttccaagacctcatgccaatgaagacgacggtccaaaattcattgtcatacgatgatgattgttcgaagtccaattttgtattagaaccttattactccgactttgcttcagtcttgaccacaccttcttcaagcccgactccgttaaactcaagttcctcaacttacatcaatagtagcacttgcagcaccgaggatgaaaaagagagttattacagtgataatatcactaattattcgtttgatgttaatggttttctccaattccaataaacaaaacgccattggaatagagttatgtaaacatgcaatcattgtatttgttatatagattttgttacatatccaaaatccaaaatactatagttttaaaataaaaaaaaaaaaaaaaaa

SEQ ID NO: 854 - protein, 324 aa, Arabidopsis thaliana
  G1328
MGRSPCCEKKNGLKKGPWTPEEDQKLIDYINIHGYGNWRTLPKNAGLQRCGKSCRLRWTNYLRPDIKRGRFSFEEEETIIQLHSIMGNKWSAIAARLPGRTDNEIKNYWNTHIRKRLLKMGIDPVTHTPRLDLLDISSILSSSIYNSSHHHHHHHQQHMNMSRLMMSDGNHQPLVNPEILKLATSLFSNQNHPNNTHENNTVNQTEVNQYQTGYNMPGNEELQSWFPIMDQFTNFQDLMPMKTTVQNSLSYDDDCSKSNFVLEPYYSDFASVLTTPSSSPTPLNSSSSTYINSSTCSTEDEKESYYSDNITNYSFDVNGFLQFQ

SEQ ID NO: 855 - DNA, 606 bp, Arabidopsis thaliana
  G1332
atggaatgcaaaagagaagaagggaagtcttacgtgaagagagggttgtggaaaccagaagaagatatgatattaaaaagctatgttgagactcatggtgaaggaaactgggcagacatttctcgtagatccgggttgaagagaggaggaaaaagctgtaggctgagatggaagaactatctaagaccaaatatcaaaagaggaagcatgtcaccacaagaacaagaccttatcatccgcatgcataagcttcttggaaacagatggtcgttgatcgctggtcgccttccaggtcgtactgacaatgaagtgaagaactactggaatactcatttgaacaagaaacctaattcccgaaaacagaatgcacctgaatcaatcgtcggcgccactcctttcacggataagccagttatgtctacagaactgagaagaagccatggagaaggaggagaagaggagagcaatacctggatggaggagaccaaccactttggctatgacgtccacgtaggatctcccttgccacttatttcccactacccagacaacactctcgtgtttgacccatgtttttcctttaccgatttctttcctctgctttag

SEQ ID NO: 856 - protein, 201 aa, Arabidopsis thaliana
  G1332
MECKREEGKSYVKRGLWKPEEDMILKSYVETHGEGNWADISRRSGLKRGGKSCRLRWKNYLRPNIKRGSMSPQEQDLIIRMHKLLGNRWSLIAGRLPGRTDNEVKNYWNTHLNKKPNSRKQNAPESIVGATPFTDKPVMSTELRRSHGEGGEEESNTWMEETNHFGYDVHVGSPLPLISHYPDNTLVFDPCFSFTDFFPLL

SEQ ID NO: 857 - DNA, 1274 bp, Arabidopsis thaliana
  G1334
atagctcccaactaataggaatctcaagcttctcactctctcttgtttttccattggacttttggaacataagctatgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtggtgaaaagagttcaagagatgtgccaaagcctcatgttgctttcgcgatgcaatcagcttgcttcgagtttggatttgctcagccaatgatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatatgatcagcagataggggacaagacatgattggtcaccagtccttttgtcttgtcccttatctttcagccaaacggaaagagaacttgtgtcttggaaaaaagacattgagtttccttggtttataagattggtccttttaccatccgtttggctgtaaacaggcaaatcatctttggctcatgcttcatcaagttcttatcttcgtctgttttcttctacgcatcttcataagatctctgaactagtgaataacatttcctagcatcatgtttcaactagtgtgtgttgtaagaaactctgccttatttccagatgatgtattgtgtgtaacgtgtttatgaaacaaacgtaagactttcaagttaaaaaaaaaaaaaaaaaaaaaaaaaaa

SEQ ID NO: 858 - protein, 269 aa, Arabidopsis thaliana
  G1334
MQTEELLSPPQTPWWNAFGSQPLTTESLSGEASDSFTGVKAVTTEAEQGVVDKQTSTTLFTFSPGGEKSSRDVPKPHVAFAMQSACFEFGFAQPMMYTKHPHVEQYYGVVSAYGSQRSSGRVMIPLKMETEEDGTIYVNSKQYHGIIRRRQSRAKAEKLSRCRKPYMHHSRHLHAMRRPRGSGGRFLNTKTADAAKQSKPSNSQSSEVFHPENETINSSREANESNLSDSAVTSMDYFLSSSAYSPGGMVMPIKWNAAAMDIGCCKLNI

SEQ ID NO: 859 - DNA, 965 bp, Arabidopsis thaliana
  G1335
tttttttttaaaagatttagagagaaaagtgagttattaagagattccaatcaaaatgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaaaaccaacgccggttacgcggtggagaagagtgagttggttatctcacaagtgatcggttctttctcccgccgccttctatctctctattatccactttttgcttattatgatggatctctatctttgttagttggttttttcttgatggtttcggattaggactcttcttttggttttgctacttatggttggttttatttatggtacttgtgatatgggtgaaatgctctacttgttgctctgtttcaagtgttcataatatgcgaacaaatattctgggttttgtttcaaaaaaaa

SEQ ID NO: 860 - protein, 203 aa, Arabidopsis thaliana
  G1335
MSGDNGGGERRKGSVKWFDTQKGFGFITPDDGGDDLFVHQSSIRSEGFRSLAAEEAVEFEVEIDNNNRPKAIDVSGPDGAPVQGNSGGGSSGGRGGFGGGRGGGRGSGGGYGGGGGGYGGRGGGGRGGSDCYKCGEPGHMARDCSEGGGGYGGGGGGYGGGGGYGGGGGGYGGGGRGGGGGGGSCYSCGESGHFARDCTSGGR

SEQ ID NO: 861 - DNA, 1630 bp, Arabidopsis thaliana
  G1337
aatggatttgtcatcattcttctcaccgtccttagtctctgaaaataaattctgattttgatttcgaattttagggattttgagagagagtcagttatgagtagttcggagagagtaccgtgcgatttctgcggcgagcgtacggcggttttgttttgtagagccgatacggcgaagctgtgtttgccttgtgatcagcaagttcacacggcgaatctgttgtcgaggaagcacgtgcgatctcagatctgcgataattgcggtaacgagccagtctctgttcggtgtttcaccgataatctgattttgtgtcaggagtgtgattgggatgttcacggaagttgttcagtttccgatgctcatgttcgatccgccgtggaaggtttttccggttgtccatcggcgttggagcttgctgctttatggggacttgatttggagcaagggaggaaagatgaagagaatcaagttccgatgatggcgatgatgatggataatttcgggatgcagttggattcttgggttttgggatctaatgaattgattgttcccagcgatacgacgtttaagaagcgtggatcttgtggatctagttgtgggaggtataagcaggtattgtgtaagcagcttgaggagttgcttaagagtggtgttgtcggtggtgatggcgatgatggtgatcgtgaccgtgattgtgaccgtgagggtgcttgtgatggagatggagatggagaagcaggagaggggcttatggttccggagatgtcagagagattgaaatggtcaagagatgttgaggagatcaatggtggcggaggaggaggagttaaccagcagtggaatgctactactactaatcctagtggtggccagagttctcagatatgggattttaacttgggacagtcacggggacctgaggatacgagtcgagtggaagctgcatatgtagggaaaggtgctgcttcttcattcacaatcaacaattttgttgaccatatgaatgaaacttgttccactaatgtgaaaggtgtcaaagagattaaaaaggatgactacaagcgatcaacttcaggccaggtacaaccaacaaaatctgagagcaacaatcgtccaattacctttggctctgagaaaggttcgaactcctccagtgacttgcatttcacagagcatattgctggaactagttgtaagaccacaagactagttgcaactaaggctgatctggagcggctggctcagaacagaggagatgcaatgcagcgttacaaggaaaagaggaagacacggagatatgataagaccataaggtatgaatcgaggaaggcaagagctgacactaggttgcgtgtcagaggcagatttgtgaaagctagtgaagctccttacccttaaccttaagttttttcacataggcttccttttagctacaaacttagttactttttttactccactgcctcataaatgtacagaccggtctcgtttcatctggccgcccttcttgttttattgccttatctggcccttttatgtaccttggaatcttatctagtttaaaaaagattgtaaccttctagaaaaccatattctgttgacagtatatacatgtctatccaagcaaaaa

SEQ ID NO: 862 - protein, 433 aa, Arabidopsis thaliana
  G1337
MSSSERVPCDFCGERTAVLFCRADTAKLCLPCDQQVHTANLLSRKHVRSQICDNCGNEPVSVRCFTDNLILCQECDWDVHGSCSVSDAHVRSAVEGFSGCPSALELAALWGLDLEQGRKDEENQVPMMAMMMDNFGMQLDSWVLGSNELIVPSDTTFKKRGSCGSSCGRYKQVLCKQLEELLKSGVVGGDGDDGDRDRDCDREGACDGDGDGEAGEGLMVPEMSERLKWSRDVEEINGGGGGGVNQQWNATTTNPSGGQSSQIWDFNLGQSRGPEDTSRVEAAYVGKGAASSFTINNFVDHMNETCSTNVKGVKEIKKDDYKRSTSGQVQPTKSESNNRPITFGSEKGSNSSSDLHFTEHIAGTSCKTTRLVATKADLERLAQNRGDAMQRYKEKRKTRRYDKTIRYESRKARADTRLRVRGRFVKASEAPYP

SEQ ID NO: 863 - DNA, 1432 bp, Arabidopsis thaliana
  G1362
aggtagaatctctattcgagtccccaagattctctttatatccctagtttagttgtatggttgggttttgattggaatatcaaggggtagtttttagctaggttcacttgatacttggaagatctgagttctttgggattctgttaagtttgtggagatctaaaagacacgaaatttgtagaaatctggttgatatcccagacttttagagggattagggtagattctatagaatttgaggcgggtttgattggaattatgacggtggaggaagttagtgatggttctgtgtggagtagggaggatgatattgcctttgagagacctctagccaataataccgatgaatcagaggaacggtgggagaagattgctgcagacgttccaggcaaaagtgttgaacagattaaagaacattacgagcttttagttgaagatgttactaggattgaatcaggatgtgtgcctcttcctgcctatgggtctcctgaaggatcgaatggccatgctggtgatgaaggagcaagtagtaagaaaggaggtaacagtcatgcgggagagtctaaccaagcaggtaaatcaaagtccgatcaagaacgacgaaagggtatcgcgtggacagaagatgagcacaggttatttcttcttggtttggataagtacgggaaaggtgattggcgtagcatttctcgcaactttgtagtaacaagaacaccgacccaagttgcgagccatgctcaaaagtatttcattcgtctaaattcaatgaacaaagacagaaggcgatcaagcattcacgacatcactagtgttggcaacgcagatgtctcaaccgccacaaggccaatcactggtcagaacaacagcaataacaacaacaacaacaacaacaacaacagttctcctgctgttgctggaggaggaaacaaatcagccaagcaagccgtctctcaagcaccacctggacctcctatgtatggaacacccgccataggtcagccagcagttggaacaccagtgaacctcccagctccacctcacatggcttatggagttcatgcggctccagtccctggctcagtggttcctggtgcagcaatgaacattggtcaaatgccgtacaccatgccgcgtacaccaacggctcataggtaactcgaaagcacctttgctgtcatagtgcactttgtttttaggtgtaagaaagaagatgtgtaaaggatttagtgaatattcaagcttgttccttgagtgagttttttttattacttagtttgtggggattttgtatgaggtccgaataagatatgaagatgacatgattagtttccagactcgagaagcaaaaatactcctgtttgtatgtgaacacaataaagcctctgttatgagacttacaacaaagcaacattgtatatcttgttctcacaaa

SEQ ID NO: 864 - protein, 298 aa, Arabidopsis thaliana
  G1362
MTVEEVSDGSVWSREDDIAFERPLANNTDESEERWEKIAADVPGKSVEQIKEHYELLVEDVTRIESGCVPLPAYGSPEGSNGHAGDEGASSKKGGNSHAGESNQAGKSKSDQERRKGIAWTEDEHRLFLLGLDKYGKGDWRSISRNFVVTRTPTQVASHAQKYFIRLNSMNKDRRRSSIHDITSVGNADVSTATRPITGQNNSNNNNNNNNNNSSPAVAGGGNKSAKQAVSQAPPGPPMYGTPAIGQPAVGTPVNLPAPPHMAYGVHAAPVPGSVVPGAAMNIGQMPYTMPRTPTAHR

SEQ ID NO: 865 - DNA, 757 bp, Arabidopsis thaliana
  G1366
ctaatctcttctcttctcttaaaatcaaacgtaatcataaataaagatcttcttgtttaatttctcttgatcctcgcaaaatcacagattcttgaaattcttttttcttgtcttgaaattcttgagttcttgagttatgaaaagacaatggacagagttatgaaatgataaatctcaaccaattccttgtttatcattctatatcagttgtgattcttcattggttttacgttatctcttgaacaaaaaaacatggcaaacgcagagaagacaagttcaggttccgacatagatgagaagaaaagaaaacgcaagttatcaaaccgcgaatctgcaaggaggtcgcgtttgaagaaacagaagttaatggaagacacgattcatgagatctccagtcttgaacgacgaatcaaagagaacagtgagagatgtcgagctgtaaaacagaggcttgactcggtcgaaacggagaacgcgggtcttagatcggagaagatttggctctcgagttacgttagcgatttagagaatatgattgctacgacgagtttaacgctgacgcagagtggtggtggcgattgtgtcgacgatcagaacgcaaacgcgggaatagcggttggagattgtagacgtacaccgtggaaattgagttgtggttctctacaaccaatggcgtcctttaagacatgagatttgtgtattagtgtgtgttttactttggtcattttatagtttttgtaatctttttatatcgaat

SEQ ID NO: 866 - protein, 145 aa, Arabidopsis thaliana
  G1366
MANAEKTSSGSDIDEKKRKRKLSNRESARRSRLKKQKLMEDTIHEISSLERRIKENSERCRAVKQRLDSVETENAGLRSEKIWLSSYVSDLENMIATTSLTLTQSGGGDCVDDQNANAGIAVGDCRRTPWKLSCGSLQPMASFKT

SEQ ID NO: 867 - DNA, 1177 bp, Arabidopsis thaliana
  G1380
tttcttctcttcttcacacaaacacacacagatctcttcttcatcacattacttctggctttacatcttttttcttctccatgaggaaagggagaggctcttccgtcgttggacccgcccttccagtaaccgccggtggatctgtgaaggagccgaggtatagaggcgttaggaagagaccttggggtcgattcgcagctgagatccgtgatccattaaaaaaatctcgtgtctggctcggtactttcgattccgccgtagatgctgcacgcgcttacgataccgccgcacgtaacctccgtggtccaaaggccaagaccaatttcccgatcgattgttctccttcttctcctctccaacctctcacctacctccacaatcaaaacctctgttctcctccggtgattcagaaccagatcgatccgtttatggaccatcggttatacggcggaggtaatttccaggagcagcagcagcagcagattattagtcggccggcgagtagcagcatgagcagcaccgttaaatcttgtagcggaccgagaccgatggaagccgcggcggcgtcttcgtcggtggcgaaaccgttacatgcgattaagagatatccgagaactccaccggtagctccggaggattgtcatagcgactgcgattcttcgtcgtctgttattgacgacggagatgatatcgcatcttcgtcttcccgccggaaaacgccgtttcagtttgatcttaatttcccgccgttggatggcgttgacttattcgctggcgggatagatgatctccactgtaccgatctacgtctctgatttgctgctttacaaaaaaaatccgttgattacacacaaaaaaaattctcaaattttacaaaatgataactttatgctcttttgtttttccattttcctttgatatcatattgaaagagaaaaaaaggaagaacaaaaaaaaaagattgagcgtgatgattttatcatcaacgaagatgatgacgattaaaaagagagagagattgtgttaagatctgttactgtaagaaccagatctgggtttcatttttatctgtttcttcttataaaagatccaacaaccctttgttacatatatataacattctgaagctggtgatgatttctgaatgattcaaatccattatcttaaaaaaaaaaaa

SEQ ID NO: 868 - protein, 244 aa, Arabidopsis thaliana
  G1380
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEAAAASSSVAKPLHAIKRYPRTPPVAPEDCHSDCDSSSSVIDDGDDIASSSSRRKTPFQFDLNFPPLDGVDLFAGGIDDLHCTDLRL

SEQ ID NO: 869 - DNA, 2008 bp, Arabidopsis thaliana
  G1382
ctctcatttcgccatagctgagagcttcttctactttcccttagcttcttttttccttcatttttgttctacccttgcgaatctctgaaatgaaccctcaagctaatgaccggaaggagtttcagggagattgttcggcgacgggagatctcacggcaaagcacgattcagctggaggaaacggaggtggaggtgctaggtataagctgatgtcaccggccaagcttccgatctcgaggtcgactgatatcacgattcctcctgggttgagtccgacttcgtttttggaatctcctgttttcatctccaacatcaagccagaaccttcccctactactggttctttgttcaagcctcgaccagtgcacatttctgctagctcaagttcttatacaggcagggggttccatcagaacacctttactgagcagaagtccagtgaatttgagttcagacctcctgcatcaaatatggtatatgcagagcttggcaagattagaagtgagccaccagtacattttcaaggccagggccatggatcctcacactcaccttcttcgatcagtgatgctgcaggttcctcaagtgagctaagccggccaactcctccttgtcagatgacaccaacgagctcagatattccggctggatctgatcaagaggaatcaatccagacttcccaaaatgactccagaggaagcactccatccatcttggctgatgatggttataactggagaaaatatggtcaaaagcatgtcaaagggagtgaatttccccggagctattataaatgtacacatcctaattgtgaagtgaaaaagttatttgaaagatctcatgatgggcagatcaccgatattatatacaagggtacacatgaccatcctaaacctcaacctggtcgccgaaactctggtggtatggctgcacaagaagaaaggctagacaagtatccttcttcaactggccgagatgagaagggatctggcgtctacaacttgtctaaccccaatgaacaaactggtaaccctgaagtacctcctatctcagcatctgacgatggtggagaagcggcagcgtcaaataggaataaagatgagccggacgatgatgatccattctcaaaacggaggaggatggagggtgcgatggaaataactccactagtgaaacccatccgggagcctcgggttgttgttcaaactctgagtgaggttgacattctggatgatggttatagatggcgcaaatatgggcagaaagtcgtaagggggaacccaaatcccaggagctactacaaatgcacagctcatggatgcccagtgagaaaacacgtggagagagcatcacatgatccaaaagctgtaataacaacatacgaaggcaaacacgatcatgatgttcccacttcaaagtctagcagcaatcacgaaatccagcctcggttcagaccagatgaaacagacaccatcagcctcaatcttggtgttggaatctcatctgatggacctaaccacgcttccaacgaacatcagcaccagaatcaacaacttgtcaaccaaactcacccaaatggagtcaatttcaggtttgttcatgctagtcccatgtcatcctactatgctagcttaaatagcggtatgaatcagtacggccagagagaaacaaagaacgagactcaaaatggtgacatctcgtccttgaacaattcatcttacccatatccgcccaacatggggagagtacaatcgggtccgtaaaacaaaaagtaagcaacattatgtacgggatcttcttaggttaggaatgggacgaggccttgttctatataattcctatttcttcacagagagctgatcttgattcaaactatctccaccatatatatttgtttgtgtcacctgtattgagttccaaaaatgttatgtaaaaatacacaacaagatgttaatgcttttatttaaacaagaaacagcaatattactacaaaaaaaaaaaaaaaaaa

SEQ ID NO: 870 - protein, 557 aa, Arabidopsis thaliana
  G1382
MNPQANDRKEFQGDCSATGDLTAKHDSAGGNGGGGARYKLMSPAKLPISRSTDITIPPGLSPTSFLESPVFISNIKPEPSPTTGSLFKPRPVHISASSSSYTGRGFHQNTFTEQKSSEFEFRPPASNMVYAELGKIRSEPPVHFQGQGHGSSHSPSSISDAAGSSSELSRPTPPCQMTPTSSDIPAGSDQEESIQTSQNDSRGSTPSILADDGYNWRKYGQKHVKGSEFPRSYYKCTHPNCEVKKLFERSHDGQITDIIYKGTHDHPKPQPGRRNSGGMAAQEERLDKYPSSTGRDEKGSGVYNLSNPNEQTGNPEVPPISASDDGGEAAASNRNKDEPDDDDPFSKRRRMEGAMEITPLVKPIREPRVVVQTLSEVDILDDGYRWRKYGQKVVRGNPNPRSYYKCTAHGCPVRKHVERASHDPKAVITTYEGKHDHDVPTSKSSSNHEIQPRFRPDETDTISLNLGVGISSDGPNHASNEHQHQNQQLVNQTHPNGVNFRFVHASPMSSYYASLNSGMNQYGQRETKNETQNGDISSLNNSSYPYPPNMGRVQSGP

SEQ ID NO: 871 - DNA, 2098 bp, Arabidopsis thaliana
  G1391
atggcttttgctcaatctgtctacaaccaaagctctgtcttgaaaatcaatgtcatggttgtggacgataatcgtgttttccttgatatttggtcacgcatgcttgaaaagtccaaatacagagagatcacggttatagctgtagactatccgaagaaagcattatctactctaaaaaatcaacgagataatatagatcttataatcacagattattacatgcctggcatgaacggtctacaactcaaaaaacaaatcactcaagaatttggaaatttatcagtcttagttatgtcatcggacccaaacaaagaagaagagagtttaagttgtggagcaatgggtttcattccaaaacccatagcaccaactgacttaccaaagatttaccagtttgctttaacctacaagaggaacggtaaatcaacattatcgaccgagcaaaaccaaaaggacgcaaatgttagtgtccctcagcaaatcatgttggttcctgagcaagcttacgttttaaagaccaagaagaagaactgctcatctaaatcagatacaagaaccgtgaacagtacaaatgtaagtcatgttagtacgaatggttcaagaaaaaatcggaaacgaaaacccaaaggtggtcctagtgatgatggcgagtctctgtcgcaaccccccaagaagaaaaagatttggtggacgaatcctcttcaagacctattcttacaggctatccaacatatcggttatgataaggtggtgcccaaaaagatcctcgcgatcatgaacgtaccatacttgacaagagagaacgtagccagccatttacagaaatatcggttattcgtgaagagagtcgtgcatcaaggtaggtttagcatgctgtcagatagaggcaaagactcgatgtttcgacaaactcacattaaggagccgtacgtcaactattacacaccatctacttcttggtatgagacaagtcttaacaatagatcattctattccgaatccgtacatggacactctagactcttgtccgaagcacgtgagcccgtccgctacaaccaaatgtcttacaactacatgaaccggtcagccacctatgagccgcagtattggatctggatcaaccttgacgcttcccatccaaagcaacatcagtttcgaaaaccagccatctcaaaacgaagaaacaagaaccgttttcgagccacccgtgatggcgaacaaaatcagccaaacatctcaagttcttgggtttggacaacttggaccgtcagctatcagtggtcataatttcaatactaacatgatgagcagctatggaagtttggctccgaatcaaccgggaactagccacttctcctatgggatgcaatcggtcttaaacaatgagaacgcaacatataaccctcagccacctgccaatgcaactacacagccaaatcttgatgaacttcctcaactggagaatctcaacttatacaatgatctcggcaacactagtgagcttccttacaacataagtaactttcaatccgatgacaacaagaaacgaggagaagaagatggtgactggaccttcgtgaacataaaccaggatcaatctaatggagaatcatcgaacactattgctactccggagactaatactccaaatttcaacattaaccctaatcagaatcagggacaagctgttccagagtttaccgattggtcgtttttggatcagcaggaattggttgatgacgacttcatgaactctctgttcaacaatgacatgaattgaaaagggttctcttctccaagatgttctcaaaagcgaggtgaagaaataaaaccggcgatacctagtacttctctaaggagatgtatataactagtaggcagatctattaaatatatatgtatatcgtagaagtatggttttagttatcttattatataaagtatggttttcaaagttactaactcataggatcgtgccacgtgtcaagtcaaacgatcagatgtttacatgtgtcattcaaaatttaacttttttattctctaaaaaaatagaaaatcttaaaaagcaaaaaaaaaaaaaaaaaaaaaaaaaaaaaaa

SEQ ID NO: 872 - protein, 428 aa, Arabidopsis thaliana
  G1391
MAFAQSVYNQSSVLKINVMVVDDNRVFLDIWSRMLEKSKYREITVIAVDYPKKALSTLKNQRDNIDLIITDYYMPGMNGLQLKKQITQEFGNLSVLVMSSDPNKEEESLSCGAMGFIPKPIAPTDLPKIYQFALTYKRNGKSTLSTEQNQKDANVSVPQQIMLVPEQAYVLKTKKKNCSSKSDTRTVNSTNVSHVSTNGSRKNRKRKPKGGPSDDGESLSQPPKKKKIWWTNPLQDLFLQAIQHIGYDKVVPKKILAIMNVPYLTRENVASHLQKYRLFVKRVVHQGRFSMLSDRGKDSMFRQTHIKEPYVNYYTPSTSWYETSLNNRSFYSESVHGHSRLLSEAREPVRYNQMSYNYMNRSATYEPQYWIWINLDASHPKQHQFRKPAISKRRNKNRFRATRDGEQNQPNISSSWVWTTWTVSYQWS

SEQ ID NO: 873 - DNA, 435 bp, Arabidopsis thaliana
  G1395
attttttccggcgagcggtgctgataacctcgtagctccgaaacgccgccatggccgcagaatttgatggaaaaatcgaaagcaaagggctaaacccgggactgatcgtccttcttgtaataggagggttgctactgacattccttgtaggaaacttcatcctttacacatacgcacagaagaatttacctccgaggaagaagaaacccgtttctaagaagaagatgaagaaagagaagatgaagcaaggcgtccaagttcctggcgagtagcttttgttatatgttgtcgggattatcctttgatgataactcactctgctggactagaacttgtatgactccgttactcattagttttttgatgttttcgatgtagcatgcatgatattttcttgagttgacaatctataagctttactgagataaaaaaaaa

SEQ ID NO: 874 - protein, 73 aa, Arabidopsis thaliana
  G1395
MAAEFDGKIESKGLNPGLIVLLVIGGLLLTFLVGNFILYTYAQKNLPPRKKKPVSKKKMKKEKMKQGVQVPGE

SEQ ID NO: 875 - DNA, 1011 bp, Arabidopsis thaliana
  G1398
ggtcattgaatcattgatcgtgcatcaaagatactacaaaaagaagaaaatcaaatatataaagaaagaaggcgagtcattttatgacaacgagaaacagaacatcactaccaaacatctccagctcagtttcttcaaataaaaacattgttgtacctaacatcatggctgaagaggaaccgaagaaggtgacagagaccgtgtcggaaccaactccaacaccggaagttccggtggagaaacctgctgctgctgcagatgttgctcctcaggagaagcctgtggctccacctcccgttcttccatctccggcaccggcagaggagaagcaagaagactctaaggctattgttcccgtcgtccctaaagaagtagaggaagagaagaaagaaggatcagttaatcgagatgctgttctggctagagttgagacagagaagaggatgtcacttatcaaagcttgggaagaggctgagaaatgcaaagtggagaacaaagctgagaagaagctttcttcaattggatcatgggagaacaacaagaaagcagctgtggaagctgagctcaagaaaatggaggagcaattggagaagaagaaggcagagtatgtggagcagatgaagaacaaaatagctcaaattcacaaggaagcagaagagaagagagcgatgattgaagctaagcgtggagaagaaattctcaaagcagaggaattagcagccaagtaccgtgccactggaaccgctcccaaaaagcttttcggatgcatgtgatctctaatcatctcgatggggaaacaaatgaaatatggtatttgatgtaatgacgttctttagtttgcttaatgtgggtttaatatggcaacatagaaagttataaggtcaacatcttatattgattgggctgcgtttgttaatttgatttgtatttgtacatcttttcattgaaaggctttctcttagctttatgaattggtaagtacaataatacatatttgttctttaaaaaaaa

SEQ ID NO: 876 - protein, 229 aa, Arabidopsis thaliana
  G1398
MTTRNRTSLPNISSSVSSNKNIVVPNIMAEEEPKKVTETVSEPTPTPEVPVEKPAAAADVAPQEKPVAPPPVLPSPAPAEEKQEDSKAIVPVVPKEVEEEKKEGSVNRDAVLARVETEKRMSLIKAWEEAEKCKVENKAEKKLSSIGSWENNKKAAVEAELKKMEEQLEKKKAEYVEQMKNKIAQIHKEAEEKRAMIEAKRGEEILKAEELAAKYRATGTAPKKLFGCM

SEQ ID NO: 877 - DNA, 1674 bp, Arabidopsis thaliana
  G1399
aggtcgaattttctgaaattaagattcattcctccatggaagaagctctgtttttattctctttagcttagcttagcttctactgatctgtttttgctacaaaatcccatctttttctttaaaactctttatctctgaatcttgagtttcttgtagaagaagaagcaattttgaatctttcgtaatcataaagattcgtggaggatctctactgatttgtcggaatctctcactacagaatcacttgatcttatgtccggatggaggagagagaaggaaccaacatcaacaacaacatcactagcagtttcggcttgaagcagcaacatgaagctgctgcttctgatggtggttactcaatggacccaccaccaagacccgaaaaccctaacccgtttttagtcccacccactactgtccccgcggccgccaccgtagcagcagctgttactgagaatgcggctactccgtttagcttaacaatgccgacggagaacacttcagctgagcagctgaaaaagaagagaggtaggccgagaaagtataatcccgatgggactcttgtcgtgactttatcgccgatgccaatctcgtcctctgttccgttgacgtcggagtttcctccaaggaaacgaggaagaggacgtggcaagtctaatcgatggctcaagaagtctcaaatgttccaattcgatagaagtcctgttgataccaatttggcaggtgtaggaactgctgattttgttggtgccaactttacacctcatgtactgatcgtcaacgccggagaggatgtgacgatgaagataatgacattctctcaacaaggatctcgtgctatctgcatcctttcagctaatggtcccatctccaatgttacgcttcgtcaatctatgacatccggtggtactctaacttatgagggtcgttttgagattctctctttgacgggttcgtttatgcaaaatgactctggaggaactcgaagtagagctggtggtatgagtgtttgccttgcaggaccagatggtcgtgtctttggtggaggactcgctggtctctttcttgctgctggtcctgtccaggtaatggtagggacttttatagctggtcaagagcagtcacagctggagctagcaaaagaaagacggctaagatttggggctcaaccatcttctatctcctttaacatatccgcagaagaacggaaggcgagattcgagaggcttaacaagtctgttgctattcctgcaccaaccacttcatacacgcatgtaaacacaacaaatgcggttcacagttactatacaaactcggttaaccatgtcaaggatcccttctcgtctatcccagtaggaggaggaggaggtggagaggtaggagaagaagagggtgaagaagatgatgatgaattagaaggtgaagacgaagaattcggaggcgatagccaatctgacaacgagattccgagctgatgatgatcatacggtttcttttcgcggatttgttaggtttgatggatttcagattttggttgattgtttttattaacacagaatgtttagaagctgctatctttaggttcccatcctcttgtgattgttgagtatccttgttagaaacaaacttactgttgcaaaactctcttcaaaaaagtttcactttgctttccca

SEQ ID NO: 878 - protein, 404 aa, Arabidopsis thaliana
  G1399
MEEREGTNINNNITSSFGLKQQHEAAASDGGYSMDPPPRPENPNPFLVPPTTVPAAATVAAAVTENAATPFSLTMPTENTSAEQLKKKRGRPRKYNPDGTLVVTLSPMPISSSVPLTSEFPPRKRGRGRGKSNRWLKKSQMFQFDRSPVDTNLAGVGTADFVGANFTPHVLIVNAGEDVTMKIMTFSQQGSRAICILSANGPISNVTLRQSMTSGGTLTYEGRFEILSLTGSFMQNDSGGTRSRAGGMSVCLAGPDGRVFGGGLAGLFLAAGPVQVMVGTFIAGQEQSQLELAKERRLRFGAQPSSISFNISAEERKARFERLNKSVAIPAPTTSYTHVNTTNAVHSYYTNSVNHVKDPFSSIPVGGGGGGEVGEEEGEEDDDELEGEDEEFGGDSQSDNEIPS

SEQ ID NO: 879 - DNA, 894 bp, Arabidopsis thaliana
  G1412
atgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatga

SEQ ID NO: 880 - protein, 297 aa, Arabidopsis thaliana
  G1412
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 881 - DNA, 1651 bp, Arabidopsis thaliana
  G1417
tctatctctatctatctctctttgtctgcaaatggaagaacatattcaagatcgccgtgaaattgcgttcttacactcaggagaatttctccacggagattctgactcaaaggatcatcaaccgaacgagtctccggtggaacgtcatcacgagtcgtctatcaaagaagttgatttcttcgctgctaaaagtcagccgtttgatcttggtcatgtgagaacaacgacgatcgttggatcatctggttttaatgatggattaggtttggtaaattcatgtcatggaacatcaagcaatgatggcgatgacaaaaccaaaactcaaattagtagactgaagttggagctagagaggcttcacgaggagaatcacaaactgaagcatttattagatgaggtcagtgagagttacaacgacctccaaagaagagttttgttagcaagacaaacacaagtggaaggtcttcatcataaacaacatgaggatgtacctcaagctggttcctcacaagctctagagaacagaagaccaaaggatatgaaccatgaaactccggccaccaccttgaaacgacggtctccagacgacgtggatggtcgtgatatgcaccgaggatcaccaaaaactcctcgaatagaccaaaacaagagtactaatcatgaagaacaacaaaaccctcatgatcaattaccctatagaaaagctagggtttccgttagagctagatctgatgccactacggtaaatgacggatgtcaatggagaaaatacggtcagaaaatggcgaaagggaatccatgtcctcgcgcttattatcgttgcaccatggccgttggatgtcctgtccgtaaacaggtccaacgatgcgcggaggatacaactatcttgacaacaacgtacgaaggaaaccataaccatcctcttcccccgtcagccacagccatggctgcaaccacctccgccgcagcagccatgctcttatcaggctcctcctccagcaacctccaccaaacactctctagcccctccgccacgtcatcatcatccttctaccataacttcccatacacctccacaatcgcaacactctctgcctcagctcctttccccaccataaccttagacctcaccaacccacctcgaccgctacaaccgccaccgcagtttctaagccagtatggtcccgccgcgtttttaccaaacgctaatcaaattaggtctatgaataataataaccagcagttattaatacctaatttgtttggcccacaagccccaccacgtgaaatggtcgattcagttagggctgcgattgcgatggatccgaacttcacggcggcacttgcggccgcgatctcaaacattatcggaggaggtaataacgacaacaataataatactgatattaatgataacaaggttgatgcaaaaagtggagggagtagtaacggagattcgccacagcttcctcagtcttgcaccactttctctacaaactaattttactaccattattatatgttatcttattatatattacacacacatattatacattatgcgtatcttaagtttttttttgggggccattatatatgaatgatatggagatcactgagagagagagagagctattatgggttttttttt

SEQ ID NO: 882 - protein, 489 aa, Arabidopsis thaliana
  G1417
MEEHIQDRREIAFLHSGEFLHGDSDSKDHQPNESPVERHHESSIKEVDFFAAKSQPFDLGHVRTTTIVGSSGFNDGLGLVNSCHGTSSNDGDDKTKTQISRLKLELERLHEENHKLKHLLDEVSESYNDLQRRVLLARQTQVEGLHHKQHEDVPQAGSSQALENRRPKDMNHETPATTLKRRSPDDVDGRDMHRGSPKTPRIDQNKSTNHEEQQNPHDQLPYRKARVSVRARSDATTVNDGCQWRKYGQKMAKGNPCPRAYYRCTMAVGCPVRKQVQRCAEDTTILTTTYEGNHNHPLPPSATAMAATTSAAAAMLLSGSSSSNLHQTLSSPSATSSSSFYHNFPYTSTIATLSASAPFPTITLDLTNPPRPLQPPPQFLSQYGPAAFLPNANQIRSMNNNNQQLLIPNLFGPQAPPREMVDSVRAAIAMDPNFTAALAAAISNIIGGGNNDNNNNTDINDNKVDAKSGGSSNGDSPQLPQSCTTFSTN

SEQ ID NO: 883 - DNA, 1164 bp, Arabidopsis thaliana
  G1425
actctctcaaaccataaaaaatattctccgatcatcattttaatggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcacatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttgaaaacaatttacgatgaagaatttttaaaatttgtgtatatatatacggtttgagtgattagggggcattgggggatttatttacggttgattattattgtagtgttatagaactaaggagattaaattaaatagattggaggaaaaaaaaaaaaaaaaa

SEQ ID NO: 884 - protein, 320 aa, Arabidopsis thaliana
  G1425
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 885 - DNA, 1410 bp, Arabidopsis thaliana
  G1426
atgaatcagaatcttcatgtattatcaatggattcgttaccagttggattaagattccgtccaacagacgaggagctaatccgttactatctccgtaggaaaatcaacggtcacgatgacgacgtcaaagctatccgtgagatcgatatttgcaaatgggaaccttgggatttacctgatttttctgtgatcaaaactaaagactcagagtggctctacttctgtccattggatcggaagtatccgagtggaagtagacagaaccgggcaacagttgcagggtactggaaagccacaggaaaagaccggaagataaaatccggtaagactaacattattggtgtgaagagaactctagttttccacgcgggtagagctcctagggggacacgaaccaattggattattcatgagtatcgtgccacggaggatgatcttagtggtaccaatcctggccagagtccgtttgttatatgcaaattgttcaagaaagaagaactggttttaggggaagaagattcgaagtcagatgaagttgaagaacctgctgtctcgtctccaactgtcgaagtgactaagtcagaagtatctgaggtaattaaaacagaagacgtgaagcgtcatgacatagcagaatcttctcttgtaatctctggagattctcatagtgatgcttgtgatgaggctacaaccgcagagcttgtagattttaaatggtatccggaattggagtccttagatttcacgctgttctctccattacactctcaagtccaatctgagcttggatcctcttacaacacattccagcctggctcgagtaatttttcagggaacaacaacaacagcttccaaatccagactcagtatggtacaaatgaagtagatacgtatatatctgattttcttgattcgattctcaagagcccagacgaggatccagagaagcacaagtatgttttgcaaagtggttttgatgttgtagcaccagatcagattgcgcaagtgtgtcaacagggctcagcagttgacatgagcaatgatgtttcagtgacgggtatccagattaagagtcgccaggcacaaccctcaggttataccaatgactatatagcgcagggaaatggtccaagaaggctgcgtctgcaaagtaactttaatggcattaacacgaagaatcctgagcttcaagctataaagagagaggctgaggacacggttggagaaagtataaagaaaaggtgtggaaagctaatgagatcaaagaacgtgaccggttttgtgtttaaaaagattacgtcggtgaaatgttcatatggaggactctttagggcggcagtagttgcagttgtgttcttgatgtcagtctgcagtctaaccgtcgacttcagagcatctgcagtgtcctga

SEQ ID NO: 886 - protein, 469 aa, Arabidopsis thaliana
  G1426
MNQNLHVLSMDSLPVGLRFRPTDEELIRYYLRRKINGHDDDVKAIREIDICKWEPWDLPDFSVIKTKDSEWLYFCPLDRKYPSGSRQNRATVAGYWKATGKDRKIKSGKTNIIGVKRTLVFHAGRAPRGTRTNWIIHEYRATEDDLSGTNPGQSPFVICKLFKKEELVLGEEDSKSDEVEEPAVSSPTVEVTKSEVSEVIKTEDVKRHDIAESSLVISGDSHSDACDEATTAELVDFKWYPELESLDFTLFSPLHSQVQSELGSSYNTFQPGSSNFSGNNNNSFQIQTQYGTNEVDTYISDFLDSILKSPDEDPEKHKYVLQSGFDVVAPDQIAQVCQQGSAVDMSNDVSVTGIQIKSRQAQPSGYTNDYIAQGNGPRRLRLQSNFNGINTKNPELQAIKREAEDTVGESIKKRCGKLMRSKNVTGFVFKKITSVKCSYGGLFRAAVVAVVFLMSVCSLTVDFRASAVS

SEQ ID NO: 887 - DNA, 1281 bp, Arabidopsis thaliana
  G1435
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 888 - protein, 298 aa, Arabidopsis thaliana
  G1435
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 889 - DNA, 1090 bp, Arabidopsis thaliana
  G1448
atgtctgtatctgtagcagcagagcatgattacataggtttgtcagagtttccaaccatggaagcaacaacaatgtctgacaaaaccaaaaccagagacaataacaacggtctcaatttcaaggctaccgagttaagactcggtttacccggttctgagtcgccggagcgagtcgactcaagattcttggctctcaacaagagtagctgtcccgtgtcaggtgccaaaagggtgttctccgacgctattaacgactctaacaaatgggtcttctctcctggatccactactgctactggtgatgtcggctcgggttctggtccccgtacctccgtcgttaaagatggaaagtcgacaactttcactaaaccggctgttccggttaaggagaagaagagctctgctacagctccagcttcaaaagcacaagtggtgggatggccaccaataagatcattcaggaagaactcaatggcttcttctcaatctcagaaacctggtaataactcagagactgaagaagcagaagctaagtctggaccagaacaaccttgcttgtatgtcaaagtgagtatggaaggtgctccttacttgaggaaaatcgatctcaagacttacaaaagctaccttgagctctcttctgctcttgagaagatgttcagttgcttcaccattggtcagtttggttctcatggagggtgtggcagagatgggttaaacgagagtcgcttgactgatctcttgcgtggttctgagtatgttgtaacctatgaagataaagacagtgactggatgctggtcggagatgtcccttgggaaatgtttatatgctcctgcaagaagctgagaatcatgaagagctctgaggctatcggcttagctccaagggtgatggagaagtgcagaagcaggaactaggaaaagcccttttatgtgataatatatgatttgaaaaaatatgtttttaagaaattgaatagccattttgttttgaagtattcttgtgtgtttgtgtgctaggagtgatgtttgatctttcttaaaccagcctctactaagctctaataaggcctcttcctcttaaaaaaaa

SEQ ID NO: 890 - protein, 305 aa, Arabidopsis thaliana
  G1448
MSVSVAAEHDYIGLSEFPTMEATTMSDKTKTRDNNNGLNFKATELRLGLPGSESPERVDSRFLALNKSSCPVSGAKRVFSDAINDSNKWVFSPGSTTATGDVGSGSGPRTSVVKDGKSTTFTKPAVPVKEKKSSATAPASKAQVVGWPPIRSFRKNSMASSQSQKPGNNSETEEAEAKSGPEQPCLYVKVSMEGAPYLRKIDLKTYKSYLELSSALEKMFSCFTIGQFGSHGGCGRDGLNESRLTDLLRGSEYVVTYEDKDSDWMLVGDVPWEMFICSCKKLRIMKSSEAIGLAPRVMEKCRSRN

SEQ ID NO: 891 - DNA, 799 bp, Arabidopsis thaliana
  G1449
tagacagagagaaatagaaatagagagagagagacatgaagagcactctcaatagagaagagaaggaagcatgaagctagctctgcagcttcaaggtctcattaatggaggtctctaactcttgttcttcattttcttcatcctctgtcgacagtactaaaccttctccttctgaatcttctgttaatctctcccttagtctcacatttccttctacttctccacaaagagaagcaagacaagattggccaccgataaagtctagattaagagatacactaaagggtcgtcgtcttcttcgtcgtggtgatgacacttctctctttgttaaggtttatatggaaggtgttcccattggaagaaaactcgacctttgcgtattctcaggctacgagagtctattagaaaatctctctcacatgttcgatacttcaatcatctgcggtaatcgagatcgaaaacatcatgttttgacatatgaagacaaggatggagattggatgatggtcggagatattccatgggatatgtttcttgaaaccgtgagaagactaaagatcacgagaccggagaggtattaaaacttggatcggtcaaggctgtgattgcgcagttacgagacgtgtaagatttaggcattgatgaagagacttgaggcgggacggagctattgctgcatattgcaacaaaggccttgaagaagttggagaattgattgatgcatatatttatttatatgacacctttgagtgtgttttttcttataaataaatcacaatatccaagacttctctttaaa

SEQ ID NO: 892 - protein, 158 aa, Arabidopsis thaliana
  G1449
MEVSNSCSSFSSSSVDSTKPSPSESSVNLSLSLTFPSTSPQREARQDWPPIKSRLRDTLKGRRLLRRGDDTSLFVKVYMEGVPIGRKLDLCVFSGYESLLENLSHMFDTSIICGNRDRKHHVLTYEDKDGDWMMVGDIPWDMFLETVRRLKITRPERY

SEQ ID NO: 893 - DNA, 2816 bp, Arabidopsis thaliana
  G1451
tttgtacttccggagctaaagagttatagctactgtagtagctggaagtgaagaagattttttaatagattgtacggaaaaattagggttttcaaagtttggtttcttgaagttgaattagacatgaagctgtcaacatctggattgggtcaacagggtcatgaaggagagaagtgtctgaattctgagctatggcatgcttgtgctggaccattagtctctcttccatcatctggtagtcgagttgtttactttccacagggtcacagtgaacaggtagctgctacaactaataaggaagttgatggtcacatacccaattacccaagcctaccaccacaattgatatgccagctccataatgttacaatgcatgcagatgttgagacggatgaagtctatgctcaaatgacacttcaaccattgacaccggaggagcagaaggaaacatttgtaccgattgagttggggataccgagtaagcaacctagtaattatttttgtaagactctcacagctagtgataccagtacacatggagggttttctgttcctagacgtgctgctgagaaagtgtttcctccattggattacacactgcagccaccagctcaagaactgattgcaagggatctccatgatgttgaatggaagtttaggcatatctttcggggacagcccaaacggcatctcctaactactggatggagtgtctttgtcagtgccaagcgactagtagctggagattctgtcattttcatcaggaatgaaaagaatcaactctttttgggaattcgtcatgccactcggccgcagactattgtaccatcatctgttttatctagtgatagcatgcatattggactccttgctgctgctgcacatgcttctgcaactaatagctgtttcactgttttctttcatccaagggctagccaatctgagtttgtgatacaactttccaagtacattaaagccgtttttcacacgcgtatttcagttgggatgcgctttcgcatgctcttcgagacagaagagtcgagtgtccgcaggtacatgggtactataactggtattagtgatctagattctgttcgttggccaaactctcattggcgatctgtgaaggttggttgggatgaatcgactgcaggggagagacagccaagggtttctttatgggagattgagcctctgactacctttcctatgtatccatctctttttcctctcagactaaaacgtccatggcatgctggcacatcatctttgcctgatggaaggggtgatttgggaagtggtctaacatggctaagagggggaggtggagagcagcaaggtttgcttcctctaaattatccatctgttggtttgtttccatggatgcaacaaaggctggatctcagtcaaatggggactgataataatcagcaataccaagcaatgttagctgctgggttgcagaacatcggcggtggagatcctttaagacagcagtttgtacagctgcaagagcctcaccaccaatatcttcaacaatcagcttcccataattctgatttgatgcttcagcagcaacagcagcaacaagcgtcacgccatctcatgcatgctcaaacacagattatgagtgagaatcttccgcagcagaatatgcgacaagaagttagtaaccaaccagctggacagcagcaacagctacagcaaccggaccaaaatgcatatcttaatgctttcaaaatgcaaaatggccatcttcaacagtggcagcagcaatcagagatgccatctccctcgttcatgaagtcagattttactgactcaagcaacaaatttgcaacaactgctagtccggcttctggagatggcaatcttttgaatttttctataaccggtcagtctgtactccctgagcagttaacaacagagggctggtctccaaaagcatccaacactttttctgaaccgttgtcacttccacaagcctatcctgggaagagtcttgctctagaacccggaaatccgcagaatccctctcttttcggtgttgatcccgactctggactcttcctccccagtacggttccccgctttgcttcttcatcaggagatgctgaagcttcccctatgtcactaacagattcaggatttcagaattccttatatagctgcatgcaagacacaactcatgagttattgcatggagctggacagattaactcgtccaaccaaaccaagaactttgtaaaggtttataaatctggttcggttgggcgttcattagacatctcccgattcagcagctaccacgagctgcgagaagagttagggaagatgtttgctatcgaagggttgttggaagacccccttagatcaggctggcagcttgtattcgttgacaaggaaaatgatattcttctccttggtgatgacccatgggagtcatttgtgaataacgtttggtacataaagatactatcaccagaagatgtgcatcaaatgggagatcatggagaaggcagtggtgggttattcccgcaaaacccgacccatctctagaagctgcttcggtgttagtctcatcatgctacaacgcgggagccctttgtttcccatttgaagtcgtttccactcatctttatatgccattcgttcgcatctctctcgttttgacgtttttagaaagaaacataatcatatttgtgagtatgggtcctgaaactttaggacgtactttagcttgtattagacagacactctcgtcataaacataagaacctttatgtagctgtctcagggtaactaaacttttctag

SEQ ID NO: 894 - protein, 811 aa, Arabidopsis thaliana
  G1451
MKLSTSGLGQQGHEGEKCLNSELWHACAGPLVSLPSSGSRVVYFPQGHSEQVAATTNKEVDGHIPNYPSLPPQLICQLHNVTMHADVETDEVYAQMTLQPLTPEEQKETFVPIELGIPSKQPSNYFCKTLTASDTSTHGGFSVPRRAAEKVFPPLDYTLQPPAQELIARDLHDVEWKFRHIFRGQPKRHLLTTGWSVFVSAKRLVAGDSVIFIRNEKNQLFLGIRHATRPQTIVPSSVLSSDSMHIGLLAAAAHASATNSCFTVFFHPRASQSEFVIQLSKYIKAVFHTRISVGMRFRMLFETEESSVRRYMGTITGISDLDSVRWPNSHWRSVKVGWDESTAGERQPRVSLWEIEPLTTFPMYPSLFPLRLKRPWHAGTSSLPDGRGDLGSGLTWLRGGGGEQQGLLPLNYPSVGLFPWMQQRLDLSQMGTDNNQQYQAMLAAGLQNIGGGDPLRQQFVQLQEPHHQYLQQSASHNSDLMLQQQQQQQASRHLMHAQTQIMSENLPQQNMRQEVSNQPAGQQQQLQQPDQNAYLNAFKMQNGHLQQWQQQSEMPSPSFMKSDFTDSSNKFATTASPASGDGNLLNFSITGQSVLPEQLTTEGWSPKASNTFSEPLSLPQAYPGKSLALEPGNPQNPSLFGVDPDSGLFLPSTVPRFASSSGDAEASPMSLTDSGFQNSLYSCMQDTTHELLHGAGQINSSNQTKNFVKVYKSGSVGRSLDISRFSSYHELREELGKMFAIEGLLEDPLRSGWQLVFVDKENDILLLGDDPWESFVNNVWYIKILSPEDVHQMGDHGEGSGGLFPQNPTHL

SEQ ID NO: 895 - DNA, 804 bp, Arabidopsis thaliana
  G1468
atgcatggagccatgaactcaccatgcattgatttcgtaatgttcagtcgtggacaacacgatgaggacaacatgtcacgtcgtcctccgtggaagagggagagatcgatgtccactcagcatcatcatcttaacttgtctccaaacgaagacgaagagcttgccaactgtcttgtcttgttgtccaattcaggggatgcgcatggtggtgatcagcataaacaacatggacatggtaagggcaaaaccgtcaaaaagcaaaaaaccgcccaggttttccaatgcaaagcttgcaagaaggtgttcacgtcgcatcaggcattgggtggacacagggcaagccacaagaaagtgaagggttgttttgcctctcaagataaagaagaggaagaggaagaggaatacaaagaagacgacgacgacaacgacgaggacgaagatgaggaggaggatgaggaagacaaatcaacggctcatatcgcaagaaagagatccaacgctcacgaatgcaccatctgccatcgcgtcttctcttcgggacaggccttaggaggccacaagcgatgccattggctaacaccttccaattatcttcgtatgacgtcgctccacgatcatcatcattccgtcggcagaccgcagccgttagatcaaccatctctcgatctcaacttagcttgccaagaatattccgtcgatccaacggccatgagcgtagggatgatcgagagagatggtggtggcaataatcacaacgctacttcatcttcgtggttaaaactcgcaagtggtgattggtcttga

SEQ ID NO: 896 - protein, 267 aa, Arabidopsis thaliana
  G1468
MHGAMNSPCIDFVMFSRGQHDEDNMSRRPPWKRERSMSTQHHHLNLSPNEDEELANCLVLLSNSGDAHGGDQHKQHGHGKGKTVKKQKTAQVFQCKACKKVFTSHQALGGHRASHKKVKGCFASQDKEEEEEEEYKEDDDDNDEDEDEEEDEEDKSTAHIARKRSNAHECTICHRVFSSGQALGGHKRCHWLTPSNYLRMTSLHDHHHSVGRPQPLDQPSLDLNLACQEYSVDPTAMSVGMIERDGGGNNHNATSSSWLKLASGDWS

SEQ ID NO: 897 - DNA, 735 bp, Arabidopsis thaliana
  G1471
atggagaaccaatctatgtcttcatcaagctcctccacacacaaacatgatcaaaaactcaaaagttccgttgtggccatggaggtcctggaggagaaggagacagtgaacaatccgccccagtattataataagatctacatctgttacttgtgcaagagagcgttcccaacccctcatgcccttggcggtcacggaaccacccacaaggaggaccgagaattggagaggcaacagatcgagtcaaggctttctaacaaagacaagtctaacttgctctttggtgggtcttcacaagatgttttatcaaatgataatcaccttggactctctcttggtccattgaagtccatagaaggtagcagcagcagcaacaacgttaacccattgcttaatgttggagtccctagaggaaccacagatatgaacatgaacaactatagctcacatgctttatcaactgatgatattaatcttgatcttactcttggtccatctaagtccataggagatagcaacaatatcattaataacaacactaactcatccttcgatgggaatctgatcattcccgttcgtcctcgtgtgtctagataccattttgttgctgggaacccccttgattcaatctctagaaacattcctccttctattacttttcctcatctaaacatcaatctttctcatgattcgttttctttacaagagaatggttcgggctctagtcactcataa

SEQ ID NO: 898 - protein, 244 aa, Arabidopsis thaliana
  G1471
MENQSMSSSSSSTHKHDQKLKSSVVAMEVLEEKETVNNPPQYYNKIYICYLCKRAFPTPHALGGHGTTHKEDRELERQQIESRLSNKDKSNLLFGGSSQDVLSNDNHLGLSLGPLKSIEGSSSSNNVNPLLNVGVPRGTTDMNMNNYSSHALSTDDINLDLTLGPSKSIGDSNNIINNNTNSSFDGNLIIPVRPRVSRYHFVAGNPLDSISRNIPPSITFPHLNINLSHDSFSLQENGSGSSHS

SEQ ID NO: 899 - DNA, 813 bp, Arabidopsis thaliana
  G1472
atgaacaaccaatctatgtcttcttcaagctcctcctccccacacaaacatgatcaaaaactcaaaagtgcccttgtggccgtggaggagaaggagacaataaacaatccgaaacaaaggtctcctcaagagattgtgtctgaaaggacaaaccttgagatgcctagtttcagattaagttttttccgaaagaaaagagataccgtgctaatacatcctcccaaggataacaagatcagccacacctgtcgtttctgcaagaggaatttcaaaagctgttttgccctaggcggtcacatgaagtgccacaaaaaggaacgagaattggagaagcagcgaaagataatcgaggatgcgatgctttgtgatagtactcctttcaccttgcaaaggcttcctgttggcccttgtaagtatggccaaggtggtagctcacatgctttatcaactgatggtattaatcttgatctaactcttggtccatccaagtccacaggaggcagcaacaatagcactaataacaacactaactcatcgttccatgggaatctaatgactcccgtgggtccttgtgtgcctagatacagtttggttgctggaaaccaggttgattcaagcaatatacatgttcctgcttatccaaccaccgatctttgttatgatttttttgctttacaagagcatggttcgggctctagtcactcaaaaagtctcatctcaaaggggaaaaacaaagtcatggtgcctgaagatgatgaggatatcgggatgataaggtggttgcccaagaaaaaaagatcaagaggagagtag

SEQ ID NO: 900 - protein, 270 aa, Arabidopsis thaliana
  G1472
MNNQSMSSSSSSSPHKHDQKLKSALVAVEEKETINNPKQRSPQEIVSERTNLEMPSFRLSFFRKKRDTVLIHPPKDNKISHTCRFCKRNFKSCFALGGHMKCHKKERELEKQRKIIEDAMLCDSTPFTLQRLPVGPCKYGQGGSSHALSTDGINLDLTLGPSKSTGGSNNSTNNNTNSSFHGNLMTPVGPCVPRYSLVAGNQVDSSNIHVPAYPTTDLCYDFFALQEHGSGSSHSKSLISKGKNKVMVPEDDEDIGMIRWLPKKKRSRGE

SEQ ID NO: 901 - DNA, 944 bp, Arabidopsis thaliana
  G1474
caatattgtcatatacaatggagaaacctggtggcttctggatccccaagaaaagcaacaaagagtcatcttgggaagagctggcctttgcagaagacgatgccgccggatctttgtggccgccaagatcttatacgtgtagcttctgccggagagaatttaaatcggctcaagccctcggtggccatatgaacgttcaccgaagagacagagcacggcttaagcaagccgacgaccaatacttattccccaaatcttcttcgtctccagagtatccatctcataaagatagcgataatattcatgaaacctcttgctatactttggtttttaacaccaaacctaattattttaagactcaacactcttgtgttattgatctttcttcgtcttcttctttaccatatttgactccttctagggtttcttctggtttgcctggaaagcaacatacttcttcttctcctccttctttcgttgtagaaccttccaagaactctaaatatattccctcttcttccccatggtcgtgcccaagtactgttgtggagcaaaagagttgtgatctatatgaaattccggctatggaaggagaaaagaagagaaagactgagagtgatgtgccaaaaatcgggcataaagcaaaacttagtcttggaaacaccactgatctctcggtgagtatgaatctggtcatccaccaaagttttccgattactgctcacggtagcgatgaagagattggtagggtggatatccgtaaaagaagacgaagacatgagagtccgtcgcagcagtcgattttcatttcaagtttatcttgtaagagtgacataattacaagaaacgaggaaagcaaacacaaaggtgatcgctttgaggatttagatcttgagcttaggctagggactgatccaccaaaaggaatttgattgatggaccga

SEQ ID NO: 902 - protein, 304 aa, Arabidopsis thaliana
  G1474
MEKPGGFWIPKKSNKESSWEELAFAEDDAAGSLWPPRSYTCSFCRREFKSAQALGGHMNVHRRDRARLKQADDQYLFPKSSSSPEYPSHKDSDNIHETSCYTLVFNTKPNYFKTQHSCVIDLSSSSSLPYLTPSRVSSGLPGKQHTSSSPPSFVVEPSKNSKYIPSSSPWSCPSTVVEQKSCDLYEIPAMEGEKKRKTESDVPKIGHKAKLSLGNTTDLSVSMNLVIHQSFPITAHGSDEEIGRVDIRKRRRRHESPSQQSIFISSLSCKSDIITRNEESKHKGDRFEDLDLELRLGTDPPKGI

SEQ ID NO: 903 - DNA, 414 bp, Arabidopsis thaliana
  G1476
atggagtgtgagagatcatcgtcgtccacgtcatcagaaaccggagcagtcaggcaccgtcgtacgtcgtcgtcgtcagtctccaccgtgacgagacgaatgtacgagtgcactttctgcaaaagaggtttcacaaacgcacaagctttaggtggtcatatgaacatccatcgacgtgaccgtctcaacaaggccaaggtgcaaaacgatgctgacgtggcactctcgcaaactcatagatgtttccacgtggcgtctgaccttggaggctacgagcaagtagactccgtcgtgttgaggacgacgacctcgaactacatccaacacttacgaatcggctcgatggctacaaggagagaaaacgtcgtcgttgaaggaaatgaaatcgatttggagctgcgtcttggcttatga

SEQ ID NO: 904 - protein, 137 aa, Arabidopsis thaliana
  G1476
MECERSSSSTSSETGAVRHRRTSSSSVSTVTRRMYECTFCKRGFTNAQALGGHMNIHRRDRLNKAKVQNDADVALSQTHRCFHVASDLGGYEQVDSVVLRTTTSNYIQHLRIGSMATRRENVVVEGNEIDLELRLGL

SEQ ID NO: 905 - DNA, 1131 bp, Arabidopsis thaliana
  G1482
cgtcgacaccaccatctctatctctctcttaatcgatcgatgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaattttactatcttccctaaatgggggagttttttttttgtttgtttgtttctccttcatttctcccaactttgatctcagaattaggcgcggccgct

SEQ ID NO: 906 - protein, 331 aa, Arabidopsis thaliana
  G1482
MKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 907 - DNA, 525 bp, Arabidopsis thaliana
  G1483
gttgaaggatgaagatacaatgtgaagtgtgtgaaaaggctgaagcagaagtactttgttgttcagatgaagctgtactatgcaagccatgtgacattaaggttcatgaagctaataaacttttccaaagacatcaccgagtcgccttacaaaaagatgcagcctcagccaccacagcttctggagctcctctatgtgatatctgccaggagagaaaagggtacttcttctgcttagaggatagagcaatgctgtgcaatgattgtgatgaagccattcacacttgcaattctcaccaaagattcttactttctggagtacaagtttctgatcagtctttgactgaaaactccgaatgcagcactagttttagctctgaaacttaccagattcagtcaaaagtgtctctgaatagtcagtactctagtgaggaaactgaagctggaaactcaggtgagatagtacacaagaatccttctgtaatcttaagtccttagagatatacacacaacatcatggttccgg

SEQ ID NO: 908 - protein, 162 aa, Arabidopsis thaliana
  G1483
MKIQCEVCEKAEAEVLCCSDEAVLCKPCDIKVHEANKLFQRHHRVALQKDAASATTASGAPLCDICQERKGYFFCLEDRAMLCNDCDEAIHTCNSHQRFLLSGVQVSDQSLTENSECSTSFSSETYQIQSKVSLNSQYSSEETEAGNSGEIVHKNPSVILSP

SEQ ID NO: 909 - DNA, 1453 bp, Arabidopsis thaliana
  G1490
attcatcagggccctgtgttctctgagtcaagtcaggaactgatgaataaccctgtaccgtgtcagtcggtctctggtggcaattctggtggttatttgtttccttcttcctctggatactgcaatgtttcagctgtcttgcctcatggaaggaatttgcaaaaccagccacctgtttccaccgtgcctagagacagattggctatgcaggattgtcctttgatagctcaatcctcgttgattaatcatcaccctcaagagttcatagatccacttcatgagttctttgatttctctgatcatgttcctgttcagaatctacaagcagagagtagtggagtaagggtggactcatccgtggaacttcataagaaaagtgaatggcaagattgggcagatcagctgatttctgttgacgatggttctgagccaaattggtctgaacttcttggagattcaagttcccacaatccaaattcagagatacctacaccatttttggatgtaccaaggctagatataacagctaaccagcagcaacagatggtttcatcagaggaccagctcagcggcagaaactcatcatctagtgtagcaacatctaaacaacgtatgcgttggacaccagaacttcacgaggcattcgttgaagctgttaatcagcttggtggtagtgaacgagccacccctaaggctgttttgaagctcttgaataaccctggcttgaccatttatcatgtaaaaagccatttgcagaaatatagaacggcaaggtataaaccggagacttcggaagttacaggagaacctcaagagaagaagatgacatctattgaagatatcaaatctcttgacatgaaaacgagcgttgagatcacacaagctctacggttacaaatggaagtgcagaaacgtctccacgagcagctcgagatccaacggtcactgcagttacagattgaaaaacagggccggtacctacagatgatgttcgagaaacaacaaaagatacaagacaacaagagctcttcttcagaagcatcaccaaagcaatgcaatggttcatttgcagaagttgaagttggtcttgagacactaacaggggaccaaaatgaatctgcttcagcatcaaggaaacgtgtcagagaagattaaagcatgtttaatttgatctcgtttgacgaaacatgtttattgggaattaattgtggaaaccaactccagttttgttaaaagaatctgtttctttcttagctctgtattgttctagtttagaagcagttgatttggccttgcatggctgcaacactaactaaagagtaaagactaattgtgtatatctacatatacatttttggggacgatttgtgtcgaaaaatcctttttcaatttttgatattgtatgtttagtccctacaaaatcaatcagacaagatattttctttaggacaaa

SEQ ID NO: 910 - protein, 370 aa, Arabidopsis thaliana
  G1490
MNNPVPCQSVSGGNSGGYLFPSSSGYCNVSAVLPHGRNLQNQPPVSTVPRDRLAMQDCPLIAQSSLINHHPQEFIDPLHEFFDFSDHVPVQNLQAESSGVRVDSSVELHKKSEWQDWADQLISVDDGSEPNWSELLGDSSSHNPNSEIPTPFLDVPRLDITANQQQQMVSSEDQLSGRNSSSSVATSKQRMRWTPELHEAFVEAVNQLGGSERATPKAVLKLLNNPGLTIYHVKSHLQKYRTARYKPETSEVTGEPQEKKMTSIEDIKSLDMKTSVEITQALRLQMEVQKRLHEQLEIQRSLQLQIEKQGRYLQMMFEKQQKIQDNKSSSSEASPKQCNGSFAEVEVGLETLTGDQNESASASRKRVRED

SEQ ID NO: 911 - DNA, 2090 bp, Arabidopsis thaliana
  G1493
cttgggttcgagctacatagagagaggtatgatgaatccgagtcacggaagaggactcggatcggctggtgggtccagctccggtagaaatcaaggaggtggtggtgagaccgtcgtcgagatgtttccttctggtcttcgagttcttgtcgttgacgatgacccaacttgtctcatgatcttagagaggatgcttaggacttgtctttacgaagtaacgaaatgcaacagagcagagatggcattgtctctgctccggaagaacaaacatggattcgatatagtaatcagtgatgttcatatgcctgacatggacggtttcaagcttcttgagcatgttggtctagagatggacttacctgttatcatgatgtctgcggatgattcaaagagtgtggttctaaagggagtaacgcacggtgcggttgattaccttatcaagcctgtacgtatggaggcacttaagaacatatggcagcatgtagttaggaagaggagaagtgaatggagtgtaccggaacattctgggagcattgaggagactggcgagagacagcagcagcaacatagaggaggtggtggtggtgcagctgtttctggtggagaggatgcggtggatgataactcatcctcggttaacgaaggtaacaattggaggagcagttcacggaagaggaaagacgaggaaggagaagagcaaggagatgataaggacgaagatgcgtcgaatttgaagaaaccgcgtgtcgtctggtctgttgaattgcatcagcagtttgttgctgctgttaatcagctcggcgttgagaaggcggttcctaaaaagatcttagagctgatgaatgttcctggtctaacccgagaaaacgtagcaagtcacctccagaaataccggatatatctaagacggcttggaggggtatcgcagcaccaaggcaatcttaacaactcgtttatgacgggtcaggatgcgagcttcggacctctttcgacattgaatgggtttgatcttcaagcactagccgtcacaggtcagttacctgcacagagtcttgcacagcttcaagccgctggtttaggccggcctgcgatggtctctaagtcaggtttgccggtttcctccattgtggatgagagaagcatcttcagctttgacaacacgaaaacaagatttggagaagggcttgggcatcacgggcaacaaccccaacagcaaccacagatgaacttacttcacggtgtccccacgggtttacaacagcagcttcctatgggtaatcgaatgagtattcaacaacagattgctgctgttcgagctggaaatagtgttcaaaacaacggaatgctgatgcctctagcgggtcagcagtctttgcctcggggaccaccgcctatgctaacctcttcgcaatcatccatcaggcagccgatgttatcaaaccgcatttccgagagaagtggtttctctggaaggaacaatatccccgagagcagcagagtgttaccgacaagttacactaatctcacaacacaacactcatcaagctcgatgccttataacaacttccaaccagaacttcccgtgaacagtttcccgctggcaagtgcaccagggatatcagtaccggttcggaaagccacttcttaccaggaagaggttaacagctccgaagcgggtttcactacgccgagctacgacatgttcaccaccagacagaatgattgggatctgaggaatattggaatagcctttgactcacatcaggactcagaatccgctgcgttttccgcttcagaagcctactcttcttcgtccatgtcaagacacaacacgacagttgcagccaccgagcatggccgaaaccaccagcagccaccatcgggaatggtacagcaccatcaggtttatgcagacggaaacggtggttcagtgagggtgaaatcagagagagtggctacggatacagcaacaatggcgtttcacgagcagtatagtaatcaagaagatcttatgagcgcacttcttaagcaggtttgatttgatttttttttttttttgtcaaacttatatagaagcataatctgatccg

SEQ ID NO: 912 - protein, 669 aa, Arabidopsis thaliana
  G1493
MMNPSHGRGLGSAGGSSSGRNQGGGGETVVEMFPSGLRVLVVDDDPTCLMILERMLRTCLYEVTKCNRAEMALSLLRKNKHGFDIVISDVHMPDMDGFKLLEHVGLEMDLPVIMMSADDSKSVVLKGVTHGAVDYLIKPVRMEALKNIWQHVVRKRRSEWSVPEHSGSIEETGERQQQQHRGGGGGAAVSGGEDAVDDNSSSVNEGNNWRSSSRKRKDEEGEEQGDDKDEDASNLKKPRVVWSVELHQQFVAAVNQLGVEKAVPKKILELMNVPGLTRENVASHLQKYRIYLRRLGGVSQHQGNLNNSFMTGQDASFGPLSTLNGFDLQALAVTGQLPAQSLAQLQAAGLGRPAMVSKSGLPVSSIVDERSIFSFDNTKTRFGEGLGHHGQQPQQQPQMNLLHGVPTGLQQQLPMGNRMSIQQQIAAVRAGNSVQNNGMLMPLAGQQSLPRGPPPMLTSSQSSIRQPMLSNRISERSGFSGRNNIPESSRVLPTSYTNLTTQHSSSSMPYNNFQPELPVNSFPLASAPGISVPVRKATSYQEEVNSSEAGFTTPSYDMFTTRQNDWDLRNIGIAFDSHQDSESAAFSASEAYSSSSMSRHNTTVAATEHGRNHQQPPSGMVQHHQVYADGNGGSVRVKSERVATDTATMAFHEQYSNQEDLMSALLKQV

SEQ ID NO: 913 - DNA, 902 bp, Arabidopsis thaliana
  G1499
tcgactccttaattgcatcaccaacctaacccctcatcatatgatcacctttctttttttcctttaatatatatatatgctcacacacacacatatatatatacatataagcatcgcctcaagcattaaaatttttacgaaccaaacaaacaaaaattatgaataattataatatgaacccatctctcttccaaaattacacttggaacaacatcatcaacagcagcaacaacaacaacaagaatgatgatcatcatcatcaacataataatgatccaatcggtatggccatggaccagtacacacagctccatatcttcaatcctttctcttcttctcatttccctcctctctcttcttccctcacaaccaccactcttctctccggagatcaagaagacgacgaagacgaagaagaacctctagaggaactcggtgctatgaaggaaatgatgtacaagatcgcagccatgcaatcggttgacatcgacccagcaaccgtcaagaaacccaaacgccgtaacgtgaggatctccgacgaccctcagagtgtggcggctagacatcgccgtgagagaatcagtgagaggatcagaattcttcagagactcgtgccaggtggcactaaaatggatacggcttcaatgctcgatgaagctatacgctatgtcaagttcttgaaacggcagatccggctactcaataataataccggatatactcctccgccgccgcaagatcaagcttctcaggcggtgacgacgtcatgggtttcaccgccaccaccgccaagtttcggccgtgggggaagaggagtaggagaattaatctagacaagatgacatttccattagtagtaactaaattatgctataatgtgtgagtaatggtgcaattatgga

SEQ ID NO: 914 - protein, 224 aa, Arabidopsis thaliana
  G1499
MNNYNMNPSLFQNYTWNNIINSSNNNNKNDDHHHQHNNDPIGMAMDQYTQLHIFNPFSSSHFPPLSSSLTTTTLLSGDQEDDEDEEEPLEELGAMKEMMYKIAAMQSVDIDPATVKKPKRRNVRISDDPQSVAARHRRERISERIRILQRLVPGGTKMDTASMLDEAIRYVKFLKRQIRLLNNNTGYTPPPPQDQASQAVTTSWVSPPPPPSFGRGGRGVGELI

SEQ ID NO: 915 - DNA, 876 bp, Arabidopsis thaliana
  G1504
atgaataacgatttgtggttacctgaagaggacttcaagggtctaccggataatttccttgataatctcgttgatcctaccaatgatgtttctgtagaagatatagagaccggcgatgatgagggagattgggatgccaaatttcaaaagctcgtacctccaccattggatgagctaatgagtttgtcctatgagttcacttgcaatggacagcgtgtgcaagttcagaagcatgtgccaattttgaagcagtcgagttcttcagaagtcttctctactgttgataactcccctcctaatgtcaaagtctcaaagttgttgcaatctttaagcccagtctcagtcctcaagaacaccaacggttctggctcaccccaaaacccaaacggagatcagaaactggcctttctcgtgaaaggcatcagaagcaagcgcaaacgccccacactactgagagttacattcctcaaatcatttctattagagatgtcacagcagtttgctccggatgaatctgaatcttctgagatttccgccttgaagaaacgcaagaagaacaagagtcgtcgcttgaaatgcactcattgcgagacaaccactaccccgcagtggagggaaggacctaatgggcgtaaaaccctttgcaatgcttgtggaatccgctttagatcgggccgtcttgttttagaataccgtccagcagcaagcccgaccttcatcccaaccgtgcattcaaatttgcacaagaagatcatatatatgagaatgaaagataacgaccagtttgataccagaaagatccgtgctgagacatccggaccagagactagatcaaggcttcgtaacttcggcagaccaatgagttatggtcaatga

SEQ ID NO: 916 - protein, 291 aa, Arabidopsis thaliana
  G1504
MNNDLWLPEEDFKGLPDNFLDNLVDPTNDVSVEDIETGDDEGDWDAKFQKLVPPPLDELMSLSYEFTCNGQRVQVQKHVPILKQSSSSEVFSTVDNSPPNVKVSKLLQSLSPVSVLKNTNGSGSPQNPNGDQKLAFLVKGIRSKRKRPTLLRVTFLKSFLLEMSQQFAPDESESSEISALKKRKKNKSRRLKCTHCETTTTPQWREGPNGRKTLCNACGIRFRSGRLVLEYRPAASPTFIPTVHSNLHKKIIYMRMKDNDQFDTRKIRAETSGPETRSRLRNFGRPMSYGQ

SEQ ID NO: 917 - DNA, 420 bp, Arabidopsis thaliana
  G1508
atgctagatcacagtgaaaaggtcttattggttgattcagaaaccatgaaaacaagagctgaagatatgatcgaacagaacaacactagtgttaacgacaagaagaagacttgtgctgattgtggaaccagtaaaactcctctttggcgtggtggtcctgttggtccaaagtcgttgtgtaacgcgtgtgggatcagaaacagaaagaagagaagaggaggaacagaagataataagaaattaaagaaatcgagttctggcggcggaaaccgtaaatttggtgaatcgttaaaacagagtttgatggatttggggataaggaagagatcaacggtggagaagcaacgacagaagcttggtgaagaagaacaagccgctgtgttactcatggctctttcttatggctctgtttacgcttag

SEQ ID NO: 918 - protein, 139 aa, Arabidopsis thaliana
  G1508
MLDHSEKVLLVDSETMKTRAEDMIEQNNTSVNDKKKTCADCGTSKTPLWRGGPVGPKSLCNACGIRNRKKRRGGTEDNKKLKKSSSGGGNRKFGESLKQSLMDLGIRKRSTVEKQRQKLGEEEQAAVLLMALSYGSVYA

SEQ ID NO: 919 - DNA, 1227 bp, Arabidopsis thaliana
  G1540
atctctttactaccagcaagttgttttcttgctaacttcaaacttctctttctcttgttcctctctaagtcttgatcttatttaccgttaactttgtgaacaaaagtcgaatcaaacacacatggagccgccacagcatcagcatcatcatcatcaagccgaccaagaaagcggcaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacgggaatttaaatcatgcaagctcaggtactgaatgtggtgttgttaatgcttctaatggctacatgagtagccatgtctatggatctatggaacaagactgttctatgaattacaacaacgtaggtggaggatgggcaaacatggatcatcattactcatctgcaccttacaacttcttcgatagagcaaagcctctgtttggtctagaaggtcatcaagacgaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaactagctcttacgccggtgtcgctcgggattaaagctctttcctctctctctctctttcgtactcgtatgttcacaactatgcttcgctagtgattaatgatgcagttgttatattagtagttaactagttatctctcgttatgtgtaatttgtaattactagctaagtatcgtctaggtttaattgtaattgacaaccgtttatctctatgatgaataagttaaatttatatat

SEQ ID NO: 920 - protein, 291 aa, Arabidopsis thaliana
  G1540
MEPPQHQHHHHQADQESGNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQDEEECGGDAYLEHRRTLPLFPMHGEDHINGGSGAIWKYGQSEVRPCASLELRLN

SEQ ID NO: 921 - DNA, 766 bp, Arabidopsis thaliana
  G1545
catcaccaatcttttgaatctaagagagagaagaagaagaaggtctagagaacgaaaagaagaaacatgaataaccagaatgtagatgatcataatcttctactcatttctcaattgtaccctaatgtctatactccattagtaccacaacaaggaggagaagcaaaaccaacacggcggaggaaaaggaagagcaagagtgttgtggtggcagaggagggtgaaaacgaaggcaatgggtggtttagaaagagaaaattgagtgatgagcaagtaagaatgttggagattagctttgaagacgatcataagcttgaatccgagaggaaagatcggcttgcttctgagttagggcttgatcctcgtcaagtcgccgtctggttccaaaaccgccgtgcacggtggaagaacaaacgagtcgaggatgaatacactaaactcaagaatgcatacgaaaccaccgtcgttgagaaatgtcgtcttgattctgaggttattcacctaaaggaacaactttacgaggctgaaagagagatccaacggcttgcaaaaagagttgaaggaactttaagtaacagtcctatctcatcctctgtgaccattgaagccaatcatacgacaccgttttttggagattacgacatcggatttgacggtgaggctgacgagaacttgctctactcgccagattacattgatggattagactggatgagccaatttatgtaaaaaactataagctaatctattttcagtcgtagtatag

SEQ ID NO: 922 - protein, 220 aa, Arabidopsis thaliana
  G1545
MNNQNVDDHNLLLISQLYPNVYTPLVPQQGGEAKPTRRRKRKSKSVVVAEEGENEGNGWFRKRKLSDEQVRMLEISFEDDHKLESERKDRLASELGLDPRQVAVWFQNRRARWKNKRVEDEYTKLKNAYETTVVEKCRLDSEVIHLKEQLYEAEREIQRLAKRVEGTLSNSPISSSVTIEANHTTPFFGDYDIGFDGEADENLLYSPDYIDGLDWMSQFM

SEQ ID NO: 923 - DNA, 1080 bp, Arabidopsis thaliana
  G1552
atggactggaatttcaaacttagctctggttatttatctggattcgatcaagaaccagatttatcaccaatggatggttcgatctcgtttggtgggtcgtcacagtcaaaagcggatttttcatttgatctaaaacttggaagaaacattggaaactcttcctctgtttttggtgatacagagcaagtgattagtcttagtaagtggaaagatagtgctttagctaaaccagaaggttcaagaagctcgagttcaaagagaacaagagggaatggtgttggaaccaaccagatgccgatttgtcttgttgatggatgtgattctgattttagtaattgtagagagtatcataagagacataaagtttgtgatgttcattcaaaaactcctgtggttactattaatggtcataaacagaggttttgtcaacaatgcagcaggtttcatgctttggaggagtttgatgaagggaagagaagttgtaggaaacgtcttgatggacataatcgaagacgacggaagccgcagcctgaacatatcggtcgtcctgccaacttctttacgggttttcaaggtagcaaattgctagagttttctggtggttcacatgtgtttccaactacatctgtgttgaacccgagctggggaaatagtcttgtaagcgttgctgtagccgccaatggttcgagttatgggcagagccagagctatgttgttggttcttctcctgcaaagacagggataatgtttccaatctcttcttctccaaacagtaccagaagcatagcaaaacaattccctttcttgcaagaagaagaaagctcgagaaccgcatcgttgtgtgagagaatgacgagttgcatccatgactctgattgtgctctctctcttctgtcatcctcctcgtcgtcagtccctcatttgcttcaaccaccactttctttgtcccaagaagcagttgagacagttttttacgggtcgggattgtttgagaatgcgagtgcagtctctgatggatcggttatatccggtaacgaggctgtccgtcttccgcagacattcccgtttcattgggagtag

SEQ ID NO: 924 - protein, 359 aa, Arabidopsis thaliana
  G1552
MDWNFKLSSGYLSGFDQEPDLSPMDGSISFGGSSQSKADFSFDLKLGRNIGNSSSVFGDTEQVISLSKWKDSALAKPEGSRSSSSKRTRGNGVGTNQMPICLVDGCDSDFSNCREYHKRHKVCDVHSKTPVVTINGHKQRFCQQCSRFHALEEFDEGKRSCRKRLDGHNRRRRKPQPEHIGRPANFFTGFQGSKLLEFSGGSHVFPTTSVLNPSWGNSLVSVAVAANGSSYGQSQSYVVGSSPAKTGIMFPISSSPNSTRSIAKQFPFLQEEESSRTASLCERMTSCIHDSDCALSLLSSSSSSVPHLLQPPLSLSQEAVETVFYGSGLFENASAVSDGSVISGNEAVRLPQTFPFHWE

SEQ ID NO: 925 - DNA, 1440 bp, Arabidopsis thaliana
  G1560
atcctttcaatttccactcctctctaatataattcacattttcccactattgctgattcatttttttttgtgaattatttcaaacccacataaaaaaatctttgtttaaatttaaaaccatggatccttcatttaggttcattaaagaggagtttcctgctggattcagtgattctccatcaccaccatcttcttcttcatacctttattcatcttccatggctgaagcagccataaatgatccaacaacattgagctatccacaaccattagaaggtctccatgaatcagggccacctccatttttgacaaagacatatgacttggtggaagattcaagaaccaatcatgtcgtgtcttggagcaaatccaataacagcttcattgtctgggatccacaggccttttctgtaactctccttcccagattcttcaagcacaataacttctccagttttgtccgccagctcaacacatatggtttcagaaaggtgaatccggatcggtgggagtttgcaaacgaagggtttcttagagggcaaaagcatctcctcaagaacataaggagaagaaaaacaagtaataatagtaatcaaatgcaacaacctcaaagttctgaacaacaatctctagacaatttttgcatagaagtgggtaggtacggtctagatggagagatggacagcctaaggcgagacaagcaagtgttgatgatggagctagtgagactaagacagcaacaacaaagcaccaaaatgtatctcacattgattgaagagaagctcaagaagaccgagtcaaaacaaaaacaaatgatgagcttccttgcccgcgcaatgcagaatccagattttattcagcagctagtagagcagaaggaaaagaggaaagagatcgaagaggcgatcagcaagaagagacaaagaccgatcgatcaaggaaaaagaaatgtggaagattatggtgatgaaagtggttatgggaatgatgttgcagcctcatcctcagcattgattggtatgagtcaggaatatacatatggaaacatgtctgaattcgagatgtcggagttggacaaacttgctatgcacattcaaggacttggagataattccagtgctagggaagaagtcttgaatgtggaaaaaggaaatgatgaggaagaagtagaagatcaacaacaagggtaccataaggagaacaatgagatttatggtgaaggtttttgggaagatttgttaaatgaaggtcaaaattttgattttgaaggagatcaagaaaatgttgatgtgttaattcagcaacttggttatttgggttctagttcacacactaattaagaagaaattgaaatgatgactactttaagcatttgaatcaacttgtttcctattagtaatttggctttgtttcaatcaagtgagtcgtggactaacttgc

SEQ ID NO: 926 - protein, 406 aa, Arabidopsis thaliana
  G1560
MDPSFRFIKEEFPAGFSDSPSPPSSSSYLYSSSMAEAAINDPTTLSYPQPLEGLHESGPPPFLTKTYDLVEDSRTNHVVSWSKSNNSFIVWDPQAFSVTLLPRFFKHNNFSSFVRQLNTYGFRKVNPDRWEFANEGFLRGQKHLLKNIRRRKTSNNSNQMQQPQSSEQQSLDNFCIEVGRYGLDGEMDSLRRDKQVLMMELVRLRQQQQSTKMYLTLIEEKLKKTESKQKQMMSFLARAMQNPDFIQQLVEQKEKRKEIEEAISKKRQRPIDQGKRNVEDYGDESGYGNDVAASSSALIGMSQEYTYGNMSEFEMSELDKLAMHIQGLGDNSSAREEVLNVEKGNDEEEVEDQQQGYHKENNEIYGEGFWEDLLNEGQNFDFEGDQENVDVLIQQLGYLGSSSHTN

SEQ ID NO: 927 - DNA, 896 bp, Arabidopsis thaliana
  G1634
ttatctcgtagcctttaaacgatggagactctgcatccactactctcgcacgtgccaacttctgaccaccggtttgtagttcaagagatgatgtgcttgcaaagctcgagctggactaaagaagagaacaagaagtttgagcgagctcttgctgtctacgctgatgacacgcctgatcgctggttcaaagttgctgctatgatccctggaaagaccatatcagatgtcatgaggcaatactctaagcttgaagaagacctcttcgatatcgaagcaggacttgtcccgatcccgggttaccgttcagttactccttgtggatttgatcaggttgtgagtccacgtgactttgatgcgtatcgtaaacttcctaatggagccagaggatttgatcaagaccgtaggaaaggagttccatggacggaggaagaacacaggagattcttgttagggcttctcaagtatgggaaaggagattggagaaacatatcgaggaactttgtgggatcaaaaacaccaactcaggttgcaagtcatgcccaaaagtactaccaaagacagctttccggtgcgaaagacaaacgacggcctagcattcacgacatcaccaccgtcaatcttctcaatgccaatcttagccgtccatcgtctgatcacggttgcttagtctcaaaacaggccgagccgaaactagggttcaccgacagggataatgcagaggagggagttatgtttcttggtcagaatctatcctcggtcttctcttcctacgatcctgccattaagttttccggagcaaatgtttacggtgaaggaggttactgtatctcacaagatcttgaaacgagaaaatgagaattttgaaattttaactattgcaacgaaaccataattgc

SEQ ID NO: 928 - protein, 277 aa, Arabidopsis thaliana
  G1634
METLHPLLSHVPTSDHRFVVQEMMCLQSSSWTKEENKKFERALAVYADDTPDRWFKVAAMIPGKTISDVMRQYSKLEEDLFDIEAGLVPIPGYRSVTPCGFDQVVSPRDFDAYRKLPNGARGFDQDRRKGVPWTEEEHRRFLLGLLKYGKGDWRNISRNFVGSKTPTQVASHAQKYYQRQLSGAKDKRRPSIHDITTVNLLNANLSRPSSDHGCLVSKQAEPKLGFTDRDNAEEGVMFLGQNLSSVFSSYDPAIKFSGANVYGEGGYCISQDLETRK

SEQ ID NO: 929 - DNA, 1144 bp, Arabidopsis thaliana
  G1645
cgtcgacctcccaacactaactccatgtttataacggaaaaacaagtgtggatggatgagatcgtcgcaagaagagcttcttcttcttgggacttccctttcaacgacattaatattcatcagcatcatcatcgtcactgcaacacaagtcatgagtttgaaatcttgaagagtcctcttggagatgtagcggttcacgaagaagagagtaataataataaccctaatttcagtaacagcgagagtggtaagaaggagacaacagatagtggtcagtcttggtcctcgtcgtcttcaaaaccatcggtcttggggagaggacattggagaccagctgaagatgttaaactcaaagagcttgtctccatttacggcccacaaaactggaacctcatagctgaaaagcttcaaggaagatctgggaagagctgtagactacgatggtttaaccaattggacccgaggataaaccgaagagctttcacagaagaagaagaggagaggctgatgcaagcacataggctttatggtaacaaatgggcaatgattgcgaggcttttccctggtagaactgataattcagtgaagaaccattggcatgttgtcatggctcgtaagtatagagaacactcttctgcttaccgtaggagaaagcttatgagtaataatccacttaaacctcacctcaccaataatcatcatcctaaccctaaccctaattaccactcttttatctccactaatcattacttcgctcagcctttccccgagtttaatttgactcatcacctggttaataatgcccctatcacgagtgaccataaccagcttgtgttgcctttccattgctttcaaggttatgagaacaatgaacctccgatggttgtgagtatgtttggcaaccaaatgatggtcggcgataacgttggtgccacgtcagacgcgttatgcaatattccgcacattgaccctagtaaccaagagaaaccggagccaaatgatgcaatgcattggatcggaatggacgcggtagatgaggaggtgttcgaaaaggctaagcagcaaccacattttttcgattttcttggcttggggacggcgtgaatgttgaacaaattggtgttaatcagataacgacagtggc

SEQ ID NO: 930 - protein, 359 aa, Arabidopsis thaliana
  G1645
MFITEKQVWMDEIVARRASSSWDFPFNDINIHQHHHRHCNTSHEFEILKSPLGDVAVHEEESNNNNPNFSNSESGKKETTDSGQSWSSSSSKPSVLGRGHWRPAEDVKLKELVSIYGPQNWNLIAEKLQGRSGKSCRLRWFNQLDPRINRRAFTEEEEERLMQAHRLYGNKWAMIARLFPGRTDNSVKNHWHVVMARKYREHSSAYRRRKLMSNNPLKPHLTNNHHPNPNPNYHSFISTNHYFAQPFPEFNLTHHLVNNAPITSDHNQLVLPFHCFQGYENNEPPMVVSMFGNQMMVGDNVGATSDALCNIPHIDPSNQEKPEPNDAMHWIGMDAVDEEVFEKAKQQPHFFDFLGLGTA

SEQ ID NO: 931 - DNA, 1423 bp, Arabidopsis thaliana
  G1650
tcgacagtcacaaatgtccatatgagtttctgggcgacttctatcagaatttttgttcataattttttttattgtatcaagggatgacttggaaaccgaagatgcttatattatcccatgatctaatctcaccagaaaaatacatcatgggtgaagatgatatcgtggagctcttagggaagagcagccaagtagttacaagtagccagacacaaacaccctcttgcgatcctcctctcattctccggggcagcggaagcggggacggagaaggaaatggtcctctaccgcagcctccgcctcccctgtaccatcagcagagtctctttatccaagaagacgaaatggcttcttggcttcaccagcctaatcgccaagattatctctactcccaacttctttactccggagtagcctcgactcacccgcaaagtttggcctccctagaaccaccaccaccacctagggctcagtacattctggcggcggatagaccgaccggtcatattttggccgagagaagggcggagaattttatgaatatctcgaggcaaagagggaacatatttcttggcggtgttgaagctgtaccgtcgaactcgaccctgttgtcttcagccactgaatcaataccagcgactcacggcaccgagagtcgagcaacagtcactggcggagtatctcgtacttttgcagttcctggtcttggtccgaggggaaaggcggtggcgattgagacggcgggaacacaatcttgggggttgtgcaaggccgaaacagagccggttcagagacaaccagcgacggagacggatatcaccgatgaacggaagagaaaaacgagagaggaaacaaatgtcgaaaaccagggaactgaagaagctcgtgattcgacgtctagtaagaggtcacgagctgcaataatgcataaactctccgaaaggagacggagacaaaagattaacgagatgatgaaggctttgcaagaactccttcctcgctgcacaaagactgatagatcttccatgctggatgatgttatagagtacgtgaaatctctacagagccaaatacaggatgttctcaatgggacatgttatgattccaccgatgatgtatgcggggaatatacaacaacagtacatgccccacatggccatgggtatgaatcggcctcctgcattcatacctttccctaggcaggctcatatggcggaaggtgtaggtcctgttgatttatttagagagaatgaagaaacagagcaagagacaatgtctcttctccttagagaagacaaaagaacaaaacagaaaatgttttcttgaactgaaacttgttagttcttttattaagacaagacacactcttatatacatgttcacataactactctacgttggtaacagttgtaacttctccagc

SEQ ID NO: 932 - protein, 371 aa, Arabidopsis thaliana
  G1650
MTWKPKMLILSHDLISPEKYIMGEDDIVELLGKSSQVVTSSQTQTPSCDPPLILRGSGSGDGEGNGPLPQPPPPLYHQQSLFIQEDEMASWLHQPNRQDYLYSQLLYSGVASTHPQSLASLEPPPPPRAQYILAADRPTGHILAERRAENFMNISRQRGNIFLGGVEAVPSNSTLLSSATESIPATHGTESRATVTGGVSRTFAVPGLGPRGKAVAIETAGTQSWGLCKAETEPVQRQPATETDITDERKRKTREETNVENQGTEEARDSTSSKRSRAAIMHKLSERRRRQKINEMMKALQELLPRCTKTDRSSMLDDVIEYVKSLQSQIQDVLNGTCYDSTDDVCGEYTTTVHAPHGHGYESASCIHTFP

SEQ ID NO: 933 - DNA, 1564 bp, Arabidopsis thaliana
  G1664
ctctctctctctctctactagtttgacatgaacagcgacggtgtttggcttgacggctccggtgaatctccggaagttaataacggtgaagctgcgtcttgggtcagaaacccagatgaagactggttcaataacccaccaccaccacaacacactaatcaaaacgacttcagattcaatggtggctttcctttaaacccctcagagaatctgcttcttcttcttcagcaatcgattgattcttcttcttcttcttctccgttattacatcctttcacactcgacgctgcttcacagcaacaacaacaacaacaacaacaacaggaacagtctttcttagctacgaaagcttgtatagtttctcttctcaacgtcccaaccatcaataacaacactttcgatgacttcggctttgactctggtttcttaggacaacaattccatggaaatcatcaatctccgaactcgatgaatttcactggcttaaaccactcagtaccggattttcttccagctccggaaaacagctcaggatcatgtggattgagtcctctgttctcaaacagagcaaaggttttaaaaccgttacaggtaatggcttcatctggctcgcagccaactctgtttcagaaacgagctgcaatgcgtcagagctcgagtagcaaaatgtgcaattctgagagttcttctgaaatgaggaaatcgagctacgagagagagattgacgatactagtaccggaatcatcgatatctctggattgaattacgaatctgatgaccataatactaataacaacaaaggtaagaagaaaggaatgcctgcaaagaatcttatggctgagagaagaagaaggaagaagcttaatgataggctttacatgcttagatcagttgttcccaagatcagcaaaatggatagagcatcaatacttggagatgctattgattacctcaaagagcttttacaaagaatcaacgatcttcacaccgaacttgaatctactccaccgagttcttcaagcttgcatccgttaacaccgactccacaaacgctgtcttaccgtgttaaggaagagttgtgtccatcttcctccttgccaagtcctaaaggccaacaaccaagagttgaggttagattaagagaaggaaaggcagtgaacatacacatgttctgtggacgtagaccaggtcttttactttccaccatgagagctttggataacttaggattggatgttcaacaagcggtgattagctgtttcaatggttttgctttggatgttttccgcgctgagcaatgtcaagaagaccatgacgtgttacctgaacaaatcaaagcagtgcttttagatacagcaggttacgctggtttggtttgattgcgaagcagaaggaagcatctgtgtggaacagagctagatctaagtccttgttctgttttagtcagcaattttcttacttagtttcatcaatttcaatcatgtatggaagatgataactgttttattttagctatgagaacatgtgtttggggaacaatagttgcaacctttgagcaaaaaa

SEQ ID NO: 934 - protein, 450 aa, Arabidopsis thaliana
  G1664
MNSDGVWLDGSGESPEVNNGEAASWVRNPDEDWFNNPPPPQHTNQNDFRFNGGFPLNPSENLLLLLQQSIDSSSSSSPLLHPFTLDAASQQQQQQQQQQEQSFLATKACIVSLLNVPTINNNTFDDFGFDSGFLGQQFHGNHQSPNSMNFTGLNHSVPDFLPAPENSSGSCGLSPLFSNRAKVLKPLQVMASSGSQPTLFQKRAAMRQSSSSKMCNSESSSEMRKSSYEREIDDTSTGIIDISGLNYESDDHNTNNNKGKKKGMPAKNLMAERRRRKKLNDRLYMLRSVVPKISKMDRASILGDAIDYLKELLQRINDLHTELESTPPSSSSLHPLTPTPQTLSYRVKEELCPSSSLPSPKGQQPRVEVRLREGKAVNIHMFCGRRPGLLLSTMRALDNLGLDVQQAVISCFNGFALDVFRAEQCQEDHDVLPEQIKAVLLDTAGYAGLV

SEQ ID NO: 935 - DNA, 1179 bp, Arabidopsis thaliana
  G1669
atggtggtcgatgtagagagccgaaccgcgagcgtgacaggagagaagatggcggcgcgtggctgtgatgcgtgcatgaagagatcacgtgctagttggtactgtccagccgatgacgctttcctatgccaaagctgcgacgcctcgatccactcggctaaccatttagcgaaacggcacgaacgtgtccggttacaatcatcttcgccgacggagacggcagacaaaacgacgtcggtatggtacgaaggattcaggagaaaggcgagaacgcctaggagcaagagttgtgcgtttgagaagttgttgcaaatcgagtcaaacgatcctcttgttccggagcttggtggagacgaagatgatggctttttctcgttctcctccgtagaagaaaccgaggagagtctgaattgttgcgtgcctgttttcgatcctttctcagacatgctgattgatgatataaacggcttttgcttagttcctgatgaagtcaataacactactactaatggagaattaggagaagtcgagaaggcaatcatggacgatgaaggttttatggggttcgtgccattggatatggatcttgaggatctcactatggacgtggagagtttacttgaggaagaacaactttgcttgggattcaaggaaccaaacgatgttggagtcatcaaagaagagaataaagtagggtttgagattaattgtaaggatttgaagagggtgaaagatgaagatgaagaagaagaagaagccaagtgtgaaaatggaggatcaaaggatagtgatagagaagcatcaaatgataaagatagaaagacaagtttgtttctgagattagattatggagctgtgattagtgcttgggataatcacggttcgccgtggaaaaccggaatcaaaccggagtgcatgttgggagggaacacgtgtctgcctcatgttgtgggtgggtacgagaaattgatgtcgagcgacggatcggtgacacgtcagcaagggagagacggaggaggatcggacggggagagagaggcgagggttttgaggtacaaggagaagcggaggacgaggttgttctcaaagaaaataagatatgaggttcggaaacttaacgctgagcagagacctcgaatcaaaggtcgtttcgtgaagaggacgtcacttttgacgtga

SEQ ID NO: 936 - protein, 392 aa, Arabidopsis thaliana
  G1669
MVVDVESRTASVTGEKMAARGCDACMKRSRASWYCPADDAFLCQSCDASIHSANHLAKRHERVRLQSSSPTETADKTTSVWYEGFRRKARTPRSKSCAFEKLLQIESNDPLVPELGGDEDDGFFSFSSVEETEESLNCCVPVFDPFSDMLIDDINGFCLVPDEVNNTTTNGELGEVEKAIMDDEGFMGFVPLDMDLEDLTMDVESLLEEEQLCLGFKEPNDVGVIKEENKVGFEINCKDLKRVKDEDEEEEEAKCENGGSKDSDREASNDKDRKTSLFLRLDYGAVISAWDNHGSPWKTGIKPECMLGGNTCLPHVVGGYEKLMSSDGSVTRQQGRDGGGSDGEREARVLRYKEKRRTRLFSKKIRYEVRKLNAEQRPRIKGRFVKRTSLLT

SEQ ID NO: 937 - DNA, 1038 bp, Arabidopsis thaliana
  G1760
ccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataacagagagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatccaaaaaaaaaaaaaaaaaaaaaaaaaa

SEQ ID NO: 938 - protein, 228 aa, Arabidopsis thaliana
  G1760
MGRGKIVIQRIDDSTSRQVTFSKRRKGLIKKAKELAILCDAEVGLIIFSSTGKLYDFASSSMKSVIDRYNKSKIEQQQLLNPASEVKFWQREAAVLRQELHALQENHRQMMGEQLNGLSVNELNSLENQIEISLRGIRMRKEQLLTQEIQELSQKRNLIHQENLDLSRKVQRIHQENVELYKKAYMANTNGFTHREVAVADDESHTQIRLQLSQPEHSDYDTPPRANE

SEQ ID NO: 939 - DNA, 318 bp, Arabidopsis thaliana
  G1816
atggataacactgaccgtcgtcgccgtcgtaagcaacacaaaatcgccctccatgactctgaagtgagcagtatcgaatgggagtttatcaacatgactgaacaagaagaagatctcatctttcgaatgtacagacttgtcggtgataggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctag

SEQ ID NO: 940 - protein, 105 aa, Arabidopsis thaliana
  G1816
MDNTDRRRRRKQHKIALHDSEVSSIEWEFINMTEQEEDLIFRMYRLVGDRWDLIAGRVPGRQPEEIERYWIMRNSEGFADKRRQLHSSSHKHTKPHRPRFSIYPS

SEQ ID NO: 941 - DNA, 609 bp, Arabidopsis thaliana
  G1820
atggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaattga

SEQ ID NO: 942 - protein, 202 aa, Arabidopsis thaliana
  G1820
MAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 943 - DNA, 1059 bp, Arabidopsis thaliana
  G1842
actattacatgcctcttcctcgcttcaaaacggcaccgtttccacttgttattatttttctctctatcgtctaacaaaaaaaaaaactgacttgggattttttttcatttgtctagcccaaaagaagaagatagaaacgaagaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgcttgt

SEQ ID NO: 944 - protein, 196 aa, Arabidopsis thaliana
  G1842
MGRRKVEIKRIENKSSRQVTFSKRRKGLIEKARQLSILCESSIAVVAVSGSGKLYDSASGDNMSKIIDRYEIHHADELKALDLAEKIRNYLPHKELLEIVQSKLEESNVDNVSVDSLISMEEQLETALSVIRAKKTELMMEDMKSLQEREKLLIEENQILASQVGKKTFLVIEGDRGMSRENGSGNKVPETLSLLK

SEQ ID NO: 945 - DNA, 818 bp, Arabidopsis thaliana
  G1843
cagacatcacaatcaaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagatgcatcaaataaagtaattgatttttattgtta

SEQ ID NO: 946 - protein, 200 aa, Arabidopsis thaliana
  G1843
MGRRKVEIKRIENKSSRQVTFCKRRNGLMEKARQLSILCESSVALIIISATGRLYSFSSGDSMAKILSRYELEQADDLKTLDLEEKTLNYLSHKELLETIQCKIEEAKSDNVSIDCLKSLEEQLKTALSVTRARKTELMMELVKTHQEKEKLLREENQSLTNQLIKMGKMKKSVEAEDARAMSPESSSDNKPPETLLLLK

SEQ ID NO: 947 - DNA, 834 bp, Arabidopsis thaliana
  G1844
agaaattaggggattagatgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatca

SEQ ID NO: 948 - protein, 198 aa, Arabidopsis thaliana
  G1844
MGRRRVEIKRIENKSSRQVTFCKRRNGLMEKARQLSILCGSSVALFIVSSTGKLYNSSSGDSMAKIISRFKIQQADDPETLDLEDKTQDYLSHKELLEIVQRKIEEAKGDNVSIESLISMEEQLKSALSVIRARKTELLMELVKNLQDKEKLLKEKNKVLASEVGKLKKILETGDERAVMSPENSSGHSPPETLPLLK

SEQ ID NO: 949 - DNA, 1076 bp, Arabidopsis thaliana
  G1947
acaactattctctcctctctctttttttattaaaaaagctcaaatttatataggttttttgttcacaaaatggattataaccttccaattccattagagggtctcaaagaaacgccaccaacggctttcttgacgaaaacatacaacatagtggaggattcaagcacaaacaacatagtttcatggagcagagacaacaacagcttcattgtttgggaaccagagacttttgccctaatttgcctccctagatgctttaagcacaataatttctccagctttgttagacagctcaatacttatgggtttaagaagattgatacagagagatgggaatttgcaaatgagcattttctgaagggagagaggcatcttcttaagaacatcaagagaagaaagacatcatctcaaacgcaaacgcagtcgctagaaggagagatccatgagctgcgaagagacagaatggctttagaagtagaactggttagactgcgacgaaaacaagaaagcgtgaagacatatctgcatttgatggaagagaaactgaaagtcacagaagtaaagcaagaaatgatgatgaatttcttgctaaagaagattaagaaaccgagttttttacagagcttaaggaaacgtaatctgcaaggaatcaagaatcgagagcaaaagcaagaggtgatctcaagccatggtgttgaggataatggaaagtttgttaaagctgagccagaagagtatggtgatgacatcgatgatcaatgtggaggtgtgtttgattatggtgatgagcttcacatagcttcaatggagcatcaaggacaaggggaggatgaaattgaaatggatagtgaaggaatttggaagggtttcgtgttgagtgaggaggagatgtgtgatttagtggaacattttatataataaactaatgtattatgagaggtttttttttgtttttttgctttttttttccgagtttgtcatcaagcattgtatacaatttgggccaaactaaaagcccaacaaaatatttggccttggcatttgttaacaaattgactaattcggccacaccttcc

SEQ ID NO: 950 - protein, 282 aa, Arabidopsis thaliana
  G1947
MDYNLPIPLEGLKETPPTAFLTKTYNIVEDSSTNNIVSWSRDNNSFIVWEPETFALICLPRCFKHNNFSSFVRQLNTYGFKKIDTERWEFANEHFLKGERHLLKNIKRRKTSSQTQTQSLEGEIHELRRDRMALEVELVRLRRKQESVKTYLHLMEEKLKVTEVKQEMMMNFLLKKIKKPSFLQSLRKRNLQGIKNREQKQEVISSHGVEDNGKFVKAEPEEYGDDIDDQCGGVFDYGDELHIASMEHQGQGEDEIEMDSEGIWKGFVLSEEEMCDLVEHFI

SEQ ID NO: 951 - DNA, 525 bp, Arabidopsis thaliana
  G2010
atggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgcaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatag

SEQ ID NO: 952 - protein, 174 aa, Arabidopsis thaliana
  G2010
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 953 - DNA, 906 bp, Arabidopsis thaliana
  G2119
atggcgtttaatcacagaaaaatgcttctttcatgtctacagtttaaagatttacgcttttgtttccggcaataccctcccccgccaccaccaccaccgccaccgagggagctctctctcctactccccacctcgatctgcgtcgtcggctcaatcatactctttctatttctagtcttcttcctctacctccacatcacgcaacaacggcggatttcagccgccagcgtaactcccggtgacacaaaccaacaggaagatgaggacgaaacagaggagagagatttctccgactttcatcacgtttggcaaatcccaaccgtcggtctccaccgttccgcgatcaactcgatcacagtcgttggattcaaaaagggagaagggataatcgacggcacagaatgctctgtctgcttaaacgagtttgaagaagacgagtcgctgagactgttaccaaagtgtagccatgcctttcatctaaattgcatcgacacttggttgctctctcacaagaactgtcctttatgtcgtgcccctgtacttcttatcactgaaccacctcatcaagaaacagagacgaatcatcaaccagattctgaatcgagcaatgacctccgtggaagacaagacagttccagatctagaagaaaccataacatttttcttccaagggcacaaagtgatttggcaaactactgtggctcaggaagagtagaaaacgtgagaagatcgttttcaattggaggaagcttatcactttgcgatggtattaacaatgctactagaagtggaagacagttctataccagcttcagtgctaacttgttctcatcatcaagaagagtaaggaacgaacaaccgattccacaaaaccaaatgccatccgtaactggtaacaccagttaa

SEQ ID NO: 954 - protein, 301 aa, Arabidopsis thaliana
  G2119
MAFNHRKMLLSCLQFKDLRFCFRQYPPPPPPPPPPRELSLLLPTSICVVGSIILFLFLVFFLYLHITQQRRISAASVTPGDTNQQEDEDETEERDFSDFHHVWQIPTVGLHRSAINSITVVGFKKGEGIIDGTECSVCLNEFEEDESLRLLPKCSHAFHLNCIDTWLLSHKNCPLCRAPVLLITEPPHQETETNHQPDSESSNDLRGRQDSSRSRRNHNIFLPRAQSDLANYCGSGRVENVRRSFSIGGSLSLCDGINNATRSGRQFYTSFSANLFSSSRRVRNEQPIPQNQMPSVTGNTS

SEQ ID NO: 955 - DNA, 2109 bp, Arabidopsis thaliana
  G2120
atgtcggtgggatctcttttattcatgtttcttcttatctggaacttcaatggcgaattgaatgctctaaacgacgaagggtttgctcttttaactctgaagcagtctatttcaaaagatccagatggttctttaagcaattggaactcagagaatcaaaacccttgttcttggaatggagtcacttgtgatgataacaaggttgttgtctctcttagcatcccaaagaagaaacttttaggttatcttccttcttctcttggtttactctctaatctccgtcatttgaatttgagaagcaatgagcttagtgggaacttacctgttgagctttttaaggctcaaggtcttcaaagtttggttctttatgggaatttcttgtctgggtccattccaaatgagattggtgacttaaagtttctgcaaattttggatctttctcgtaattctcttaatgggtctattccagaatcggttttgaagtgtaataggcttaggagctttgatttgagtcagaataatctcactggttctgttcctagtggatttggtcagtctttggcttctttgcagaagcttgatctttcttctaacaatcttattggtcttgttcctgatgatttggggaatttgactagattgcaaggaactcttgatttgtctcataattcgtttagtggctcgattccagctagtttggggaatttgcctgagaaagtttatgtcaatctagcttacaacaacttgagtggaccaatcccacaaaccggtgctttggtgaacagaggaccaactgcattcttggggaatccaagactctgtggccctccattgaaggatccttgtttgccagatacggatagttcttcaacttctcacccttttgtaccggataacaacgagcaaggtggaggagggtcaaagaaaggagaaggtttaagtaaaactgctattgttgcaattgtggtttgtgatttcattggaatctgcattgtgggatttctcttctcttgttgttacttgaagatttgtgcacgtcgtaatagtgtggatgaggaaggctatgtgttggagaaagaagggaaagaaaagaaaggttccttctgtttcagaagagatggatcagagtccccttcttcggaaaatcttgagccacaacaagatcttgttctgttggataaacatattgctttggatttagatgagctgcttaaggcttcagctttcgttcttggaaaaggcgggaacgggattgtgtataaagttgtcctcgaagatggtctaacggtcgctgttaggagactgggagaaggaggttcccaaagatgcaaggagtttcagacagaagttgaagcaattgggaagctaaggcatccgaatatcgttagtcttaaagcttattattggtcagttgaagagaaacttctcatctacgactacattcctaatggaagccttaccaatgcactccacggaaatcctggaatggtgtcattcaagcctctgtcttggggagttcggttaaagataatgaggggaatctcaagagggctggtgtatcttcacgagtttagtcctaaaaagtatgttcatggatctctgaaactcagcaatatactgttgggacaggatatggagcctcatatctcggatttcggacttatgcacctctctagcattgctggaacattggaatcaactacagttgaccgaccatccaacaagaccgcctcatcgattggatcatctgcaaacttgagctcattttatctggctcctgaagccactaaagcaacagtgaagccatcacagaaatgggatgtatactcattcggagtgatcttgctagagatgataacgggaagattaccgattgttttcgtgggtaaatcggaaatggagatagtcaagtggatacaaatgtgtatcgatgagaagaaagagatgtcagacattttggatccttatttggtgcctaatgacacagagattgaagaagaggtcatcgccgtgttgaaaattgcaatggcttgtgttagtactagccccgagaaacgtccaccgatgaagcatatcgctgatgctttgacccaaatttgccttcagtga

SEQ ID NO: 956 - protein, 702 aa, Arabidopsis thaliana
  G2120
MSVGSLLFMFLLIWNFNGELNALNDEGFALLTLKQSISKDPDGSLSNWNSENQNPCSWNGVTCDDNKVVVSLSIPKKKLLGYLPSSLGLLSNLRHLNLRSNELSGNLPVELFKAQGLQSLVLYGNFLSGSIPNEIGDLKFLQILDLSRNSLNGSIPESVLKCNRLRSFDLSQNNLTGSVPSGFGQSLASLQKLDLSSNNLIGLVPDDLGNLTRLQGTLDLSHNSFSGSIPASLGNLPEKVYVNLAYNNLSGPIPQTGALVNRGPTAFLGNPRLCGPPLKDPCLPDTDSSSTSHPFVPDNNEQGGGGSKKGEGLSKTAIVAIVVCDFIGICIVGFLFSCCYLKICARRNSVDEEGYVLEKEGKEKKGSFCFRRDGSESPSSENLEPQQDLVLLDKHIALDLDELLKASAFVLGKGGNGIVYKVVLEDGLTVAVRRLGEGGSQRCKEFQTEVEAIGKLRHPNIVSLKAYYWSVEEKLLIYDYIPNGSLTNALHGNPGMVSFKPLSWGVRLKIMRGISRGLVYLHEFSPKKYVHGSLKLSNILLGQDMEPHISDFGLMHLSSIAGTLESTTVDRPSNKTASSIGSSANLSSFYLAPEATKATVKPSQKWDVYSFGVILLEMITGRLPIVFVGKSEMEIVKWIQMCIDEKKEMSDILDPYLVPNDTEIEEEVIAVLKIAMACVSTSPEKRPPMKHIADALTQICLQ

SEQ ID NO: 957 - DNA, 850 bp, Arabidopsis thaliana
  G2347
agcccatccttcaacattgcttcctaaccagaaatccaccatcatcttcccacgaatacaacttaaagctttaccagaaaatggagggtcagagaacacaacgccggggttacttgaaagacaaggctacagtctccaaccttgttgaagaagaaatggagaatggcatggatggagaagaggaggatggaggagacgaagacaaaaggaagaaggtgatggaaagagttagaggtcctagcactgaccgtgttccatcgcgactgtgccaggtcgataggtgcactgttaatttgactgaggccaagcagtattaccgcagacacagagtatgtgaagtacatgcaaaggcatctgctgcgactgttgcaggggtcaggcaacgcttttgtcaacaatgcagcaggtttcatgagctaccagagtttgatgaagctaaaagaagctgcaggaggcgcttagctggacacaatgagaggaggaggaagatctctggtgacagttttggagaagggtcaggccggagagggtttagcggtcaactgatccagactcaagaaagaaacagggtagacaggaaacttcctatgaccaactcatcattcaagcgaccacagatcagataaaccctcccgctctctctcttctgtcatctacatatgctctatctacactcttattagacaaataatggcatctaacaatgtcaagaaaagttggtcatggtattaaatcctacacggatatataactataaacctctagtcccctctatgctgtcctgtaatgaatatctatccggaaatgtattcgcatagtcttgcgtctaataatgtttattgattttgta

SEQ ID NO: 958 - protein, 181 aa, Arabidopsis thaliana
  G2347
MEGQRTQRRGYLKDKATVSNLVEEEMENGMDGEEEDGGDEDKRKKVMERVRGPSTDRVPSRLCQVDRCTVNLTEAKQYYRRHRVCEVHAKASAATVAGVRQRFCQQCSRFHELPEFDEAKRSCRRRLAGHNERRRKISGDSFGEGSGRRGFSGQLIQTQERNRVDRKLPMTNSSFKRPQIR

SEQ ID NO: 959 - DNA, 252 bp, Arabidopsis thaliana
  G2718
atgaatacgcagcgtaagtcgaagcatcttaagaccaatccaaccattgttgcctcttcttctgaagaagtgagcagtcttgagtgggaagaaatagcaatggctcaggaagaagaggatttgatttgcaggatgtataagcttgtcggtgaaaggtgggatttaatagctgggaggattccaggaagaacagcagaagagattgagaggttttgggtgatgaagaatcatcgaagatctcaattacgttga

SEQ ID NO: 960 - protein, 83 aa, Arabidopsis thaliana
  G2718
MNTQRKSKHLKTNPTIVASSSEEVSSLEWEEIAMAQEEEDLICRMYKLVGERWDLIAGRIPGRTAEEIERFWVMKNHRRSQLR

SEQ ID NO: 961 - DNA, 1915 bp, Glycine max
ggtacttgtttgtgccttattccctctgattctggaacaagttcccgttctttcttatctttctccactgttttattttctccctgatcttcctctaccttaatttcagtcctatttgttcttctgacagatactcttttaccttcaccagctcattcttcttctatcttcttctgctatatatgctcaacctttaaagggtatttctctctctctctctcaactagtttgagtttcattgtactttgatatcactgcagaagtacatgagactcttaaaagagggtatgctttaaagaccagaatcagaagctgattaaaggagagaacctttccaagacatggctatgtttgatctcaatgttgacatcaaccactgtgatgctgatgctgactcaagctgtgatcaaaagggattggtgctgcaaagtttcccacctgaaatctcagattccaggacctccagctcctctgtgtggaaccctgtagaggaagattcctcaaacaattcctctcccttgatttttgacatactcaagaaagagagggatgagtcagagtttgatgcagccactgaaagggtcaataaggagcaaaacatggcaccacaagaggcagagatagtggcaaggacacttttccctgtgactgctgctgctgataaaggagttagagtgcctgatttcaaattggggctgtgggggaagactgaatgcttgaacttgtccttacctgcggctcgaggacaaaatggactcagaaccttacagcagaaggtacctcctgtgaggaaaaataggagaggaccaaggtctcgcagctcgcagtaccggggtgtcaccttctaccgcaggactggtagatgggagtcacatatttgggattgtgggaagcaggtttatttgggtggatttgacactgctcaagctgctgcaagagcatatgatagggctgctataaagtttcgtggagtagatgctgatataaactttagtttgagtgattatgaggaggatttgaagcagatgagaaatttgagtaaggaagagtttgtgctcttacttcgtcgacaaataaatggaatctctaggagaagttcaacatacagaggtgcattagcccttcgcaaagatgctcaaggagaaccacgaatgggaccatttgttggcatgacatgttatcctaagccatccatcaattgtgatgatggaaaagcggaggcaagttttaagccctgttcctataagggagaaataattgtgaattccaacatgacaggcacttgccataatcttgatttgagcctaggaatttctccgtcttctaaaagattgaagaataatgactatagtggagggtattcctttggatgtatgacttgtaagatacccgaggaaagaggaccaatggagaaggtcatggtggacagaataaaaaatgttcctttgcaaaaaatttccaacttggcttggcaactttgcagcaatggcagcattgtcccaaggccattccaaccaaatgcagcatcatcaggattcgtctcttcttctagctgtctcatcacccgcacttccaatcagcacacatattaattatgccaacaatttggcattaattggctcaaccacagtactactactagttgaaaccaccagaaacaaagcatatttaccctgcttttttgaagattagatgagcaagagtacttcataaccacatgtacctatagtataagattctattgatttcatcaagcatgatggtatttaataatattgctaagcattgcttacaatggctacccgatattttctgtattcattatcgtgatgtagaacacaatattgccttgtgtaaaagacccttgttgaagtatgtatatatttgttggttcttgttaaaaaaaaaaaaaaag

SEQ ID NO: 962 - DNA, 1682 bp, Glycine max
attcggctcgagattatttggtgtagggattgcgggaaacaagtctatttgggtatggatttttaatttatgaatttatgaatttcagtgtttattttagggtacatagtttttgtactatctgaaatcgtattctatggtttactattttaagcatcttttgacaaaattggtatttgagcttgtaggtggatttgacacggctcatgctgctgccagagcctatgatcgagccgctattaagttcaggggagttgatgctgatatcaatttcaatctgagtgattatgaggatgaccttaaacagatgcagaatttgtccaaggaggaattcgtacatatactgcgtcgccaaagtactggtttctcaagaggaagctctaaataccgaggagtaacactccacaagtgtggccggtgggaagctcgaatgggacaattccttggcaaaaagtgaggacatatttttatatatcaacttacgtagtgatctactgtggttatgaaatattatgaatttaagcacctattgggctgcaaagtgaaattggtttcagcttaattctcaatgcatctttatgcttttttccatgtttggagaaacatgtctaagatagtaatatagagatgcgttttggttatagagattgcaatgctttcatgcaggtatatatatcttggactattcgacagcgaagtagaagctgcaaggtcctagtgatacatgaattacattctacccgcactgaatttatttacatgaattatcaaagctcattaggctccatccaacacgtatctcccttttgattttctggaaatcagggcttatgacaaggcagctatcaaatgcaacggacgcgtgggcggacgcgtggggcagtgaccaactttgagccaagtacttatgaaggagagatgaaacccgcagccattaatgaaggtggcagtcagaatcttgatctcaatttgggcatagcaaccccaggacctcccaaagaaaattgggggcaacttcagttcccctccatcccttacaacacacatggtggaagaagttcaatgatggaaaccaatgttaattctggaattggtaatccatctttgaaaaggatggttgtaactgaagatcgtccttcattatggaatggcatgtctcctaatttctttcccaatggggaaagagcagagagaatcggcattgatccttcaaaaggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcgccccatgtttggatacatctttgaagcaaatgctatttttagtgcactagcacagcgatgtttctgttttcc

SEQ ID NO: 963 - DNA, 2155 bp, Glycine max
  misc_feature (2149)..(2149): n is a, c, g, or t
aattcgcctggttcttctcttctctctctctctctctctcttccatggaatccaatagtcggcgacgctttcactctctccggcgacgatgaactcatcgccgacgaaatgagtttgcgccggtttcttctctctcctcgttccgtgagttccttcctctcactccttctccgttctccggtcgccggaaaatttatccggtgttagcgatacggaaaactcatcgcgattccgttttcttcttcgcttcgttttctacttctctttatctttcacttacattacctctctcattcggttgtttccgatcggatccatttcgccgtcgccggcgaagttagttggaacaggctttagctaagttgtaaacctcagaaattataaaaatagataatcggaatttagtagttagttcggtttttagttacttaaccgcttaacgatataaataaataaataaaaagaagcgcgacgatgttagatcttaatctcaatgcggagtggaccgattcgtttagtaacggtgagtcgccgttaccgttagagaagtttccagacggtttgaggaaccaaatggccgagtcagggacttcgaattcctccgtggtgaatgcggacgggtccagtaacggcggcggcgacgaggactcggactccacacgagctgctgatgacgtgtacaccactttcaatttcgatatccttaaagtcgaaggcgcgaacggcttcgtaacgaaggagctctttccggtgatgagtgaaggagctaaaggacacgctacgtcgtcgttttcagggacgaatggtttcgtggatctctcgttcgatggcgatggagggaacactagtgagatgaagatgcttcagcctcagaatcagaatcagactcaaacgcgaactcagacacagcaaccagcgaaaaagagtaggagaggaccgaggtctcgaagctcgcaatacagaggggttactttttacagaaggacgggaagatgggaatcgcatatctgggattgcgggaaacaagtctatttgggtggatttgacacggctcatgctgctgccagagcctatgatcgagccgctattaagttcaggggagttgatgctgatatcaatttcaatctgagtgattatgaggaggatctaaaacagatgaagaatctttccaaggaggagttcgtgcacatactgcgccgccacagtaccggtttctcaaggggcagctcgaaataccggggagtgacacttcacaaatgtggccgttgggaagctcgaatgggacaattccttggcaaaaagtatatatatcttggactattcgacagcgaagtagaagctgcaagggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatggggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcatctttgaagcaaatgctatttttagggcactngcacag

SEQ ID NO: 964 - DNA, 1096 bp, Glycine max
gcagaaggacgggaagatgggaatcgcatatctgggtattgcggagaaacaagtctatttgggtgagatttgacacggctcatgctgctgccagagcctatgatcgagccgctattaagttcaggggagttgatgctgatatcaatctcaatctgagtgattatgaggatgacctcggcccgaggcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaaggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatgggcaggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggat

SEQ ID NO: 965 - DNA, 605 bp, Oryza sativa
gggcgggagcctcaggcattcactccagcccctgacaccaacacagcgcccacaacacccaagacaatcaagaatcctcagccacacgcagcacatcacccacaggcagccaccagcacagcacagcacagcacagcaagcacagcaagcacttcaggcaggcacaaagaaaagccagcacgcagggccacagcagcatcttcgcaagcatcgcaaataccagcaggcagtcaacacattctaccagcacagcaccaggccgctgggaatcccacatctgggattgcggcaagcaagtctacctaggtggattcgacactgctcacagcagctgcaagggcgtacagacagggcggcagatcaagttcaggggagtagaggctgacatcaacttcaacctgagcgactacgaggaggacatgaggcagatgaagagcttgtccaaggaggagttcgtgcacagttctccggcgacagagcaccggcttctcccgcggcagctcaaagtacaggggtgtcaccctccacaagtgcgccgctctagaggatccaagcttacgacgcgtgcatgcgacgtcatagctcttctatagtgtcacctaatc

SEQ ID NO: 966 - DNA, 2313 bp, Zea mays
aattcggcacgaggtccttctcctattctatctatatatcacccgcctcttttcccgacttcgccacgacgcaccttccctcttcttcctcagctccgtcgcccaccgccggagctccgaaaggccccgcgctcgccgcctttcctgtaaaaaacccaacctttagctagctaaccgctcctcttctccccctacgtactccccttgcccaaatcagagaagatatttaacggaggaggggaaggagaggatatttagctgattgttgattggtggtccggggtacggtgttcttgagtcgtgaagcgaccgtacggtggctagggccgtctccgggttgcgtgcaggatggtcgtcagagatcgggagtgaggaggcagctcgtggtcgtggaggctaaatgtaccgcaagaacgactcggcactctcctgtttctacctcttcctcctctggttcttcttcttgaaatagaccagcgccagccaccaggtagctacctactagctagcagcccagttgcgactggggacgggctgctgcttgcaagttggaatcttggagcaggagcagaggagcgggagatggagctggatctgaacgtggccgaggtggcgccggagaagccagcggcggcgctggaggcgagcgactcggggtcctcgggctcgtcggtgctgaacgcggaggcggcgtcggcgggcggcggggggcccgcgccgggggaggaggggtccagctcgacgccggccgtgctcgagttcagcatcctcaggagcgacagcgacgcggccggcgcggacgccgacgacggcgacgccacgccgtcgcctcctcgccaccaccaccagcagctcgtcacccgggagctcttcccggcgccgcagcattgggccgagctcggcttcttccgcgccggcccgcagcagcagccggacatcagggtcctgccgcacccgcacccgcacccgcccccgccgccgcccgcgcagccgcagccggccaagaagagccgccgcggcccgcgctcccgcagctcgcagtaccgcggcgtcaccttctaccgccgcaccggccgctgggagtcccacatctgggattgcgggaagcaggtgtacttaggtggattcgacactgctcatgccgctgcaagggcgtacgaccgagcggcgatcaagttccgcggcgtcgacgccgacataaacttcaacctcagcgactacgacgacgatatgaagcagatgaagagcctgtccaaggaggagttcgttcacgccctgcggcggcagagcaccggcttctcccgcggcagctccaagtacaggggcgtcaccctgcacaagtgcggccgctgggaggcgcgcatggggcagttcctcggcaagaagtacatatatcttgggctattcgacagcgaagtagaggctgcaagggcgtacgacaaggccgcgatcaaatgcaacggtagagaggccgtgacgaacttcgagcccagcacgtacgacggggagctgctgctgactgctgaagctagcgcagaagttgctgacgacgttgatctgaacttgagcatctcgcaaccggcatcgtcccagagccccaaaagagacaagaactgccttggtccgcagctccaccaccaccatgggcggccgtttgacggctccgccgttctgaagaaaaccaagatcgatgctccgtctgagctgtcgtcggcgggccgccctcaccggtcgttcctccctcatctcgtggctgccgagcatctaccgcctcggtctcaccccttcttcatcacacaccatgagagtgatgcatcaagaagagatcccagctgggcagcagcagcagcatggaaggtgaccgcagctgcacctcctcctcctaccaccaccctgttgccgttgccgctgccgtcgacgtcgtccgctgcagcatcatcaggattctccaataccgccacgacagctgccgccgccccatcggccgcctcctcccgccggttcgacccgccgccaccgtcgtcgtcctcctcctcgagccatcaccaccaccaccaccgccgctgagaatcgaagaagccacactgtaaatctgccgggaagcggctggtggcatccggcccgctcctccctccggggcgccgcaacttttttcgatcggttttgcgccgcccgggacgggttgtagttgatcgattggattcttcataactgtatttgcgtactgcttacactacacccaagtgaaatcgaaaatggcgccttctctcgttgaataaaaaaaaaaaaaaagcgcccccaaaaaactcgagg

SEQ ID NO: 967 - DNA, 823 bp, Zea mays
gcggcattgggccgagctcggcttcttccgcgccgacctgcagcagcaacaggcgccgggccccaggatcgtgccgcacccacacgccgcgccgccgccggccaagaagagccgccgcggcccgcgctcccgcagctcgcagtaccgcggcgtcaccttctaccgccgcacaggccccgcgcgggcccgccgctgggattgcggcaagcaggtgtacctaggtggattcgacaccgctcacgccgctgcaaggcacgcactggactggacgcccagaattcttcgtcatgtgagtctctgaccgaattgattgattaacgagtctctggctcctggaactcgcagggcgtacgaccgggcggcgatcaagttccgcggcgtcgacgccgacatcaacttcaacctcagcgactacgaggacgacatgaagcagatggggagcctgtccaaggaggagttcgtgcacgtcctgcgccgtcagagcaccggcttctcgagaggcagctccaggtacagaggcgtcaccctgcacaagtgcggccgctgggaggcgcgcatggggcagttcctcggcaagaagtaagaaccaaccaacgcttcttttctttttcttttttttatagcatgcagtgatgattcaaccttagttgtgcctttcctcctaatcctatatatgtaggatttagtactggttgacatataagtatatatgtattgttcagtaaaagttacataggttagctgcatgtttatgtatgtagcttggttgtttcaatcagaagataaaaaaagggaaagtagtggctagggaattcctccaatc

SEQ ID NO: 968 - DNA, 589 bp, Zea mays
gtgcagggggacgcctctgtacctggagctgcctctcgagaagccggtgctctgacggcgcaggacgtgcacgaactcctccttggacaggctccccatctgcttcatgtcgtcctcgtagtcgctgaggttgaagttgatgtcggcgtcgacgccgcggaacttgatcgccgcccggtcgtacgcccttgcagcggcgtgagcggtgtcgaatccacctaggtacacctgcttgccgcaatcccagatgtgggactcccagcggcctgtgcggcggtagaaggtgacgccgcggtactgcgagctgcgggagcgcgggccgcggcggctcttcttggccggcggcggcgcggcgtgtgggtgcggcacgatcctggggcccggcgcctgttgctgctgcaggtcggcgcggaagaagccgagctcggcccggacgcgtgggcggacgcgtgggtccaagtgcaactacacaccactgccaaacttcgaatgataaagagtgcagactaacaagtagtacaactcatgacatcgtactctccagtcctgaattctggtctggagtagtgatagcagcaagcaactttac

SEQ ID NO: 969 - DNA, 659 bp, Glycine max
acaaaaacccattctttatgctcactcgtctgcttagcgtagattaatcattatgtgtggcggtgccatcatcgctgacttcataccccgccgtggaggccgccgcctcgcggcctccgagctctggccaaactccttcgccataggcgatgcctttgacttggattactcccacgtcgctacccaacaaccctccactctcaaaaggtcgccaacctcccaaaggttagtcttgttcactaactcactcgctcattttcaccctgaaggttttgtaaacatgttaagatttttttctttttcgactgtgagtttgttcgaacagtcagcgagcaggttgagaataagccggtcaagaggcagagcaagaatctcttcagaggcattcggcagcgtccgtggggcaaatgggcagcggagattcgcgatcctagagaaggggttagtgtctggttgggcacctttaacaccgcagaagaatgccgcgagcagcctacgatcgtgaagctcgaaaacatctgagggccaaaaaggctaaggtgaatttccccaacgaggccgacgaatattccattcaagctcgtaatccaattccaccccttcctttcgctccgcagcaccctcccctgtaccagcaacagtaccgttgcgatctcaac

SEQ ID NO: 970 - DNA, 1285 bp, Glycine max
tcgcgattataagtttggtcttgtggatagaaatgaagggcaaagcacttcaaaataaggctgtttggattgatgtaaaaaggaacaatactatgttctattgtttgaattgtttacaatagaattttacctcgtaaaaaaaaaaaaaaaaaaaaaaaaaaaaaaacctatgaagaaccccaaagactgacgccccccccccccggcctctcacgagcccgcattaatgtgtgtttgtcacgagacccatagtgctgccaaattatagtaactctctttctctatctgaagaagaagaagttctgaagaagcatgtgtggaggtgctatcatctcagacttcattggtgtgaagcgtggccgcaacctcgccgcgcaggaactgtggtccgagcttgaccctttctctgacctccttggcttcgataccaccaccaccaccaccaaccaaccaccccttccagacaaaaaagtggtgtcatcatgtgagaagaagaagaagaaaagtgtgagtgcagaaaagaagagtggtgggcgagctcggaagaacgtgtacagaggaatcaggcaaaggccgtggggcaagtgggccgcggaaataagggacccacataagggcgtccgcgtctggctcggcaccttccccaccgccgaggaagccgcccgagcctacgacgacgccgccaagcgcatccgcggcgacaaggccaagctcaacttcccggccaccgctccgccaccctccaaaaaacaacgctgcctcagccctgacaccaccaccgaacaaagcagcagctcacaatccaccactggatccaccggatcgccgccttccgccgccttccacggcggaggagatgaactcgacctgaaacaacttgaacggtttctagggttggacaacatgggtgctgagtgggacaacatggatgacctgtggatgctggacgacgtcgttgtgcccaaccgtcacttaatttactagaagggagataattaattaattaataaatggcgttttcttaagttatagttttataaaactatgttggtgtatgtgttcttagttttctgttttgtcttgtcctctcgctttggtaatttctgttttgtacggtcgaatgatttcaaaattatgtgcaacgtatcatgagagggatgattatatgttatgattatgattataaataaaggccaattagggtgtgttagcgtttgggtcgtgcatgtttatatgtagtttatgcgttgtatataatatatttggcatgacattatttggttct

SEQ ID NO: 971 - DNA, 1129 bp, Glycine max
tccccgagccgaatcggctcgtggtttgtttgtctgtcacgagactcatacattgtgctgccaattatagtaactctctatttctctttccatctctcaagttctgaagaagaaacatgtgtggaggtgctatcatctcagacttcattggtgtgaagcgtggccgcaacctcgccgcgcaggaactatggtctgagcttgaccctttctctgacttccttggcttcgataccaccaattccaaaaaccaaccacccctgcagaaaattccagacaaaaaagtggtgtcatcatgtgagaagaagaagaaaagcgtggtgggtgcagaaaagaagaagagtgatagtgggcgagctcgtaaaaacgtgtacagaggaatcaggcaaaggccatggggcaagtgggccgcggagataagggacccacacaagggtgttcgtgtctggctcggcaccttccccaccgccgaagaagccgcccaagcctacgacgacgccgccatacgcatccgcggcgacaaggccaagctcaacttcccggccaccaccatttccgccgccgccgctccgccaccttccaaaaagcaacgctgcctcagccctgacatcatcactgaagaaagcagcagcagcagctcacattccaccactggatccaccggcgaaagcggcggaggaaacgacgaactcgacctgaaacaaattgaatggtttctaggtttggagaatgagctgcctgttagcaacaacattggtgctgagtgggacaacatggatgacctgtggatgctggacgacgtcgttgtgcccaaccgtcacttaatttactagaaggctaataattaataaatggcgttttcttaagttttagttttactttataaattgtagtataaaactatgttggtatttgtgttcttagttttcttctgctgttttgtctcttctctggctttggtaatttctgttttggacggttgaatgatttcaaaattaggtacttaattacaccctatcatgattgggatgatgattatatattatgattatgatgattatatataaataaagggtgattaagttacggcgcgtgagtgtttgcgactttgcgccgtgcatgtttttataaa

SEQ ID NO: 972 - DNA, 570 bp, Glycine max
cccacgcgtccgcaaaaacactcatcactctatctctctcaaaagtgaaaatgtgtgggggtgctataatttctgatttcatagacgtgaatttgaacagtggtcggaaattgaccacccacaacacccatcatcagcttcacactttctctgatttccacgccacctcttcttccaaacatcaaccatcctaccaggatccaaacctccctaggcctcctccgcttccaaacaaccaaggagtgaagttgaaggctttgactttgaacactggtcgagtacggaagaacgtgtacagaggaataaggcaaaggccatgggggaagtgggctgcagaaataagggacccacgtaagggtgtgcgtgtgtggctgggtactttcaacactgctgaagaagctgctcgtgcttacgacaatgccgccaagcgcatccgcggagacaaggccaagctcaactttcccgacagcaagaacccatgtcttaatccctttcaactcaaacacctcttttccaacctcgaatccttccttggttgggcctcgctctaatcactcccattcttgtctg

SEQ ID NO: 973 - DNA, 750 bp, Oryza sativa
cccacgcgtccgcccacgcgtccgcccacgcgtccggagccagcgactgtgccaatgtactactcctaccccctctcctactcctgttaacaagttgtgctgctatatagaggagcagccgagcaagtgtgttgccccgggtcgacccgcgtcggtgggtaattgatagtagcaagacaatgtgtgggggagcgatcatcgccgacttcgtcccgcccgccggcgcccgccgcgccgctgcctccgacatctccgacaacgccgtcctctccgctgccggtgccggtgacgagtcgttcgcggcggccaaggcgccggcgccggggaggaagacggcgtaccgcggcatccggcgccggccgtggggacgctgggcggcggagatccgcgacccgaggaagggcgcccgcgtctggctcggcacctacgccaccgccgaggaggccgcccgcgcctacgacgtcgcggcgcgcgacatccgcggcgccaaggccaagctcaacttccccccgaccatcggcgccgccgccgcgccaccgccgcccaagaagcgacgcaaagccgccgccgcggcgaaccaccaccaccaccaccaccagcaggagagctcaggctcctcgtcggcgtcgtcgctgcctcccaccccgccgccggccgccgagcaccagctccgcgagtgcatgtccgggctggaggcgttcttgggcctcgaggaggaggaggacgacggcggcgccggtgagccatggg

SEQ ID NO: 974 - DNA, 395 bp, Oryza sativa
  misc_feature (316)..(316): n is a, c, g, or t
cccacgcgtccggtccatttctttgcagtcctcgcatgcgcaacgtgtccactgtttagatggatgcacacggtgacgagtcgttcgcggcggccaaggcgccggcgccggggaggaagacggcgtaccgcggcatccggcgccggccgtggggacgctgggcggcggagatccgcgacccgaggaagggcgcccgcgtctggctcggcacctacgccaccgccgaggaggccgcccgcgcctacgacgtcgcggcgcgcgacatccgcggcgccaaggccaagctcaacttccccccgaccatcggcgccgccgncgcgccacccggcgccaagaagcgacgcaaagccgccgccgcggcgaaccaccaccaccaccaccaccagcaggagagc

SEQ ID NO: 975 - DNA, 467 bp, Oryza sativa
gtttccttcgcgtgagcggcagcaagtgttcagggcgggcttcttctcgatttagctttcttggtttcttgatctgtagcttattagcggccatgtgcggcggagcaatcatctccgggttcatcccgccgtcggccgctgcggcggcgaggaggaggaggacgacgacgacgtggtcgtggtggtccccccgccggcggcggcgaggttcgtcgtccgtgccgcggccaaggcggcgcccccaactgcagatgggatgttgactacaaagcttgtccaacatgatggacctactgctagatcagcaaagcacaagaggaagaatcagtacagggggatccgccagcgtccctggggcaaatgggcagctgaaatccgagaccccacaagggtggccgtgtttggcttggaacatataacactgctgaggaggcagctagggcatatgacgctgaagcccgcaagat

SEQ ID NO: 976 - DNA, 1536 bp, Zea mays
gaggctggccgggatctcccaactccgcctccaagtcccacccccactccctcgctcaccagaggaactggcggaccaggcaaagccgagccgcaccgcaaccgcgaagatcttgcgtggcctccttttcccagctcgtcactgtgccgctcgtgccctacactcccggtccgcccaaccaataatccatccatccatccatccaccaccaccccgctgcggcgatgtgcggcggcgccatcctctcgggtttcatcccgccgtccggggtggcggcggcggcggcggcggccaagaagcagcagcagcagcagcagcggtgccgtgtgactgcggacctgctatggccgggggcccggcagtaagggagctccccaggacaaggaggaggacttcgaggccgacttccgcgagttcgagcgcggcctcggcgaggatgacgtggacagcgccggcgaaggcggcgaccccgaggtccaggagcttcctccgccggagccgacgaggtttgccttcgccaccgcggccaaggcggcagttgatggcgtgatgactcctcctccaaaggatgtccaaggagatagagcagtaaaaaagcgcggcccggaagaaccagtacaggggaatcaggcagcggccttggggcaaatgggcagctgagatcagggaccctaacaagggcgtccgcgtctggctcggaacctacaacaccgcccgaggaggcagctagggcatacgacgccgaagctcgcaagatccgcggcaagaaagcgaaggtgaattttcccgatgacgcgacaggcactcgtcacaggccaacgaccgatgagatctttaacaacctgaagaacgacgacaacaacaacaacgatgatctgtttgcgatgtttgcgttcggtgacaataagaagaaggttcctgcagcgaagccagccgccgccgagggtggcagtggcagtggcagcttcctcgtccctgcgccctgcggtggcggtggtgcccggtaataagaggaggtcgtccgcgaccaacactatgctctccgtctccgacgaccagcgcagcaactcctacggctccggctcctccgccgacttggtggggtcgtgggtcgtgggacgacgacgacgccgccgccgccgccgccgccgccgccatgacctcggactacacctcctcggtcttagctccggcgtcttactcttacatgcaaggcggagcgccgaagagaatgaggcacagctacagcggcgcaccgcaccaacctcgcacatgacgcggccatgcctggttttggccttgataaagtgagctaccactaccagccgttgccgttgcctccttattacgtcgggagcagcagcggctcgtcagacgacgcgtcggtgggcagccttggtcttctgcaggctgatggtgctccacaggatggggcgagcgccggggatatctggagcctcgacgagctgctcatgctggcaacagctggtgcttattgagaacgcaaaaaaaacaaaaaaaaagggccctaaggcc

SEQ ID NO: 977 - DNA, 990 bp, Zea mays
aattcggcacgaggcggcaccaaaaccacgcgctacttcaccagcctagctagccctttcgccgtcgctgcggctcctgcccactgactcgtaggtttcgttgtttcgacaatgtgcggcggagccatcatcgccgacttcgtccccgccggcgcccggcgcccggcaacagacgacaccatgtccgcctccatcctctccggtagcgaggaccatccggagctgccgctgccgctgccggcgccggcgccggggcgcaagacggcgtaccgcgggatccggcgccgcccgtggggccggtgggcggcggagatccgcgacccgcggaagggcgcccgcgtgtggctcggcacctacgccaccccggaggacgcggcgcgcgcctacgacgtggcggcgcgcgagatccgcgggcccaaggccaagctcaacttcccgcccgccgtgggcggcggcggcggcgcgcgcgcgccggcgccggctgcggccaagaggcgccgcaagtccccggcggccgaggagagctcggcctcgtctcctccggcggccgtcgtcgtggcgggcggcggggaggaggcgctgcgcgactgcatgtccgggctcgaggcgttcctggggctgcaggacaccgatgagggtggcggcgtcgaggcgtgggacgccgtggacctcatgttggcgtaggccggagtacgccgtagcagggctgcaggggggcccagccccagccccagcgcgcgcgtgccgtcgctgtgaacggccgccgcagctgttttggatcgagtaataatattattagtagtataatgtttctccaagcagctaagctaattgcatgcccttgctgggtgggtggtattactagcactgctatctaggagtatgtactagcaggatgggtttatctagcttgttgctaaacagataattaatctaagaaaacagagatatggtctgttaaaaaccgcctctaaataatgcccggcgatt

SEQ ID NO: 978 - DNA, 1049 bp, Glycine max
cctttttttttttttttttttttttttttttttttttttttttccatcaatttgttatatattcttcattattttcattgtcatgagatacaactattcatattacaaagaaaaaggaaaaaaaaaatactatgacaaactatcctcacacttctgcaatgccataagaatggcaagatagtagtaatacatttcatatatatatatatatatatatatatatatatatatatatatatatatatatattcccttttattattgccacctcgtgtctattgaaaactgccacatatttgaatcatatatccagctccaaatctgtcaaggagctatctttactccgctttatggctaccgtggatgacaaaggacactataaagaaacatccgacaaatgtttcaatgtttctttagcgtaaccttaattggctcatgatccgagccaattaaatgaggaaaattcagcttagcttttgagccccgcatcttaaatgcagctcgatcataagctaaagctgcatcctcagcggtttcgtaggttccaagccacactctcacaccattcctcttagtgtccctaatctccgccgcatacttcccccacggcctcctccgcacgcctcggtagctcaaccccttctttggaggcgtgcgagtgccacgcgcggctgtagttttactattttgaccctcattttccattttcacagctacactaacattactcacctcatttccattggcggggaaccatccggtggcagcagcatcacgcaaagcaccgtagatgaccatgtcattggtgtcgttctccttcaacggcagctccgcccaattctctgtcaagaaaatgttccggaagctagaactccggcagaacgctgctatggacggcaccgatgcagaaacgtcctgaaacggcgtcgttacgggtatctcaaagtgatcaagagcattcacattggtgtttaaagcatgagagctcattgctccgtacaagtttgatgtttcgttgctttcgtaggttgtgtggcgcgcccgcgtgg

SEQ ID NO: 979 - DNA, 515 bp, Glycine max
agccgatgagtatgataaatcagactctagcaaattttgcttcaaagtctttgtcaatactcttatcggcttcagaggcgcgtgagaaccaatgaggtgaggaaaatttaacttagctttgctgccacgcatctcaaaagcagctctatcataagctaaacccgcttcttcttcagtttcgtaagtcccaagccatatcctagcaccattcttcttcggatctgttatttccgccgcgaacttgccccaaggtctacgcctcacaccccggtaacgcttccatgctggtggcgcgtgaacttcacgctccaccttagggtgttctcttttgcatgctaacgacccttctgcatcatggacaccttccaagcggaacgtagtagagcttgggaatgaattgtacgttggagaatagcaaatttcgtgattggaagcgttcatgagtgtgttggaatcgtgctcaagctcaagacgacagtggtgaatagattccactgaagagaaatcacaagata

SEQ ID NO: 980 - DNA, 475 bp, Glycine max
gacgaaccaaagttaactactttagagagagagagagagagagagagagatggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtctgtgctagagtcgatgctcttcaggcaacccttcaccaccactacgtgcccccgcggcaacttctctctggcggtggtggtgggtcc

SEQ ID NO: 981 - DNA, 1471 bp, Glycine max
ccacgcgtccgaatacaacagcaacatgatggtttcagtttcttgagggtactaatatgaacagaatctcctctcaacacctttgccttgctgcagttcgcaactgcaactgcactcaaatataaatatatatacatatatatatatatatatatatatgtattacttcatggtcacacatagttaagtttattaattactaggtagctggttttgaatagggtagttggtagttatagttgttgtcccagatatggaagaagcaggtttaggagattgttgttcctcgaattcgacgattacgaggaagagcgataagcgaaagcagcaacaccaacaacaagagaagccatacagaggaataaggatgaggaagtggggcaagtgggtggcggagattagagaacccaataagcgttcgaggatctggctgggttcttacgccacccccgtcgccgccgcacgcgcctatgacaccgccgtcttccacctccgaggcccttccgctcgcctcaacttccccgaattgctgtcccaggacgacgacgtttcgacccaacaacagggcaacatgtccgccgattcaattcgcaaaaaagccacccaagtcggcgccagagtcgacgcgctccaaaccgcgcttcagcaatcctcgtcctcacactccgctaattccagccacgtcagcagctctgacaaaccagacttgaacgagtatcccaaacctgaagattagtaatttccttcaaccttcaagattaatattgatccaccaatcatgggttctgatgtgacttatatatagggcttcaacttgccctcttcacctatgctaatttgaaaagaaaaaaattttatatttgtcatatgatttatctgagtaaatatttttttccagtttatttaattaatattagaaagtgtaggaagaaatagacacacctgatgagaattgagatgaggctaattaacttgttaatgaggtgagtaactcctttaactatatataaattaaggggtatatatattattagttgctcacctcatgttgttgctcatctcacgaagaaactcattttagattacttttttcctttcattatgtgtatgctggagcggtggactggtagctacatagattctcgctatgatggggcatatgatcatgaggtcttttctcaggtcggttgtgtgttgtaatttgtaacgagatatccgtaacacaataggatcaaattaaccgtgttttgttgtttcagattatcttttctacgttcccgttcattgctccaatctgatatcctacataatctccactactttatatataaggccggccgttttttaagacccaagttaccttcccttgccttcaaagcaaatacttttctattgtgtcccctaaaatcaatttcattggccgtctttttccaaacctctgcttggaaaaaccttggctttccccaactta

SEQ ID NO: 982 - DNA, 1419 bp, Glycine max
  misc_feature (832)..(832): n is a, c, g, or t
  misc_feature (868)..(868): n is a, c, g, or t
  misc_feature (870)..(870): n is a, c, g, or t
cccacgcgtccgtaccaatatgaacagaatctcctctcgacacctttgctttgctgcagctcgcaactgcaacttcccacaaatataaatatatattacttcatggtcacacatagttaattttattaattactactaggtagctggtttttaataggtagtaggtaggtgtaatcgttgtcttcctgcagatatggaagaagcgggtttaggagattgttgttcctctaatacgactattacgaggaaaagcgagaagcgaaagcagcagcaccaacaacaagagaagccatacagaggaataaggatgaggaagtggggcaagtgggtggcggagattagagaacccaacaagaggtcgaggatctggttgggttcttacgccacccccgtcgccgccgcacgcgcctacgacaccgccgtcttccacctccgaggcccttccgctcgccttaacttccccgaattgctgtcccaggacgacgacgtttcgacccaacaacagggcaagatgtccgccgattcaattcgcaaaaaagcgacccaagtcggcgccagagtcgacgcgctccaaaccgcgcttcagcaatcctcgtcgacacactccattagttccagccacgtcagctatgagaaaccagacttgaacgagtatcccaaacctgaagatttagtaatttccttcaaaccttcaagattaatattgatccaccaatcatgggttctgatgtgacttatatatagggcttcaacttgccctcttcaccctaggctaattggaagaagaagaaaaaaccctttttatatttgtcatatgattatatatatatcntagtagatatttttcttccagtctatttattttaanantagaacgtgtaggaagaaatatacagacacacctgagaattgagatgaggctaattaacttgtttatgaggcgagtaactcctttaaatatatataaattaaggggtatatatactattacttgctcatcaccacatgaagaacaacgtttgacctttaaccaaatgagatcgtgtaattcatgctgttgacctgattttgctgttgttgctcatctcacgaagaaactcattatagtttttttttttctttcaatatgtgtatgttagctggagtcgtggactggtagctacgtaggttctcgctatgatggggggcatatcatgtggtcttttctcaggtcggtggtgtgttgtaatttgtaacgagatatccgttacacaatcggatcaaattaaccgtgttttgttgttttagattaataaaaatacatatgttctgatgaattcgataatttcacatacatgtggtgaaaatgatttcatatataagttgtatgcatagttcatgtgtgtgaactatattaattcgaccgatcctgtttatgtt

SEQ ID NO: 983 - DNA, 973 bp, Glycine max
gcttagtgcgcgagtcgcatgaccctctctcccttataacccttccgtgtcttttacgagttagatttctcattcgtcattgaacagattcactctctctctctttagagatttgattgacaaacacaactaattccaaagctaacaactttatagagagagagagagagagagagagagatggagggtgaaggaagaagaagagaaggaggagagagagaaacagcaacagcagcagcaacgaggaaggtggtggagggtgctgatcagagaagatacaaaggaataaggatgaggaagtggggcaagtgggtcgctgaaattagagaacccaataagcgttcaaggatttggctcggttcctattctacccctgtcgcagccgcacgtgcctacgacaccgccgtcttttaccttcgaggaccctccgcgcgtcttaacttcccggagcttctcatcggagaaggcgccgccgccctcaccggcggctgtgacatgtcagcagcttctattaggaagaaggcctccgaggtcggtgctagagtcgatgctcttcaggcaacccttcaccaccatcaccaccatgttgtgccaccacggcagcttctctctgccagctgtggcggtgggtccggtgattttgcagtgcgggttgttgacctgaataagatgcccgaacccgagagctccgactgtgagtggaacgtgaattgaaggaaaaagaaaaaaggtgcatgttttcatattcaggtgatggtggttgttaacgtgcgccggctgaggcaaaatgatgttgttgatgaggcctgtggtggtggtggtggtggtgcggagtactgtactgtatctttttttccttcaaccttctctcttgggtagtttttttttaaaatttttagatattacaaaagaatttttggcttgtaaaaatatgttaaatgtaaattaactagtccggtagcagtttcttttt

SEQ ID NO: 984 - DNA, 1021 bp, Glycine max
cccacgcgtccgtacggctgcgagaagacgacagaaggggataccaaggtggaggcttacccagatgacaagcttagtgcgcgagtctctctcccttataacccttcttccacttccgtgtcttttacgagttagatttctcattcgtcatggaacaacacattcactctctctctctttagtgattttttcgatttgattgacaaacacaacgaaccaaagttaactactttagagagagagagagagagagagagagagagagagagagatggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtcggtgctagagtcgatgctcttcaggcaacccttcaccaccactacgtgcccccgcggcaacttctctctggcggtgatggtgggtccggggatttcccggtgcgggttgttgacctgaataagatgcctgaacccgagagttcggactgtgagtgggatgtgaattgaaggaaaaaaaagtacatgttttcttattcggttgctaagcgcgggttgaggcaaagtgatgttgttgatgaggcctatggtggtgtggagtactgtactgtatcttattccttcaattttctctcttgggtcttggctagttttttttttttagatattacaaaagaaattttggcgttgtaaaaatatattaaatgtaaattaactagtccagtagccaaaaaaaaaaaaacccccaaaaac

SEQ ID NO: 985 - DNA, 1285 bp, Glycine max
ccttttttttttttttttttcagaaccaaactgttattaaattacttatactttaacctacatcttttaaataaaataagaaataatatctacagcggatcacaaaacaaatataaaacacaacctttgggggagatgtttgtaatagttaattgtggaacaacgatcgaggtttgaggagctacaattttggtttcacattgaagacacatctctttctttcttacattttcggttgcttttctttcatattttctggttttctattttccaatttgttggatacaatgtcgtttgagatttgactccaactagacaaaaatctgagacgcagaaccgattaaccgaccccatgcatcacccatcgttatcatcgaaacagagtagtgaccacaacagcgtcttccctccccaatggtcccttctcttcacatatacaactcataaaaacacctaacatccatctttttttactcttcagtagaatagtagctattataatattataattacttgagtggttaacatggctcactccctctttttcaacccaactccctggcatcataggccattgctgtgccctctaaccccttttccccaataaaaaaaaaattaattaaaacaaggttataattttatatttgtttttgaaaaactccaaattaacaactaaacaacactcctaatccctgtcccagtagtcacaatccgaattctcgggttcgggcatcttattaaggtcaacccggtcggcgaattctccagcaggcagcgcgtgggggtgctggcggtggagagcgtcgactctggcgccgacctcggtggccttcttcctgatggaggctgcggacatgtcggcggcggggccctccgcggcaacaagctcggggaagttgaggcgcgcagaggggccccggaggtggaaaacggcggtgtcgtaagcacgcgccgccgcgacgggcgtggagtaagaaccgagccaaatccttgaacgcttgttgggttctcgaatctcagcgacccacttgccccactttctcattctgattcctttgtagcgcgtcgtctcagtttcaccctctttccctctcttctttgttgcaattcctccttcttctccttccataactactctctccctctctctctctctgaaaattcccttaatttttcatgaagagtataaataaatgaaataaaagaatgaagtgcgaggaagggaagggttataggggttttgcagtgcagagagacactgagccgaggttgtcgcgcgcgctgg

SEQ ID NO: 986 - DNA, 400 bp, Glycine max
  misc_feature (319)..(319): n is a, c, g, or t
gttttgaatagggtagttggtagttatagttgttgtcccagatatggaagaagcggggttaggagattgttgttcctcgaattcgacgattacgaggaagagcgataagcgaaagcagcaacaccaacaacaagagaagccatacagaggaataaggatgaggaagtggggcaagtgggtggcggagattagagaacccaataagcgttcgaggatctggctgggttcttacgccacccccgtcgccgccgcacgcgcctatgacaccgccgtctttcacctccgaggcccttacgctcgccttattccaattgtgcanacacactttgaccacacagcacattcgcgttcatcgaaaagcaccagtcggccgatcaccctcaacgccttacatctgtct

SEQ ID NO: 987 - DNA, 457 bp, Oryza sativa
  misc_feature (3)..(4): n is a, c, g, or t
  misc_feature (7)..(8): n is a, c, g, or t
  misc_feature (11)..(11): n is a, c, g, or t
  misc_feature (16)..(17): n is a, c, g, or t
  misc_feature (19)..(19): n is a, c, g, or t
  misc_feature (21)..(22): n is a, c, g, or t
  misc_feature (38)..(38): n is a, c, g, or t
  misc_feature (45)..(45): n is a, c, g, or t
  misc_feature (47)..(48): n is a, c, g, or t
  misc_feature (50)..(50): n is a, c, g, or t
  misc_feature (62)..(62): n is a, c, g, or t
  misc_feature (67)..(67): n is a, c, g, or t
tannatnnttngttanncnannaaaatctccttcgtgnaagtttnanncnccgtctgaccgntcctnggaggtagaacaccgccgtgtcgtaggcgcgcgccgccgccacgggcgtcgcgtacgaccccagccagatgcgcgtccgcttgtgcggctcccggatctccgccacccacttgccccacttccgcatccgcacgccacggtactgccgcctcggctgctgctgctgcagaagcagccgagtcctcgctggaggagcggtggtactcgccctgcatgagcgaagcgcagccgccgccgcagccgccctcttctctctctctctctctctctctctctgccctctcctgtgcaagcagcagtagcttttggcgttggttgggcggcttcttcttctcttctcttttctttctcgctatgtttgatgggtggtatttgtattgggcctcgtgc

SEQ ID NO: 988 - protein, 233 aa, Oryza sativa
MQGEYHRSSSEDSAASAAAAAAAAAAAMAPLAAAAAAVAAKEEQAAAAAVLPLQQQQPRRQYRGVRMRKWGKWVAEIREPHKRTRIWLGSYATPVAAARAYDTAVFYLRGRSARLNFPEEISSLASLSEGGGASEPREPDGGTLSAASIRKKAIEVGSRVDALQTGMMVAPTTHHRERQKHHHHHHHHHPHLQPHGEEQHHHHEQKHQRTAWSGRAKNPDLNQAPSPENSDAE

SEQ ID NO: 989 - protein, 184 aa, Oryza sativa
MDRREATVFLPPPPPPQPTQPQQQPAAAAVRAPVGGRGGGGGRQYRGVRMRKWGKWVAEIREPNKRSRIWLGSYSTAVAAARAYDTAVFYLRGRSARLNFPDQLDGAGGGGAGAGGAEDHRELTAAVIRKKAAEVGARVDAQHSVVGAAAPVPLQPPQPPPPQRRRTKNPDLNREPTPDTSDDE

SEQ ID NO: 990 - protein, 206 aa, Oryza sativa
MAPLAAAAAAVAAKEEQAAAAAVLPLQQQQPRRQYRGVRMRKWGKWVAEIREPHKRTRIWLGSYATPVAAARAYDTAVFYLRGRSARLNFPEEISSLASLSEGGGASEPREPDGGTLSAASIRKKAIEVGSRVDALQTGMMVAPTTHHRERQKHHHHHHHHHPHLQPHGEEQHHHHEQKHQRTAWSGRAKNPDLNQAPSPENSDAE

SEQ ID NO: 991 - DNA, 1149 bp, Zea mays
ggcggtgaagatggaggcggagcaagcggcgatggcggcgccgcagctgggggcggcgcaccagcagacgcagccgcggcggcagtaccgcggcgtgcgcatgcgcaagtggggcaagtgggtggcggagatccgggagccgcacaagcgcacgcgcccccgcctccggtcctacgccacggccgtggcggcggcgcgcgcctacgacacggccgtgttctacctgcccggcccgtcggcgcggctcaacttccccgaggagatcccctcgttcgggctggcggatggcgtggacgtgggggagcacgcgcgcgacccggccgccgccgccgccggcggcggcggcggctgcacgctgtccgcggcgtccatacggaagaaggccatcgaggtggggtcccgcgtggacgcgctccagaccggcatggtggtcccgccgccgcaccaccgcgagcgccataggcaccacaaccacctgccgcagctgcgggtgcacgcggaggagcagcaggaggaagaggagcagaagccgcagcggcctgcgtggagcgggcgcgtcaagaacccggatctgaaccgtgcgccgagccccgagagctccgacgccgagtgacaagcgagcgagagcgcagcagcagccaccgcaaggcgaggttcaacgacgacgtccgttatcggttattcccaatcccacgacgcagcatgccgttgtcgtctccgtccgaccgtccccacgtacgtacgtacgtacgtacacgacgatccagctgaccctgccgcctgcctatcctatccgtcctcgacgacgaccggatggtcggcgggcgggagggagggcggtgcggcgagggttttgggtacgttgtggataagcacgagggcagcagcagcaggggcggcgtgcgcgggcaggcaggcgaagacggagggaggcggccacaagcggcggtctttccaaacgtcaaaaaggacagctgtaacagcgataagaaaaaacaagtcatcatcaccctcgtctcactactagttctactactgttcccgagagtagtagtaacgattagcactccactagcagtatgattattcgaatcggccttgcttgacagcgattaaaaaaaaaaaaaaaaaaaaaaaaaaaaaaaaaag

SEQ ID NO: 992 - DNA, 1186 bp, Glycine max
cattcctataaataccccctaattcataaccctctgagttccagtccgtaatatctccaccttttggggagaccaccggagatatgtacggacggagtgattcttacgaatccgatttggcgcttctggattcgattcgccgccacttgctgggagagtccgaattgatattcggagccccgaatttcggttcgggtcggagctccagtttcagcagcttggactcgtgtttgagtgatgattggggagagcttccgtttaaggaggacgattcagaagatatggtgttgtacggcgttctccgtgacgcagttaatgtggggtgggtcccatccctcgatgccggctcgcccgagagcgtctcgtcgggttttccggcggtgaagctggagcctgatgtcatgccggcgttgattaatccgtgtccgcctccggcgccggcggtggaggagaagaaggttgttccgccgaaggggaagcactaccgcggcgtgcggcagcggccgtggggaaagttcgcggcggagatccgggacccggcgaagaacggggctagggtttggctggggacgtttgagacggcggaggacgcggcgttggcgtacgaccgcgccgcctaccggatgcgagggtcgagggcgctgctgaattttccgttgagggttaactccggcgagccagatccggtgagggtgacgtcgaagcggtcgtcgtcgccggaaagtatggcggcggcggcgccgaagagaaagaaagttatggtggtggggacggtgcaagagcaagtggggagtcaagtggtggagtgtacacgtggcgaacagttattggttagctgagagagattctaaaattggtattgtgtttattaaatacaaaaaatacaatactcttttgtaattatgtgaggtgcgtgtgtagtcctatacccatcatccaactcaatcttgcaacagagaaaaaaaaaaggtgaaagatgagacaggtgattttagtatatcaaatttcaaatggtgagtggtgaacccaccacgggaagaaaaaaattaaaagatgatgatgagtgatgacagaggtgaggatatgtaatttagctttgtgaatactaccaaatttgtttgttcaacattatgaattatgaatgggttaaatgtgacaaatgagttgagcccttaagaatccttct

SEQ ID NO: 993 - DNA, 727 bp, Glycine max
gcgtgcgcgcgctcgtaatccggctcgagtgatgtgttcggattgcggcggaggagaagaaggttgttccggcgaaggggaagcactaccgcggcgtgcggcagcggccgtgggggaagttcgcggcggagatccgcgacccggcgaagaacggagcaagggtttggctggggacgtttgagacggcggaggacgcggcgttggcgtacgaccgcgccgcctaccggctgccggcgaagagaaagaaagttgtggtggtggggacggtgcaagagcaagtggggagtcaagtggcagagtgtacacgtggcgagcagttattggttagctgaggtggattctaaaactggtgttgtgtttattaaatacaataaatacaatacacttttgtaattatgtgatgtgcgtgtgtgtgtaaagcacttagctatattatagccatcatccaactcaattttggaacaaagaaaaaaaggtgaaggatgaggatagatgattttagcacatcaaatggtgagtggtgtgaccccacgggaagaaaaaaaaaaaagagggggagaaaaaaattcaaagaagttatggaatttggaagatgatgaggaatgacgggggtgaggaactgaggatatgtaatttggctttgtgaatactaccaaatttgttatttgtttgttcaacattatgaactataaaaaaaaaaaagaatgggttaattgttaattgcttg

SEQ ID NO: 994 - DNA, 1181 bp, Glycine max
  misc_feature (1169)..(1170): n is a, c, g, or t
ggccggagtttaagtttatcttccaagttcacgtaccatcgcttttataaataccctcatccagtttcccttccaagttcgaatattcaattcaacaccttccctcattctcttctccaaacacgacacaaacattaagaagaagaaacataccacgaaatgtacggacaaagtagctatgagtccgatttggcccttttggactccattcgccgccacttacttggcgactccgaggagcacaaattcggagccccgaatgttagttcgggtaacactccagcgtactctcggagctcctgtttcagcaggttgtacccttgcttgagtaacgattggggagaacttcctcttaaggaagacgattcagaagacatgcttctttacggtgttcttcgcgatgcaataaacgcagggtgggtcccatctctcgatgcatcctcaccggagagtttctcgtcgggtttcatcccggcggtgaccgtgaaatccgaaccggatctatttccggcgccagagcctgtctatattcctccggcggctcagaaggctgagccggcggtggttccggcgaaggggaagcactaccgcggcgtgcggcagcggccgtgggggaaattcgcggcggagatccgcgacccggctaaaaatggggctcgggtttggcttgggacttttgagacggctgaggacgccgcgctggcttacgatcgagccgcgtatcgaatgcgcggctcgcgggctttgttgaattttccgctccggattaattcgggcgagccccgaccggttcgggtcacggcgaagcgggcttcagcagaaccgtgttcttcgtcggagagtggatcttgggtgaagaagcggaagaaggtggtgggttgagaacggggcacgtggagagcagttgttggtgaagtaatttgtgatgctaaaaaggggtggaataaatgggttggcatgctcactcattgctcaagtgggactgtgggactgatcaaatctaaagctaaaaaagaaaacaaaccacatttggaaaaactgattagggtcgaggttctgtttggctttgtgaatacagttacaagatttcttattttttggttcaattctataataatatctgtaacatagttgggtagggcacccaccctgtgctgaactaagtgatnncaataaaatat

SEQ ID NO: 995 - DNA, 767 bp, Glycine max
agcccacgcgtccgcccacgcgtccgcccacgcgtacgcctcctcttccaaaatatccacgtttcttttcccacacactatcttaaatcttaaaaacattttttttttcaaagcaattagaatttagaccacaaaaggaacaccgaagagatgtacggacagagtagtagtagcagtagttcttacgaatcggatttggcgctgttggattcgattcggcaccacttgctgggcgagtccgaatccatattcggcgccccgaatttcgggtcgggtcggagctccagtttcagcagcttggactcgtgtttgagcgacaattggggcgagcttccgtttaaggaggacgatacagaagacatggtgttgtacggcgttctccgtgacgccgttaacgtcgggtgggtcccatctctcgatgccgggtcgcccgagagcgtgtcgtcgggttttccggcggtgaagctggagccggacttgatgccggcgctgataagtctcgtgtccgcctccggcggctgcggcggaggagaagaaggttgttccggcgaaggggaagcactaccccggcgtgcggcagcggccgtgggggaagttcgcggcggagatccgcgacccggcgaagaacggagcaagggtttggctggggacgtttgacacggcggaggacgcggcgttggcgtacgaccgcgccgcctaccgggtggggacggtgcaagagcaagtggggagtcaagtggcagagtgtacacgtggcgagcagttat

SEQ ID NO: 996 - DNA, 561 bp, Glycine max
  misc_feature (12)..(12): n is a, c, g, or t
  misc_feature (84)..(84): n is a, c, g, or t
gggggaagttcncggcggagatccgcgacccggcgaagaacggagcaagggtttggctggggacgttttagacggcggaggacncggcgttggcgtacgaccgcgccgcctaccggatgagggggtcgagggcgttgctgaattttccgttgagggttaactccggcgagcccgatccggtgagggtgaagtcgaagcggtcgtcgtcgccagagagtgcggcggcgctgccggcgaagagaaagaaagttgtggtggtggggacggtgcaagagcaagtggggagtcaagtggcagagtgtacacgtggcgagcagttattggttagctgaggtggattctaaaactggtgttgtgtttattaaatacaataaatacaatacacttttgtaattatgtgatgtgcgtgtgtgtgtaaagcacttagctatattatagccatcatccaactcaattttggaacaaagaaaaaaaggtgaaggatgaggatagatgattttagcacatcaaatggtgagtggtgtgaccccacgggaagaagaaaaaaaaaaagagggggag

SEQ ID NO: 997 - DNA, 784 bp, Glycine max
tacggctgcgagaagacgacagaagggggaagtaacatagaaacaaacatgggaagcaacaaaacctacgaggaagaagaaagcacggttctattttcccattcccaaacacaaacagagttgttacccttcaacgagaacgacccgcaggacatggtcatataccaagtcctcaacgaagccaatgctctcaccaacacatttctccctcagaggcttcaccaacctcagttgtgcctcgagcccaccagaaacataacaaagaagcactacagaggagttcggcgccgcccctggggaaaatacgccgctgagattcgcgactctgcccgccacggcgccagaatatggctcggcaccttccaaaccgctgaagaggctgccatggcttatgaccgagccgcgttcaagatgaggggctccaaggctttgctcaatttcccagctgaaattgttgctgcaacggagttatctttcaataatactaatagtaacaatcacgatgctgtttctgattccagtgctggtagctcttgcacgaacaattccgttcagctaaataggaatcagtcagaaagctgcacaagtagcacaggttagctaaatggggttcaacaattaattgtagaaatctttttttttttttttcgcaattgggttggtttgttataattattataattatttgtatctgtctgtcttacaggacaccgaaaattaattcatttaatgtgataccatgttcatgaatgggttaaaaaaaaaaaaaaaaaaaaaaaaaaag

SEQ ID NO: 998 - DNA, 819 bp, Glycine max
ggctcgagccaaaaccacttgacacaccgggccgacttgcccttccttcaaaaaccaaagccagaccgaccctaagaagaaaccaacaaacatgggaagcaagaaaacctacgaggaagaagaaagcacggctctattttcccattcccaaacacaaacagacttgctgttacccttcaacgagaacgacccacaggacatggtcatataccaagtcctccacgaagccaatgctctcaccaacacattcctccctcagcccaccagaaacataacaaagaagcactacagaggagtccgccgccgtccttggggaaaatacgccgctgagattcgcgactcggcgcgccacggcgccaggatatggctcggcaccttccaaaccgctgaagaggctgccatggcttatgaccgagccgcgttcaagatgaggggctccaaggctttgctcaatttcccagctgaaattgttgctgctgctactgcaacagagttatctttcaaaagtagtagtaataataataataataataataataacaatcccgatgctgtttctgattccagtgctggtagctcttgcacgaacaattccacttgggtaaataggaatcagtcagaaatcacaagtggcacaggttagctaaatggtgttgaagttgaacaattaattgtagaaatctttttttgtttctttttctcaatcgttttggtttgttataactattataattatttgtatctgtctgtccaactggacaacaaaaattaattaattgaatgtgataccatgatcatgcatgggttaaaattataaaa

SEQ ID NO: 999 - DNA, 736 bp, Glycine max
  misc_feature (11)..(12): n is a, c, g, or t
  misc_feature (14)..(15): n is a, c, g, or t
attctatgaanncnngattacattacaatcgttgaagtctcatattaatgattgatcaaattgtacaacatgcatattcctctagccacttcaacattccaccttgacttggcttctattcttggctaatttattcagtagttcagccaggctcttcctcctctttgtcccttgtgattctgagctatcatctgaacacgaggacgacggtgatgaaatttctaacaaacttcgcttggaagttgtcatcattactggctccgacaattcatcggaattgtcggaatcaataagatgaggaaaattcagcttggccttttggcctcgcattttgaaagcggctttgtcatatgccaaagcggccttctcttcggtatcatacgtgccaagccaaaccctagctccgttcttctttggatccctaatctcggccgcaaactttccccacggtctacgcctcacccctctgtaatgcttccatgttggtggcgcatgatcacgcgctaccacagccgttgcatcctcacttcggaaagcaatgttccctgaatcaccatcacatttattagggtctgaaaatggatcatgagatgcagcttggtgggtttcagacatgagattgatggaatcatgtccaagtaggtattgttgaacagattccaagaatgcaaaatcggaatccacggtggcggaaaccatgttttaattttcagctaactttgctcaccgcgtttgg

SEQ ID NO: 1000 - protein, 259 aa, Oryza sativa
MLLNPASREVAALDSIRHHLLEEEEETPATAPAPTRRPVYCRSSSFGSLVADQWSESLPFRPNDAEDMVVYGALRDAFSSGWLPDGSFAAVKPESQDSYDGGKHYRGVRQRPWGKFAAEIRDPAKNGARVWLGTFDSAEEAAVASDRAAYRMRGSRALLNFPLRIGSEIAAAAAAAAAGNKRPYPDPASSGSSSPSSSSSSSSSSSSGSPKRRKRGEAAAASMAMALVPPPPPPAQAPVQLALPAQPWFAAGPIQQLVS

SEQ ID NO: 1001 - protein, 237 aa, Oryza sativa
MSLSLGFSAGAGVGADRLAAAPALQAAGALPPRVDVSLSLARAANGQPSSYLPLNENDSLDMVLFDVLREASAVAALSSSSSSSPELGARTTAPVVAGHPAGRKGGGGGGGGRGAAARGGAAGGRHYRGVRRRPWGKYAAEIRDPTRHGARLWLGTFGTAEEAAAAYDRAAFRMRGAKALLNFPPAVAGDGARRGAAAAAKQVGMSDVVPRACHVVCYSVLSAHIFYDIFRGVIPIP

SEQ ID NO: 1002 - DNA, 1429 bp, Zea mays
gcgcgcgggcggacgcgtgggcttccattccaatttccacacacacacgtctcagctcactccctcctccagtttcgtcagctcgtcatcataaaccgaacacagagctctcgattccattccaggatgctgctgaacccggcgtcagagacgtcggtgctagacaccatccggcagcacctcctcgaggagccagcggcggcggaggcgcggccggccgacgagagcttcgggagcctggtggcggaccagtggagcggctcgctcccgttccgcaccgacgacgccgacgacatggtggtgttcggggtgctgcaggacgccttcgcctacggctggctgcccgacggctcattcgtgcacgtgaagcccgagccagtgcggtcccccgactcgtcctcctaccacccctgctcctacgacggctcaccctgcttcggcctcctggacccggagccgccgctgacgcccggcaccaccacgcccgggagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgcggcgctcgcctacgaccgcgccgcctaccgcaggcgcggctcgcgcgcgctcctcaacttcccgctccgcatcggctccggggacaagcgcccgtcgccggcgccgcccgagcccgccacctcctcggactcctcctcgtcttcggccagcggctcgcacaagaggcggaagcgaggcgaggccgcggctgccaacatggccatggcgctggtgcccccgccctcccagcttaaccggccgccccagccgtggttccctgccgcgccggtcgagcaggcggcgatggctccgcgcgtggagcagctcgtcgtctagccatgcgtgcaacgatggatgcgccggcgaaagcgggggacggacagggcaaggccctgcgctgcacttgcgtgacagctccaccggatggaatgcgaatatgcgataaagctcgtgatgccgctgttgctccgtgcaactggcgcaagtggaagaagctgtctctgtgtgtaatcaagtgtcttgtctgcggacgaattttcggtatgtgcgtcgttgtcactgctcgggattgtgctgctgctgataagttcggaaaactgtacacccacgtagggagagagacgatccgtgatcaagaacagcccgctttgttctttctctgataaaaaaaatatccagcggccaaacaggcgcgcaagtcaacagaacagcgacctgagctcgtgacacgagatcgagatcgaaatcgcccccactgaaaccagaactgcagagccgagcggtaatccaacgctgacgacgtaac

SEQ ID NO: 1003 - DNA, 1274 bp, Glycine max
cgtagtaagcgcataccggctccagccacctactgcttcaaaaaattcttaaggatggccacagcagaagaaatttcaactttgaaactgttgcgccaatatctcttgggggatatttcagacccttttctcaccaatctcattccagtaaaacttgaagacccctcatcaggacttgatatgggttcaaacttctcagaacaaagcagcttctgcaagtttctggagtgctttgattttgaagcagaagtggtaggtctcacttctcatcataaggtccaaagctccattgcaacaagtccaccccagaatttcaattttccagaagaaccaatggtgtcaatgaaaaaggaagcaacatgttatgcaacaaggcattacagaggagtgaggagaaggccatgggggaagtttgcggcagagattcgcgaccccaaaaagaaagggagcagggtgtggcttggcacatttgacactgagattgatgctgctaaggcttatgattgtgctgccttcagaatgaggggtcataaagccgtgttgaatttccctctagaggctggaatgtctcatccagagcccaacagcagtggcaggaaaaggagaagagagtacacaacagctgccacaagttcaaggcatgttatgtcatgagaaataattcagtgtgggagaaccatgtttttcttttggcattttttgccagttacacaagttaaagcaaggttttatagttacactacagttgagcatgatgagatctgttatttaaatccttgagttatggttaagggtgaaattgaattaaacccaagaatgaaacagctcataaagaaacctacttctacttttttatacaaggctctcaaagtagaatgtgtgatagtcaccactcaccttagttcattagataatgaggaaaattcttattgcatcttaactttatctttattcgcgccgttactaaccatatcgatagtggcttgttttcatcatttactgtaatagtcagcttttttcacaaggataaggtattatgggatgttcagtggagtatttaagtggcttggctttcccttcttaattggcagctaagttataagggagggtttcccaagtgcttggatatgacaatgatttttgctttcctagttacttaattataattataggatttattagaatttatcatttcctattttttactcaaattttacttgtaaagaatgtacaacgacttgtgaatataaatgaggaaaataatcttgtctcct

SEQ ID NO: 1004 - DNA, 974 bp, Glycine max
  misc_feature (10)..(10): n is a, c, g, or t
  misc_feature (29)..(29): n is a, c, g, or t
  misc_feature (31)..(32): n is a, c, g, or t
  misc_feature (55)..(57): n is a, c, g, or t
  misc_feature (62)..(64): n is a, c, g, or t
  misc_feature (81)..(81): n is a, c, g, or t
  misc_feature (83)..(83): n is a, c, g, or t
  misc_feature (85)..(85): n is a, c, g, or t
  misc_feature (87)..(87): n is a, c, g, or t
  misc_feature (97)..(99): n is a, c, g, or t
  misc_feature (107)..(110): n is a, c, g, or t
  misc_feature (112)..(112): n is a, c, g, or t
  misc_feature (119)..(119): n is a, c, g, or t
  misc_feature (121)..(121): n is a, c, g, or t
  misc_feature (124)..(125): n is a, c, g, or t
  misc_feature (130)..(130): n is a, c, g, or t
  misc_feature (136)..(136): n is a, c, g, or t
  misc_feature (147)..(147): n is a, c, g, or t
  misc_feature (150)..(150): n is a, c, g, or t
  misc_feature (157)..(158): n is a, c, g, or t
  misc_feature (161)..(161): n is a, c, g, or t
  misc_feature (163)..(163): n is a, c, g, or t
  misc_feature (167)..(168): n is a, c, g, or t
  misc_feature (174)..(175): n is a, c, g, or t
  misc_feature (177)..(177): n is a, c, g, or t
  misc_feature (185)..(185): n is a, c, g, or t
  misc_feature (192)..(193): n is a, c, g, or t
gacccagcgngcgactgcatcttaaaggncnnaaggaggccacagcaccagaaannncaacnnngaaacgggggcgccaanancncnggggggaaannncagacccnnnncncaccaancncannccagnaaaacncgaagaccgcncancagaacnnganangggnncaaacnncncagaacanagcagcnncggcaaggggggagaatgcattgcggctggagcagacacagaagtggtaggtctcacgtctcatcataaggtcgaaaactccattgaaacaagtcttccacataattccaatttgccagaagaaccaatggtgtcaacgaaaaaggaagcaacatgttatgcaacaaggcgttacagaggtgtgaggagaaggccatgggggaagtttgcggcagagattcgcgaccccaaaaagaaagggagcagggtgtggcttggcacatttgacactgagattgatgctgctaaggcttatgattgtgctgccttcagaatgaggggtcacaaagccgtgttgaatttccctctggaggctggaatgtctcatccagagcccaacagtagtggcaggaaaaggagaagagattatacaacagctgtcacaagttcaagtcatgtcatgtcatgagaaataattcagtgtgggataaccatgtttttcttttggcattttttgtcagttacataagttaatgcaaggttttatagttctactacagttgagcgtgatgaggtctgttatttatatccttgacttatgattaagggaagcaaatggggtgaaattgaattaaaccaagaattaaacagttcataaagaaacctaatactacttttttatttaaagctctcaaagtagaatgtgtgatagtcagttagtcacgactcaccttagtcattatataattagaaaaattctcattgtatcttaactatacctttattctcaggattactaacc

SEQ ID NO: 1005 - DNA, 969 bp, Glycine max
ggctcgacctcacaacaatattgtttcatcactcagatcccttaaagatgacaacagcagaagaaacttcaaacttggatctcatacgccaacacctattaggggaaaatatcatctcagactcctcctttttctccaatctccttcatcatcctatgaaacttgaagcaccctcatcaccagaatttgatttcacctcatatatctcagacaacacaagctttttcactttccttgaaggctatgatttgatggcagacatgaaatttgttgattcagacaacaccatcccttcaaaggaggttaagaaatgcaatatttctcctgaaccattggtgtcatcaaaagagaagccaaagaagttagaatacgataaggcaaagcgttataggggagttagaagaaggccttggggaaaatttgctgctgaaatccgtgaccctacaaggaaagggacaagggtttggcttggaacctttgacagtgaaattgatgcagctaaggcctatgattgtgctgctttcaagatgagggggcagaaggctattctgaacttccctcttgaggctggactgtctgatcctaagcctaacagttgtggcaggaaaaggagaagagagagccatgatcatgaattggagctgccacaagtccaagttcatcatggtgtttcctgagaaaaagtgagaagatataataatagatttagttgttttgtgagtagcattaagtttgttgcctagaaaaataaggttgctttgccttttaggttggacgtagaagcaaggctaatgtgaaatgtctatatgaatctatgcaaaaagcatgttacgaaagttttactaactttgaggagttttaaaaaaatattaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 1006 - DNA, 1148 bp, Glycine max
tcacatttttttcatcactcccctgaggtgacaacagcagaaaaaacttcaaacttggatctcatacgccaacacctctttggtgaaaacatcatctcagactcctcctcctttgtctccaatctccatcatcatcctgtgaaacttgaacccccctcatcaccagaatttgagtgcacctcatatatcttagataacaacacaagcagcaacttcttcacattccttgaaggctatgatttggtggcagacatgaagtttgtaattgattcagacaacaccaccaccatggtgatcccttcaaaggaggttataaagaaatgcaatattaattctcctgaagaacaaccaatggtgtcatcatcatcagaagagaagccaacaatgaaaaagtcagaacattatgatgaggcaaagcgttataggggagttaggagaaggccatgggggaaatttgctgctgaaatccgtgaccctacaaggaaagggacaagggtttggcttggaacatttgacagtgaaattgatgctgctaaggcctacgattgtgctgctttcaagatgaggggtcagaaggccattctgaacttccctcttgaggctggagagtctgatcctaaacctaataacagttgtggcaggaaaaggagaagagatcagaaccatgatcatgaattcgagcttccataagttcaagttcatcatggtgtttcatgagaaagtgagaagaatattagagttagcttaattagttgtgtggctagcattaagtttgttacttacctaggaaaataattaatatgcctgtgaaagtctgtacatagaaacaatgctaatgtgaaatgtctatatgaatctatgcaaagtatgttatgaaagttttactaacttttaggagttttagaaaaatattaatcagtttatgtttttttttaaccttcaatttatcagaaaattttttttctgactaatccaaaatttgattaggagatcaaataatctgataaaacattattttcactgaagataatcaatttatgtttgaagatacaccgaataaaatgaacaaacacattttcttttttgttgtttgtctctgtttttgagggaaacatgcaaattcttttcagttcaccttcacttttgtc

SEQ ID NO: 1007 - DNA, 1435 bp, Glycine max
agcggctcgagcggctcgagctcccaaattctcaactttcctaactttagcaaccatctaagaagttcagtcccttaattatctctcaccttgaattagaaaagcattcaaagctttgaacccaatttcactgtttgcacctcaaacatcttagaagtcccaattgagtctcaattccacaaccaaaaatgcaaagttcaatttcacaatctgatatttttatcactgattaccttgtaccccaagaagttccatttcaatttcaatttcaagatatgagcaagaatgacaacaacatgccaatgaaccataccaataataaccttcaaatgcctcaaatcacatctttctccaagcctccaaggtcctcatcaaatctaagcaaccgcaaaccctccttgaaaaacatcacaatcccttccataacctctggtcttgcaacagctatgtcacaaacaacagcaacaacaacaacaatagctacaaccatgtataacaacaaccaagtttcttcttcttctttttcttcagatgaaaccaacaataccaaagacgacaagcactatagaggggttagaagaaggccatgggggaagtatgctgcagaaatccgtgaccctaatagaaaaggctcaagggtgtggcttggaacctttgacacagccatagaagctgctaaggcttatgacaaagctgctttcaagatgagagggagcaaagccatattgaacttccctttggagattggatcagatcagtctaaagaagagtcatcatcatcatcatcatcagtttcaagcagcagcatcgtcatcaaggttggtgtgaagagagaaagagaggaagagagtgaaaggaagaacaactatgagaaaagtgagtttaacaacaatagtaatagtaataagcatgtgaagaaagaagagtgccctttgactccatcatgttggaaaggcttttgggacactgatgttatgggaacaatctttagtgtgcctcctttgtcaccactatctccactaatggttgtttgagattttgtggaacttttgctctttcaatgatgttttgaggtaaccaaactaaggggagagagagagatgatgctggtgattgtcctctctgatttaggttgctaatttgcctaaatcaaaatggtagtactaattaatctactaatagattaatttgcaagtgaatatatatatggatttgtataatgtaaatataggatagtactatgaagcaagatctttttgtttgttgaaaaaaaaaacaaaaaacccatgcttatcttcttcctttaggtaaaaaaatgtactgtacttgaagcaatattgaaatttgtttattcgtttattggagaaaaaaaaaaaaaaaaaaaaaaaaaggaaaaaaaaaaaaaaaaaaaaaaaaaaaaaaaaaaaaaaaaaaa

SEQ ID NO: 1008 - DNA, 1091 bp, Glycine max
tacggctgcgagaagacgacagaaggggaacacaatactcttcaaacactttaccttcttcttaagacaacaagctaaaagcgcttctaacttaagtgatggctaacgctgctgaagtttcagcgttgaaacgcatcaagttgcatcttttgggtgaactctctccactggccactccccaaaacaaatttgaccaaacaaaccctagcccctctgaatcttccaattccgaatcttcttctatttctcttaaccactacttcactgacctcctcgaacccgaaattgaatttcctctcttcgaattcgattccaaaccccaagtaatcgacctcgaaaccccgaaaaccctaatttcagctgagaagaagcctcaatttaatcggaaaccgtcgctgctaatcgctgttccgaagaagaccgagtggatccaattcggaaaccctgaggtggcggcgccggagaaccagcctgagaagaagcactacagaggtgtccgtcagcggccgtggggcaagttcgccgccgagatccgcgacccgaacaagcgcgggtctagggtttggctcggaaccttcgacaccgccatcgaagccgccaaggcctacgaccgagccgccttcaggctccgcggctccaaggccatcctcaacttccccctcgaagttaacaccgcggcggagaccgtctccgtcgccgccgtcgacgtcgagaggaagcgccgccgcgaggaggaggaggtggtggtggaggatgtaaaggcggtggtgaagaaggagaaaataacggagcatgatgtgagttgttttagggggatgccgttaacgccgtctatgtggaccgggttctgggacagtgacgtcaaggatattttcaacattccgccgttgtcgccgttatctccttttggattttcaccgctcgtggctgtgtgaaattccaatttaggactgcgttttttcgtgttttagtacttacagcgtcctcctgttcagggatgagtacattgtacatttgacgaatttgtttattcaacaatcttttattcacttttatttgctacataccatggagaatttttttgaagtttg

SEQ ID NO: 1009 - DNA, 1018 bp, Glycine max
ccacgcgtccgctctttaccttcttaacgcaccaagcgaagcgaaaagcgctttctaacttaagtgatggcgaacgcagctgaagtttcagccttgaaccgcatcaaactgcatcttttgggtgaactctctccactggccactcccctaaactattttgatgaatcaaaccctagcccctctgaatcttccaattcccaatcttcttctgtttctcttaaccactacttcactgacctcttcgaattcgactccaaaccccaaataatcgacctccaaactcccaaaacactaacttcagctcagaagaaacctcaattgaatcggaaaccgtcgctgctaatcgctgttccaaagaagaccgagtggatccagttcgggagcccggatccgaacccggtgatggctgcgccggagaacctgccgcagaagaatcactacagaggtgtccggcagcggccctggggcaaattcgccgccgagatccgcgacccgaacaagcgcggctctagggtttggctcggaaccttcgacaccgccgtcgaagccgccaaggcctacgaccgagccgccttcagactccgcggctccaaggccatcctcaacttccccctcgaagttagcgccgtggcggagaccgtctccgtcgccgccgccgaaggcaacgtcgagagaaagcgccgccgcgaggaagaggaggtggtggtggaggaagtaaagccggtggtgaagaaggaaaagataacggaacaggatgtgagttgttttagggagatgccggttaacgccgtctatgtggaccgggttctgggacagtgacgtcaaggacattttcaacgttccgccgttgtcgccgttatctccttttggattttcaccgctcgtggcggtgtgaaatttctaatttagcactgcgttttttcgtgtttaagttacagcgtcctgtatggggatgagtacagtgtacatttgacgaatttgttaattcaacaatcttttattcacttttatttgctcc

SEQ ID NO: 1010 - DNA, 1027 bp, Glycine max
tttttttttttttttttttttttttttttttttttttttttttttttttttttttttttttttttttttttttttttttttcaatataataaataaatgaataaattatctccatattcgacaaggaaagaagaaaaaaaaatgatttcacacaaccataagctgtggaaaacccaacgccgggtggggagataacggtgacaagggcggcacggtgaatattccgtttgcatcactaccccagaaccctaaccaactagacggcgttaaaggattattcttaataagactaacgtcggattcccctatcttttctctcttgacgacttcaagcaccggctccaccttctcttccctttggcgtttgcggtcatcggcgccggcttcgagggggaagttgaggatggctttggagccgcgaagcctgaacgcggctcggtcgtaggctttggcggcttcgatagccgtgtcgaacgtcccaagccacaccctggagccgcgcttgttcgggtcccggatctccgctgcaaacttcccccacggtctctgtcgcactcctctgtagtgcttcttctcttccgcgttcgggttactctgcgacaccgtttcggtaacctcgggctctccaaattggatccactcggtcttcttcgggagagagatttgcagcgacggccttcgactcgatttgcagcgtgtggttggaaaactgaattccaattgtggctcaattatttcgggttttggctcaaactcgaatgcagaaaactggttttgttctgtggaagaagtagtagtagttgggaaatcgaggaattcggagaagatttggtcaactgtggtgaatgaatcggaagttgaagattgggaacagagggaggttgtgtttggttcctgaaattgggtgaggggagagagttctcctaaaagatgcagcttgatgcgattgagagcagagacttcaagagcgtttgccatgagatattgagaggagaaggagctttagaaatgttaagacgtgtggccc

SEQ ID NO: 1011 - protein, 273 aa, Oryza sativa
MAGFGLDQHLDLIRAHLLEDAHHHVLAPSPSPSPPGTGRVRPAPVSLPPRPPLLWAAASAAPRQQEECFELGGGYAGEGEGEEEDDFRRYRGVRQRPWGKYAAEIRDPARKGARVWLGTYDTAVEAARAYDRAAFQLRGSKAILNFPNEVAADAAVKWAPPVAPIPAAAMSAGRGKRVRSEEQYYLREVKKERLIMAPPENSSSSSSSAAAAAGDIWDELKGICSLPPLSPLSPHPHMAFPQLFVIDLAFGQILNSFVLLLLRTRDFAFDYAI

SEQ ID NO: 1012 - DNA, 400 bp, Zea mays
  misc_feature (369)..(369): n is a, c, g, or t
gagctcgcacgcttggggcccggcggccgtgccgctggaggcacctggcgcggcggtgctggacgcgaacgacttccgcaagtaccgcggcgtgcggcagcggccctggggcaagttcgcggcggagatccgcgaccccaagaagcgggggtcccgcgtgtggctcggcacctacgacaccgccatcgaggccgcgcgcgcctacgaccgcgccgcgttccgcatgcgcggcgccaaggccatcctgaacttccccaacgaggtgggcacccgcggcgcggacttcctcgcgccgccgccgccgccgccgcatgccgcggcaacgtcccagaacaaacggaagctgatgcacgacgccgaggccacggncacggccggggccggagccggagccgagcca

SEQ ID NO: 1013 - DNA, 889 bp, Glycine max
ggtatataatatgtcactaatttaattaggcacagactagtagctgaagcaaacttccccacggcaacattatgtttaagagcttctctagatggtccatgtttcaaccagaatagaaataacagaaggcaagtagctaaaccatggcatagttccctatgcatgtattaagcacacaattggaaaattcgtgcaagttatatccatagtggtggctttcagctgcatttacaaaccagggagcagattatgcgtcacccgatctgtttgatcatagtcaataaaccgtgtcaccacgttattgccgcccccaccccttttctggccctccatccgcttcccccaaacctcaccctcatttctcaagatatgttcctttttcttaagattctctccagattccatcatcaatcgcatctttgctgatctgattcgcgaaagagcagaatgaaccagtttctctagttccataaggtcagtcacactcagatgctcaagttcagaaacaccaaagtggctttggaccaattgagaaaacgcttcatcagaccagatatctgcaatttcaaagcggagtccctttgtgtcagtaccgctcgctcctaagttatcccaatatcgctgcacgacctcggccaaactgtcaccgttgcaaagctcgtagagcttgccggtgctggagaagatgagcagcgccaacttcgcatcgcagagaatggataactcgcgggctttcttcatcaatcctttgcgcctcttggagaatgttatctgccgattgcttttgttctcgattcgctttatctccagcttcttcttccccattcttcttcgcgccaaaaccctagctagctaccttcttttctattcggttttctcggacgcgtgg

SEQ ID NO: 1014 - DNA, 964 bp, Glycine max
tgtcgagccgattcggctcgagaagaccaaagaaaaaaccaaaatcatcgtgtggtttttcaaggaccaaattcaaatcagtcataaaaagggggggtatggaaggaggagagagaggtgttaatcccaatatttatgagtctccaagtttcagtcgcaaacacccctcaagccatccaggaaatgggttttgttcaatttgaagaaaaccaggttcttagcttcttggcaccctctgctcaatcccaatcttctcagctctctcaatctctaaacgcctgcaacggtggcagcaatactgctgttgctgccgctaccacaaccgccaccgccaccacctccggatccggagcaacaattggtttcagccataatgaccttgtatccagaacttgttggtataataatgaacaggtgcgaacactggatcccaaagctgtcaatgatgaaaattgcaccggatatactagtgatggtggcaacaactcatggtggagaagtgctggctcagagaagaacacgatgaaagtgaggaggaagctgagggagccacggttttgtttccgaattcggcttgaggtagatgtgcttgatgatggttataaatggaggaagtatggtcagaaagttgtcaagaatagccttcacccaagaagctactaccgctgtacccataacaactgtagggtgaagaaaagagttgaacgactctctgaagattgtcgtatggtaataactacctatgaaggcagacacaaccactctccttgtgatgactcaaattcatcggaacatgaatgtttcacctctttttgaacaatgtcgtttcaataattattatgtattattaataattaattagctgtacgtgacattttcatgaaggatattgcattgtacttatattgttactatttgttattgagctcagtcactctttcatggaataaaaaaaaccaaaccc

SEQ ID NO: 1015 - DNA, 609 bp, Glycine max
actgcaaagatcaagatatcttatacacgatattaaagtccatgacatccctacacatggtcatcttatctagctaaaaaataataatctatatattgacaacaaaaaaagcttccaaatatatggacaagataaaatatttttttgtggggtaatgtggttccctccaaataggaaaaatatggagaaagaaatctagggaaatgttttaacaagcatatcgatactgagagttctgaataatgacatgactgagttcatctttgaagcacactgaactctgtggcaaagtacatggcaatctatcaataatatcatagtgccttaattgagttcataattaaatacatgctgatcatcattataagcaaatgacattgaccttactagaaagaggtaaagcattcattctcggatgaatttgagtcgtcgcaaggggagtgattgtgtctaccttcataggtggttatcaccatacgacaatcctctgagagtcgttcaaccctcttcttcaccctacagttgttgtgggtgcaccggtaataacttcttggatgaaggctattatgacaactttctggccatatttcctccatttgtaaccatcac

SEQ ID NO: 1016 - DNA, 589 bp, Oryza sativa
  misc_feature (544)..(544): n is a, c, g, or t
aagcttcctactacattttcattcataattagactgaatatcatgcaacgtgttgatcgatcggctagctgattgaccaggaaattaaatagcatccataagagttctaaaagctttcctagaacatttttattttacatcgatccctgctttttcgatttcccaattgcccccatcagatcagaaaacaataatccatcaccgatccatgtacataagcatgcgttcgtcaaaaggaggggaaggcccacctggcggggtggtccccggcggcgcccgggggggcgtcctcccttcaggggggggggggggggcggccctcgtagggggggatcaccatgcgggaattctccgacaggcggtccacccgcttttttacgcggcagttgttgggggtgcacctgtagtaactccttggggggaggctgttcttgacaaccttctggccatacttcctccacttggagccgggggccagacatccacattgttcctggtgtggaagcagaacctcggctccctcatcttcctcctcaccttcatnttccccttctccggccccttccaccatgaattaggcccatggcaa

SEQ ID NO: 1017 - protein, 344 aa, Oryza sativa
MVNFLKLSDIQSTDAESVDVGFISSVHKTTRKKGFTTCLLGRNSILFGKTTVVIGEKVEHCCRWSQEEEITGIAGVDSCYGEPGGVLSGRLGVNGEKGSTQFQISYGVSSAFGFRCDFGTGFITHGMGDHHGMPLPPPLQLPCHPKLLQMPFDQEDQPGIHGVMLSSDHCGLYPLPALPLSNSAAAAAATVALGKHSAAAGSMPNIGGAEEVATTVTKAGNESTTCNGSTTWWRGSTMAAAGEKGKMKIRRKMREPRFCFQTRSEVDVLDDGYKWRKYGQKVVKNSLHPRSYFRCTHSNCRVKKRVERLSTDCRMVITTYEGRHTHSPCDDNSSGEHTNCFSSF

SEQ ID NO: 1018 - DNA, 509 bp, Zea mays
ccccttttcgagttttttttttttttttttttttttttttaagggaacaaatggcagtgtagctttatttgatacaacactacacatgaccgcctacaccgatggacgatggaccctctatcacatcggattacatgatgagtacactacgcatgcatgactagctagggttcatcgaccacacgctctgtcattcattcggcaagattgaagaccgtgatcaccaacaacatctatcgtggtcgtgggacgacagaacagatacggttcatcaaaaggagctgaagcaatcggtgtggtcgccggaggaagcgtcgtcgctgcagggagagtgcgtgtggcggccctcgtacgtggtcatcaccatgcggcagtccgtcgacagccgctccacccgtttcttcacgcggcagttgctgtgggtgcaccggaaatagctccttggatggaggctgttcttgacaaccttctgcccgtacttcctccacttgtagccatcatccagtaca

SEQ ID NO: 1019 - DNA, 375 bp, Glycine max
ggaattccgcacgaggcaaaaaccaattaagggttctccatatccaaggaattactataggtgcagcagttccaaaggttgtatggctcgaaaacaagtcgaacggagtaacactgaacccgacatgttcgtcgttacgtacaccggagaccactcgcatccccggccaactcaccggaactcgctcgccggaagtacccggagtaagactctggtaaccaatccgccaccgtcacctgggtcactctcctgcttccaagccacccctttttcttcttcttcttcatcgccaccacactctccaacgtcgccggaggaagatccacggaaaccgccgatttagaacccgacccggatatggaaaccgacgggaac

SEQ ID NO: 1020 - protein, 361 aa, Oryza sativa
MEEELCGNNWDLDAVVRLGCCRRRISPAAVAQQVDPFASFLQQGVAMEVAAEKEVGVEAAWSFPELTVRDGGGGGLGRDADELLKAFCAAFPSSSSSKSSPLPTPPPPPPTQPQPEQQKPVTVQENLPAPTTAPARASQPAAARQVPAGGVPRSKRRKNQQKKVVRHVPADGVSADVWAWRKYGQKPIKGSPYPRGYYRCSSSKGCPARKQVERSRSDPNTFILTYTGEHNHSAPTHRNSLAGTTRNKLPSSSAASAASAQPQPPPPSVVVVGAGGGGAEAAGLSPTTPLRTPSMEEDEEEEEEEELLVEDMEMAGEDELLFLNGGDDNAALDGTPMSSLFDIADEPFLPSPWTEPTAAGS

SEQ ID NO: 1021 - protein, 386 aa, Oryza sativa
MDGDAWWYPGGGGGGGSNNWDLGAVVRFGCGGGRVSPAAALLGEAWEYDDDPFSSFLAPPMTAQQAALPAVWEEGDDGDAAWMAPLPGLQTGGGWGDQAPMVVDELCGALVVAPPPPPKQQEVLQVQQQPPPADNTQPTTYQQGSGGDGESTRAGGSRSARRKYAASAIYIVSVCFSDSCIMWIRSLADDRGVRHACRKKQTRKEVVRVAASGPAPDLWAWRKYGQKPIKGSPYPRGYYRCSSNKNCAARKQVERCRFDPSFLLLTYTGAHSGHDVPLHRNSLAGTTRHKPPPPPPLPSAADKSPATAAEAATASQSPGLSPTTPLRASSMELHGEDDAEAELQVEEDDMAIDDEDDDDVADETISTVPWGTPISDAIIAASYEWR

SEQ ID NO: 1022 - DNA, 723 bp, Zea mays
cattgggtacctcgaggccggccggtatctcctccgccactttcctccatttcccacacccccgccactccacgtcgtcgtcgtttgctgccgctgcgcaatggaggaggagcgctgcttcaacaactgggatctggacgccgtcgtccgcctgggctgccgccgccgcctctccccgccacggcagcccgacccgtttgcttcgcttctccctccgaccctgccgtcgccgtcgccgtcgccgccgcagaaggagaagcccgtggtgccagcgctggctaaaggaccagagccagagccatacgccgggtggcgctttcctaacctcggtgctggcggcgggcaagacggcgacgagctcatgagggccatgttagcagtccagccttccctgcctcagcctctgccaacgacaacgccaacgccaacgccaacgcttcccccggcagcaggagagcatcgacagtcgactgttacagccgtggacgtgccgctaccccaggtgcgccccgctccggccgccagagcgcagccgagcgggcggcaggtgcccggttccgtgccaagatccaagagaaggaagaaccaggtgaagaaggtggtctgccacgttccggcggacggctcgtcgtcggacatgtgggcgtggcgcaagtacggccagaagcccatcaagggctccccctacccaaggggatactaccggtgcagcagctcccaggg

SEQ ID NO: 1023 - DNA, 1581 bp, Glycine max
gtcgacccacgcgtccgcccacgcgtccgtacggctgcgagaagacgacagaaggggatacctctctgtagcgaaaagtcagcgccttcttttgtctctctctctcaaaaaaaaaattccacacactgcagagtttgtctctctatggcggaagattgggatctacatgcggtggttagaggctgctccaccgttacatcatcctcagtgtcttcttcttcatctccttcttcctctggttttgcctcttcttacttccaccctgaagctgcagtttcttcttcttcttcttcctattctggcttcaacatcttcaagggtgaacaaggaataagccaagttttgtcgctctctgcgtacccctttgaggcaaggagctccattgaggaattgcatgagctttgcaaacctttcttctccaaatctcagcctctaacgttgcaagcctcttcacctttgtcctcactctcttcctattcctctgcgccacccaaatctgtttcaacgcaagagaaacaacaacagaggagcaagcaggcacatgctgtcaccaccccacgatctaaaagaagaaagaaccagcttaagaaagtttgtcaagtgccagttgagaatctctcctcagacatatgggcatggaggaaatatggccagaaacccataaaggggtctccatatccaagggggtactatagatgtagcagctcaaaggggtgtttggcaaggaaacaggttgaaagaaacagatcagacccaacaatgtttatagtgacttacactgctgagcacaaccaccctgctcctactcacagaaactctcttgctggctccacacgtcagaagccattggtacctcaaacagccaccaccactgaagaagactctgacaagagcaagagcctcacaaaacccacttcccctgccacctcaggggcagaagaagaggctccaacaccatcacaaggggaaaagtctgagagcagagaagagaaagaggatgtgatggatgatgaggaagaagatgaatttggcttgtctgatatggtgctttcagatgacttctttgaaagtttggatgaactgagccaacttacggctccttctgttgtcactggagactgtttcagtgaccccttttcagcaattgcaatcccttcttgggtggctagtggtgctgctactgctagtgggtgtagatgattctttcgggcaaatcatcacaatgcttttcattgatgacaatagggaccttttctttttggtttttgtttgtagaggaaatggaacattttggaggaatctttactaacaatggtttgtggatgggaggaaaagttttccttagtagagtagtagtgactagtaaggtagatcaagcattaatcttgttaaaaatcaatgattattattaggcattcatagttttattatttatgtcatcatacctatgtgttaatgtaaaaacaatttattttagtaagctttttgtatgctccttgagttgtggttgagttcattgtatttgacattggttttgtgatataaattggcaaaagcacttttgggttgacttgtggccgc

SEQ ID NO: 1024 - protein, 336 aa, Oryza sativa
MEHFNDWDLQAVVRSCSFPQSEPPRVGVGVPAAPGAGGAPVVVAPPARAPDGPDQMARASASALYDLEYLDLDHKPFLLPGSSSSSSSSRAVARARGEDDGKGRHEVMISFPAAAAASTSGAQPRSPSGRKPGIRTPRPKRRSSKKSQLKKVVYEVPVADGGVSSDLWAWRKYGQKPIKGSPYPRGYYKCSSMKGCMARKMVERSPAKPGMLVVTYMAEHCHPVPTQLNALAGTTRHKSAPTGDDDKPTSPGPAAGRAAAGEGVVKCEDVDGNELSAMAADGGAEDTAAAADDDGELWPEGMGLELDEFLGPMDDDVFEFDHVLEDDGVLGRRLSL

SEQ ID NO: 1025 - DNA, 1258 bp, Glycine max
gctttgctattatctcttcccttgtccttcttcctactatactatattttctctctctaatcaatcatagttctgatcttcatacacttaccccggaaacctccatttctcagatcaagcttgcacgaagacattaaaaaatagaaatacatacatagctatggacaataatacttgtgcctcctcccaacttgagtcagaagaagcatcttttgagcacaaatcagaaactcaaacatcaaagaaaaggaaaatggttgagaaaacagttgtggcagtgaggacaggagagaatgttggcaagctgaagaatgaagggctaccttcggatttttggtcttggaggaaatatggacaaaaaccgatcaaagggtctccatatccaaggggctattacaagtgcagcacatccaaaggttgttccgccaaaaagcaagtagagagatgccgaactgatgcttcaatgctcataatcacatatacctctacacataaccatccatgccccactgccatcaccacaaattcaccccaacaaccaaaagaattatccgaatccgaaaccacccaagacctctcagctaccacaaaggaggaagaccaagaacatatagaactagaagaagagcaaagggataataataagcccagtgatgaagttacaaatgaagaaaattttcattacttgcaatctcctatacgttgctccggccaagacatcattatagaacaagaagatcctttcaaactaaacacggagaaaagccatgatcgaatggatctcctcttagaggaagagcctctttgttttgcacagctcaagaacttgtctgcttccaaaaacgaagaacttgactttttcgatgagcttgaggagttacccatgtcttcatctttgttgcactttacgaggaacattttttccgatgaaaggattcccgttggcccttcttgattctagtgttgttttctcggtgcttgctatgctagtgacagtgtatgtattgttttcatccatgttatatatccattaatttcagctagtttttcaattcggaacttttctttttcttttgtaccctttatttatatgattatatcctatacttttaattaattattggttcacaactaagcatagttcatcactttggcgtgagcagggttagtgtgtagacaaaatcatcagctcttgcaattaaaattaaagaatgatggtttggctcacaatcaatggtatattgttcattctgtattc

SEQ ID NO: 1026 - protein, 514 aa, Oryza sativa
MPPCVWGSHTPLSLLSPPAAWAGERMEGDQAGGDLTDIVRAGGGAMPGSVVVDLPSTAAEWQLPAEPMLFPPPPSLSSTTDGCGAGGAAGADIFGGGGGDLFSGLVDPFSSDYSSGADFLDAMPDAMAKVGFDTAVGGGCGGGGGGGGGSGGHLLDMSRKPLLPRGMPMAAVGGLAAPRVMPSPLSPRAIRPYPPISAGDMMKLGITAGQAAGCAIDAAVAGMQMSSPRSGGIKRRKNQARKVVCIPAPTAAGGRPSGEVVPSDLWAWRKYGQKPIKGSPYPRGYYRCSSSKGCSARKQVERSRTDPNMLVITYTSEHNHPWPTQRNALAGSTRSHHSKNSGGGGGSGSKGSQNDKSQQQPSVKEEQKDQATTATTTTTSTITTTNSASPVVVKEEEAALAGSSEALELERVMDTTAAGVVDHSELMDHVFSESYKPMIPETGQPDDFFADLAELESDPMSLIFSKEYMEAKPSGGDHAQEKAMAKELDPFDMLDWSTTTNSSAGSSFEQGKRG

SEQ ID NO: 1027 - protein, 299 aa, Oryza sativa
MCDSLFWQSSADQGDLSDVVRASLQLQTAPRHQAASPPYVHLLGGGGGGGEDQLAAVSQHAEQQQQSMVDASAACDLLHALLPPPPVVQVQQQGASRTRTTIEEDTTGDGEELFAGAHYVVPPIKRRKSQTKKVVCIPAGASGGGGGEVVPSDLWAWRKYGQKPIKGSPYPRGYYRCSSSKGCSARKQVERNRADPTMLVVTYTFDHNHQWPTHGNAFAGSTRPSSSNSSNIRLQDSTPVHHQSQTGHDRLTTTHLKQEDVIISPSLLQPDHHQLCTIIDTKHHLLFHQDYPHSFGLFD

SEQ ID NO: 1028 - protein, 299 aa, Oryza sativa
MCDSLFWQSSADQGDLSDVVRASLQLQTAPRHQAASPPYVHLLGGGGGGGEDQLAAVSQHAEQQQQSMVDASAACDLLHALLPPPPVVQVQQQGASRTRTTIEEDTTGDGEELFAGAHYVVPPIKRRKSQTKKVVCIPAGASGGGGGEVVPSDLWAWRKYGQKPIKGSPYPRGYYRCSSSKGCSARKQVERSRADPTMLVVTYTSDHNHPWPTHRNALAGSTRPSSSNSSNIRLQDSTPVHHQSQTGHDRLTTTHLKQEDVIISPSLLQPDHHQLCTIIDTKHHLLFHQDYPHSFGLFD

SEQ ID NO: 1029 - DNA, 1119 bp, Zea mays
actgctcatatatccgcctcccctcgccctccctctctctctctctctcactcacaaacaaacaaacaaacaagcctggatcgagcgaattcagccgagcttcagaaacccttgcaagctcgtagcaacttctctcaaccttattcggctttcttctagctatataacgaccctaaattagtctgcttcattcggttcttgcgaattgccaagaccgaaagaacagcttattactcttctgttagaaagactcgaagaggccggccgagatagactatcagctagctagagggagctaactacctacctagctagccatgtgtgactacttcctgcaaaggatggatcagggcgaccaccaccaccaccaccaggccggagacctcacggacgtcgtccgagccggcggcggcgcgatgcatcaggcagctgtcgcggagctctcctccgcggacacggggtggcagctcccggccgagccagcagctggagcaagcctcttcccgccaccccagccctcgtcgtcggactgcgacggcttcgcggacgcgttcgccggcctcccggacccgtttgccagcgactttcgcacctcctcctcctccctccggcgtgggccttggccctgccgacttcttcgacttcgaggcgcctgctgctgctgctgctgccggtggcggcgctcgaagaggcggaggcgtactggcgggcgcgcagatgcccgcgctgtcgccgagagagatacggccgtacccggtgacgatgggcggcgacaccgtgaagatcggcgcgccgacgatgatgcccgggctggccgttgggccgccctgctgtgcgttcgacgctgtcgccgggatgcagatgccgagcgcgcacgcgcacggtgaggggatgaagcgcaagaaaaaccaggcaaggaaggtggtctgcatcccagctcctgcaccatgatcgggaggaggaaggaccactggggagggtgttcgttctgatctctgggcttggaggaagtatggacagaagcctattaaaggagcacgctacccaagagggggctacagatgcagcagctctaaaggatggccggcgcggaagcaagtggagcgcaagcgaaccgac

SEQ ID NO: 1030 - DNA, 780 bp, Zea mays
ttgggtacctcgaggccggccggggccttgctcagcctcagccctcaggcctcagccagcgtgcgcgcccacaacccctcacgtcgtccccgccaatcacaccgcacgaaccgaggacgacgggacaccaccgtcaccgcgacgtagtagtagtactacatgcatagcatagcctcgtggagtcgtggtagtagtagtttagttttgctcgcttccacaccgcaccgccgttcccttttttatatcccgcggatgcgcctgcctctgcctcggggtcgggggggcagctggtgacatcggattcggatcaggccgagaagatcgaactgctccgatccggcgcttaatttctctctctctctctcgggctagctgcccgggcaaatggacgccgagtggagcggcgacgagagcaaggctggcgctgcgggcggagtttcgtcggctgattgcccaggttcgccaccgccggtgtcgccggcgccaccgtcgacgtcgccagctgctaccggtgccgggaggaggcggtcggcgaacaagcgggtggtcaccgtgccgctggcggacgtcagtggcccacggcccaagggcgtcggcgagggcaacacgccgacggacgcgtgggcgtggcgcaagtacggccagaagcccatcaagggctcgccttttccgagggcttactacaggtgcagcagctccaaggggtgcccggccaggaagcaggtggagcggagccgggcggagccggacaaggtgatcgtcacgtactcgttcgagcac

SEQ ID NO: 1031 - DNA, 1061 bp, Glycine max
tttttttttttgtagttaaattaataatatttaaaatttaaaaaatattctaaataaatgatactaatctgaggaataaataatacaatatgttcacgtgctagcaggagcaaacttaatttgttttatttgttccaaccatatattttcaccattatttgtacgtttacaccaataaagattgagcaaaagaatctaattcatctggtttctcctcaacattcaagagctgcaagtactcttcatagagcttttctagcgtatcatgatcatcagtgtgaacatcagaatagcattcctcgtaagaggcagtattgttgactaggtcatggtcttcaccaaagaatatttcaatcccaccattgtctccaatattgtcacttaccccccaaaccatgttcacctcttttgtttctgcttctgggctttgaactttctcttggcttgttgatgcagtcgtagctgaattcgaatcaagggttaaggtgctatccgttctgggtatacatgacgataaagccttaaccctgattggttttggtagataaactaaggtcttctctgaccctttgttattctcagtactcttttgcttattcttctttttacccttcttcttctctggtgcctcagttaacttgtcgtgtgtctttggatcggttccttgatttctcagcttcttgctgagatgggtattccagtagttcttaatctcattatctgttcgtcctggtaatctccccgcgatgagggaccatctatttcctaaaagcgaatgcattctaactataagatcatcttcttctggggttatgtttcctctctttatatcgggtctcagatagttcatccatctcagtcggcaactttttccgcatctaagaagcccggctctttttggtagtgatctccactggccttctccatgagtttgaatatacttagtgagcaatgcatcttctcgaggagtccatggacctctatgcaaccctactttagagcaacaaggagctcttcccatcttcagaagcttctctagcgaactctgaaaggaagcagag

SEQ ID NO: 1032 - DNA, 1014 bp, Oryza sativa
tctgcgaggaggccaagctagtcgcgcgcaaattaatcgccgatcgatcctacgatgaagcggaagcggccggcggcgctgcgcggcggggaggaggcggcggcggcggcgctgaagcgtgggccgtggacgcccgaggaggacgaggtgctggcgcggttcgtggcgcgggaggggtgcgaccggtggcgcacgctgccgcggcgcgcgggcctgctgcgctgcggcaagagctgccgcctccggtggatgaactacctccgccccgacatcaagcgctgccccatcgccgacgacgaggaggacctcatcctccgcctccaccgcctcctcggcaaccggtggtcgctgatcgccgggaggttgccggggcgcacggacaacgagatcaagaactactggaactcgcatctcagcaagaagctcatcgcgcagggcatcgacccgcggacgcacaagccgctgacggccgccgccgatcactccaacgccgccgctgccgtcgccgccacttcttacaagaaggcggtgccggccaagccgccgaggacggcatcctcgccggccgctggcattgagtgcagcgacgatcgtgcccgaccggccgacggtggcggtgacttcgcagcgatggtgagcgccgccgatgccgagggattcgaaggaggatttggcgatcagttctgtgccgaggatgcagttcatggtggcttcgacatgggttccgcttccgccatggtgggtgacgacgacttctcctcgtttcttgattctctgatcaacgacgagcagttaggcgatctcttcgtcgtcgagggcaacgatcacgagcatggcaatggtgagattggtcatggagacgtcatggaatccaaacagtaatctttcgggagattgatcagggaataagttgaccatgagaaaacatgtaagaacagcttgtctgctgagtcatgaccggtgatgtgtatgtgatggaagaaaacgtatgtacgacttaatgcttgcacctat

SEQ ID NO: 1033 - protein, 275 aa, Oryza sativa
MKRKRPAALRGGEEAAAAALKRGPWTPEEDEVLARFVAREGCDRWRTLPRRAGLLRCGKSCRLRWMNYLRPDIKRCPIADDEEDLILRLHRLLGNRWSLIAGRLPGRTDNEIKNYWNSHLSKKLIAQGIDPRTHKPLTAAADHSNAAAAVAATSYKKAVPAKPPRTASSPAAGIECSDDRARPADGGGDFAAMVSAADAEGFEGGFGDQFCAEDAVHGGFDMGSASAMVGDDDFSSFLDSLINDEQLGDLFVVEGNDHEHGNGEIGHGDVMESKQ

SEQ ID NO: 1034 - DNA, 3245 bp, Glycine max
acactttcgggcgtagtgtgtgtgtagcagtttctggttctgtttttggtttcgtttcagcaaaacctctcttcttcttctgattgattccacctcgcgatttttcgattttcgtttgttttcttctttttcggtttctgatctgaactcgattcgattcgctattgccggaaaatgagtcctccggcaagtgtccggtgatgatcgctccctcgagaggttgttgaggttatcgttgttgttcttcgaagtcatggtttcgatctgaggtgctgtcagtgctcacagcgcgacgctgttgagttgaaatttcgctggttttgagttgctttgtgactaattttttttctcggcaaccaaacaggaggattcaaaatttgcactgattaattagtaaagttttggcgctctcgagttcgttttggtgaggattctgattaaggaaaattttcttttattcattcggaggagaagcgtctcaaactctctctctttctccctcgtagcatcatcatcatcaccataccttgttcagattctgctcactttcaccacaacggctttactatttaccgcgtttcgttttcgtgtcaccgcaaataatgaaaggaggtgttccctgtatccactcctcgtcagggaagatctgaagcagtgctagctgctcacgtcctgtaatggacgcatactcctccggcgaagaagtggttgttaagactagaaaaccatatacaatcactaagcaaagggaacgatggacagaggaggagcataataggtttctagaagctttgaaactacacgggcgagcatggcagcgcatagaagagcatataggaacaaagactgccgtgcaaataaggagtcatgcacagaagttctttacaaagctggagaaagaggcccttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccaagcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcaagaaatgcagttctaattatgaagcgatgcagaaaaacctgctatttgtagaaaataacgagggactgttaaccatagggcttggacaaggaaagcttaagactcatcgaacaggttttaaaccctacaaaagatgttccatggaggccaaggaaaatagggttggagcaagcagcaatcaaggtgaagagcaaggttgtaagagaatacgtttggaaggggagacttcgacttgaggtttgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaagtaatttatgatccttcattcagccactttccacgttttacatatgaactattttttctttt

SEQ ID NO: 1035 - DNA, 614 bp, Glycine max
gcaaaacctctcttcttctgattgattcacttctcgatttttctgttttcgttttcattttcggtttccgatctaatatcgatgcgattcgccattgccggaaaatgagtcctccggcgagtgtccggtgatgatcgctctcgagagaggctgttgttgttgttcttcttcgacgtcatggttttgttctgagattctgctcactttcaccaaaacggctttactatttaccgcgtttcgctttcgtgtcaccaaaaataatgaaaggaggtgttccctgtatccactccttgtcagggaagatctgaagcagcgctagctgctcacgtcctgtaatggacgcatactcctccggcgaagaagtggttgttaagacgagaaaaccatatacaatcactaagcaaagggaacgatggacagaggaggagcataataggtttcttgaagctttgaaactacacgggcgagcatggcagcgcatagaagagcatataggaacaaagactgccgtgcatatcaggagtcacgcacaaaagttctttacaaagctggagaaagaggccctttgtaagggtgttccaattggaaaggctcttgatttagacattccccct

SEQ ID NO: 1036 - DNA, 3130 bp, Glycine max
gctcgaggcttctgctggctttgttgtagttgaagtcgctcccctcattcttctttcgttgctacttctactgtttcttcctccgatccctcattgccgcaaatgactcctcctgctagtgttaggtgaattccctcgcttcacatgcatgatcgcaccttcaactctcttcttcttcttcttctccatggctttttttcaaggttttggcgccgtggagttcgttttgtagcatcaccgtatcatcagcttcagcttgctttcaccaaaacggctttactatttggtgtgttccatgtcacaaaaaacgaaaggagatattccttttacccactcctcgtcagggaagatctgaagcagcgctagcagcacacgtcctctaatggacgccgactcctctggagaagaagtggttattaaaacaagaaaaccatatactatcacaaagcaaagagaacgatggacagaggaggaacataacagatttctagaagccttgaagctatacgggcgagcatggcagcgcatagaagagcatataggaacaaagactgctgtacaaatcaggagtcatgctcagaaattctttacaaagttggagaaagaggcctttgtaaaaggtgttccaataggacaagctcttgatatagacatcccccctccacggccaaaaagaaaaccaagcaatccttatccccggaagaccaatgttggtgccccaacattacatagcgaagcaaggcatggaaagcctctcatttcaattgtatcttcacttggtaaacaagcactgggcttggagaaagaaccccttccagagaagcatgatgtcgacctaaggccatcgactgtaaaagaaaataaggaccgaagctgctcaaacgtatttaccattatccaagaggcaccctgttcatctgtatcttccgccaacaagaattcaacatcaatattagtgccgctgagaaattcatgtgccctaagggagtttataccttcggtgaaagaggtgataactcgagatgaaaccaacgaatcttttgttactgatgagcttgaaaatcagaagttggagatagatgatggcaagcacactcaaaagtctaatggcacttgtaaagtctctaagtcggagaattctggtgcttcagaattggttcaaactgagaaaacagatggtcgtaattgtgcattaacaattgatggggtgccaggcaatcagaattacccaagacatgtccctgtgcacgttgttgatgggaaccttggaactagtactcaaaatctatccccagatatggtgtttcaagactccatatttcagccgaaaggaggggttaatgggcaacctaaccttgtcaccatttctgctacatcacacataagtgaaagtcaaaacaacaccgcacggtcctctattcatcaatcatttcctccttgtcctcctttcgcacaggatgattatcattcatttcttcacatgtcctccacattttcaagtcttattgtctctaccttgctgcaaaaccctgcagcccatgctgcagcgagttttgctgctacattttggccatatgcaaatgcagaaacttctgcagattctcccgtgtgcactccagattttccatcaagacaaattggctcgcctccaagtgtgacagctattgcagctgctacagtagctgctgcaactgcatggtgggctgcccatggactgcttcctttatgtggtccactccatacagcttttgcctgtcctcctgcatcagcaactacagttccatcaatgattattgatgaatcaccacaaaaaacagaacgaggagagattaaaccacaaaatcctcctctgcaagatcagataccggatccagaacactcggaagctcaacattcagctcctaagtcaccagctgtttcttcatccaaatctgaggataggggagatgccaatttagatacttcaccaaaggctactaatcatgagatgaaccaagcaatttctgagaaccccgattccaacaaaatgaagggcagaaaacctgtagaccgttcctcatgtggttccaacacaacctctagcagtgaagagactgagttactagagaaggatgagaaagaaaaggaagagcccaaaacacctgatgcgaacgttttagataccgagcttagtaatcgtcgaagtagaagcattagcaaccttactgattcttggaaggaggtctctgaagaggggcgtgcttgcctttcaggctctattctccagagaggtgttgccacaaagcttttcacctactcatcatttgataaatgaggataatcagatagacagcatcaaggataacgagctaaacacagactacaaagatgaagaccttgaaagcaagaaatgcagttctatttgtgatggggtgcagaaaaatctgctatttgtcaaagataacaatgaggaggagggactgctaaccataggtcttggaccaggaaagctaaagactcgtcgaacagggtttaaaccttacaaaagatgttcggtagaggccaatgaaaacaggatcggaacagcctgcatccaaggtgaagaaaaaggtcctaagagaatacgcttgaatggggaggcttcaacttgatgcttgatatatccatgcaaccacacaaagaaaatctctagttttgcatatattatttcttagtttccttgttcattgtctgtattgcttattttctaattctgcagctcacgaaacttgtcgtgtaggtgtgtgtaccatattaaattactacattacactctttttactttcttggcctgatgttactgcagttaaaaactccgctaaaatagacttagacaagaaacattaagtaccgtttgagcatttgatcatttaagtaatttatgatgcttcattcagtcaaaaaaaaaaaggaaaaaagggactaattctctctgctggtgccacattctgcactacgtggtatgcagatcaccctcacgactattactgttaacactattgtgctgaacgtggacacgctcgacactatggacgatatgatggagaaaatgcaagacatcgaaggagtccaaccgaagctgcttatgcttgtcttacctgtcgaagatcta

SEQ ID NO: 1037 - DNA, 3062 bp, Glycine max
gtttcgtttcagcaaaacctctcttcttcttctgattgattccacctcgcgatttttcgattttcgtttgttttcttctttttcggtttctgatctgaactcgattcgattcgctattgccggaaaatgagtcctccggcaagtgtccggtgatgatcgctccctcgagaggttgttgaggttatcgttgttgttcttcgaagtcatggtttcgatctgaggttttggcgctctcgagttcgttttgtactgttttacgtgtgacatgtgaattggaatgcttattccagcttatacaaaacagagacggatctctttcctattgtttctcgctttgtttcttttgtttgcaagtagcatcatcatcatcaccataccttgttcagattctgctcactttcaccacaacggctttactatttaccgcgtttcgttttcgtgtcaccgcaaataatgaaaggaggtgttccctgtatccactcctcgtcagggaagatctgaagcagtgctagctgctcacgtcctgtaatggacgcatactcctccggcgaagaagtggttgctaagactagaaaaccatatacaatcactaagcaaagggaacgatggacagaggaggagcataataggtttctagaagctttgaaactacacgggcgaccatggcagcgcatagaagagcatataggaacaaagactgccgtgcaaataaggagtcatgcacagaagttctttacaaagctggagaaagaggcccttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccatgcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcaagaaatgcagttctaattatgaagcgatgcagaaaaacctgctatttgtagaaaataacgagggactgttaaccatagggcttggacaaggaaagcttaagactcatcgaacaggttttaaaccctacaaaagatgttccatggaggccaaggaaaatagggttggagcaagcagcaatcaaggtgaagagcaaggttgtaagagaatacgtttggaaggggagacttcgacttgaggtttgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaagtaatttatgatccttcattcaaaaaaa

SEQ ID NO: 1038 - DNA, 1430 bp, Oryza sativa
cgtcgaattttggatccacaggaagtgttggatggatgcattgattcatagttccgctggctcctcccatttgatcacttgtttgatcaggatggcttccttcagttccagtggcttgaaagccagtaaccccatttctgtccatttggtagtgtgaagcttttgcagcagaccaatccacatatgttgtctccacagagtttgattttggcttaaattgttggcttgaggtatccaaacagttttcatgagaatgatcaggcttcgagctgatgtgtatcccattgagcctttccatttcttgatcattgatatcttttgcatccttccctgcaccattggaaatagaatccctttccaagatgaccacatctttgacttctgttttagtcggttccagccccctggatgcaccatgatttgaagagcttttgttaactgaagaaaatgatgccgatgggacttctcgaaagagattaagaacttcggagcaacttcctttttcagatatctcctttctttgaagtttctcaagagctgcatcacctgccatttgtgcagtgctattgttcgtcatatttgatattgttgccttatcattttgaacttccctggtggatgtctcagagctgagacaactttttcgaggatatggactgttaggttttctttttggtcgtggtggaggtatgtcgatgtcatgagcttgtcctggagaagtgccattgttgatagcttccttttccaacttggtgaagaacttttgagcatgacttctgatctgcacagctgtctttgtcccaacatgctcttctatgcgctgccaggctctcccatacagtttcaaggcttcaaggaacctgttgtgctctgcctcagtccaacgctccctctgctttgtgattgtgtatggcttcctcacctttaccaccgcttcctcaccagaggaattaatctccattcccaattcaagaaaaagaagaaatataacagaagtgttggcaattggtcgctttgtcagttagagttgaggtcttccacaaacaaaagcactcctccttccatatctccaaccaaacgctggacctgacacaagtagtacctcatacctcctcctagacctctatatcacgccaacactcccagtatttcaaatttgtgcggccaaccacaaaagagcagccaaattagtgttacaaacccaaggtagaacctaaagaattcacaattctacttgtgaattggacttgggtcaaaatcttcaagaggatcaattccactcacctacttgaattgatccaattgcagtcaatctactaaatcctcagctgcagttggtctgtgcacacaaaaaccaagtcagcagagttcacccttgctcctttcgttatcttcaactctagaatcagattaaaactcgcagttctcac

SEQ ID NO: 1039 - DNA, 1078 bp, Oryza sativa
ggcttgaggtatccaaacagttttcatgagaatgatcaggcttcgagctgatgtgtatcccattgagcctttccatttcttgatcattgatatcttttgcatccttccctgcaccattggaaatagaatccctttccaagatgaccacatctttgacttctgttttagtcggttccagcccgctggatgcaccatgatttgaagagcttttgttaactgaagaaaatgatgccgatgggacttctcgaaagagattaagaacttcggagcaacttcctttttcagatatctcctttctttgaagtttctgaatgtaagtgagtttctcaagagctgcatcacctgccatttgtgcagtgctattgttcgtcatatttgatattgttgccttatcattttgaacttccctggtggatgtctcagagctgagacaactttttcgaggatatggactgttaggttttctttttggtcgtggtggaggtatgtcgatgtcatgagcttgtcctggagaagtgccattgttgatagcttccttttccaacttggtgaagaacttttgagcatgacttctgatctgcacagctgtctttgtcccaacatgctcttctatgcgctgcccggctctcccatacagtttcaaggcttcaaggaacctgttgtgctctgcctcagtccaacgctccctctgctttgtgattgtgtatggcttcctcacctttaccaccgcttcctcaccagaggaattaatctccattcccaattcaagaaaaagaagaaatataacagaagtgttggcaattggtcgctttgtcagttagagttgaggtcttccacaaacaaaagcactcctccttccatatctccaaccaaacgctggacctgacacaagtagtacctcatacctcctcctagacctctacttgaattgatccaattgcagtcaatctgaacagtggggccacatcattttaaattcataagcatctccaaatggtcaaactactaaatcctcagctgcagttggtctgtgcacacaaaaaccaagtcagcagagttcacccttgctcctttcgtc

SEQ ID NO: 1040 - DNA, 618 bp, Zea mays
gttgcataatttgaaaacttgcgagttttaatatgattctagagttgaagataaggagtggagctaggtttaaactctggtgacttggttgttgtgtgcaacgaatcaactatgctgagtttttctgtagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagttgctccatagagcatgttgggacaaagacagccgtgcagatcagaagtcacgctcaaaagttcttcactaagttggaaaaggaagctatgaacaatggtacttctccggggcaagcgcatgacattgacatacctccacc

SEQ ID NO: 1041 - DNA, 2815 bp, Zea mays
tctttgggtctgggggcacaaatttgaagtgtgggggagtgctggtgtgatatagaggtctaggaggagatatgaggtactacttgcgtcaggtccagcgtttggttggagatatggaaggaggagctctcttgtttatagacgacctcaactccaagtgacaaagcgaacagctgttgaacgtttgccttctatttctgtttctttttgccggatttggagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacgggacagctagcattccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccaccttctccagcatgcttgtttccacgttgttgtcaaaccctgccatccatgcagctgccaggctcgcagcatcatactggccagcagctgaaggtaacactcctattgatccgaatcaagaaaaccctgcagatggcgtccaaggaaggaacataggctctcctccaagcatggcttctattgtagcagctacagttgctgcagcatctgcatggtgggcaacacaaggtcttctccctttcttcgctccacccgtggcttttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgaggtgtctctccatacggagttaaagctatctcctgcccagaatgctgatgccacacctaccacaggagctggcacaaatgatgcattcaggaataagaaaaagcaggatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcaaagcttttctcccccacaagcagtagactcgaaggaggttgccaaggaggaggaagatgaagtgaccacagtggcagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttcattaaaactcaatctgttgtgtgctgtattttaatgcttgtcaagcagcccgctagactgctttaaaaccttatctcgtagactctgatttaagcatcatgcaactatcaaacttttttttttggtcaaaatgtattttccttatgttttatatttttggaaaggaaaataattgaaatattatttattttgaaggctcacgcaaaagtttatttgatcaaggtgtaggggaataggctgagcgagagggtgaacattatgactaatatagggcagaaaatatttgaccattgtcatgtttgctgttgctagaagattgtgtagagaaagtactcacataaatgtttcacttctatttt

SEQ ID NO: 1042 - DNA, 1038 bp, Zea mays
  misc_feature (13)..(13): n is a, c, g, or t
  misc_feature (33)..(33): n is a, c, g, or t
  misc_feature (1022)..(1022): n is a, c, g, or t
tcgccgactcggnagtcgcggcgaggagccganaaccttctcattcatcttcctcttccatccatcctgcctgcctgcttgcctccgtattccagctagatctccgggcagccgattggccgagaagtttgtggttgtggcggcggcggagagggaaacggggagcgggagggcggcgcggatgccactgctgcgccggcgccggcggggccggtgatgcccgccgtggcggtcgcttgaggccgccgtgcgtgggaggtggacgggggagcgaggcggtgcggaccgaggttgcgttgggttggattcgattgggctgcgtctgctgagagtaaggacaattggatcaatttaagtaggtctgggcacacaaatttgaactattaacgcattgggagtgcttgtccgtagtaattggatcaattcaagtagaggtctaggaggagctatgaggtactacttccgtcaggtccagcgtttggttggagatatggaaggaggagctctcttgtttatagacgacctcaactccaagtgacaaagcgaacagctgttgaacgtttcccgtctatttctgtttctttttgccggatttggagatggaggtgaattcctctggcgaggaaacggtggtaaaggtaaggaagccgtacacaataaccaagcagcgggagcggtggacagaggctgaacacaaacatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaagnaaggagttgtctgaaa

SEQ ID NO: 1043 - DNA, 821 bp, Glycine max
  misc_feature (804)..(804): n is a, c, g, or t
  misc_feature (806)..(812): n is a, c, g, or t
  misc_feature (815)..(818): n is a, c, g, or t
gaagctcggaatcggtcgaggcagtctctgcacccctccctccttgtttgtatcatatcaggcagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgtatcttttctgggcataattctgctaaatatataaaattgggttaaatatatttttggtgtctataaaatttcttttttttttttggtctctgtgaattattttgtatatttttagtctcttgtttatttttttgttatcaatatcagtttcttaaattttttatacttttttctgccatttttaatctctttgatagactgatatttatgacgaaaaaattaataaatgatttgaaatagtaaaaaaatgaaatttcattagagttaaaaatatatttaaccctataaattctgttctaaatcttacagaattatcgtcaattgtatttcttgtcgttgagatgagaattaatgtacactttcgttaatcggtcatgagtatctcatatagaagctatggaaaagtttgcatgttggtttgtataaaagaaaaaggtgtgactagtcggtcaattgangnnnnnnnagnnnnata

SEQ ID NO: 1044 - DNA, 917 bp, Glycine max
ggcatgcaagaaaagttccgcttgcaaattcaatgctataggccaaggccaagcaagttgtagccacatgacaattgttgaaccattagcaagaagctaaatgaaccagaaatacacatgcacatgcaggtggtctgcattaagtacatactgcccttgacgtacatcaacagatctgaatcatagattgccttaaaacacttgggaacattacaaagataaattaagtagcattatacataagggcttttagaatggcatgcccctttttggttaccctaaaatgcaaatataagtacccatatataataggatcaacttccatttcatatcccgcaaattaagtcactgtataatgagttgcaggcacccaaaattgtcttgcttcgtttaatttctgccacttcattggctagtcgaaaatcttgaagtccaatatttctctatttcttctgcagttcttccaggaattcttccagcaatcaaagaccacctttctccaaccagattatacaccatggcaataaggatttcctcagcttcagaaaattcaacatcagaaacttggcttgatttctctacaaaacacaaatcaattctgtatgtttatgtggataacaacgagtgagccaatcattgaaataaaactgcatagagatcgatcatcattgtgtactctcaagtttgtaggtgcatgttatattataatattatagacccatcaaaaactaatctcaagatatattcttatctagctatcagaattgattattgaagacaaatggattttaaaagggtaccaatagaatcagaagaaacattattatcaaaggagcgatctatgtcagccattgcaataacaagttctcaaaagagctttgaaagtttcagtcttgtatattgaagatgcctggtgc

SEQ ID NO: 1045 - DNA, 735 bp, Glycine max
aaagatgccttacgaatacacttaatgtatgtgtatacatgcaaagaaaaaatccgcttccaaatccaatgctttaggccaaggcaaagcttgttgtaaccattagcaagaaggctaaatgaaccagaaatacacatgcccatgcaggggatctgcattaattaagtacatactgttcttgccatgatcgaacagatctgaatcatagattgcctaaaacacttgggaacattacaaagataaaattaagtaacattaaacataagggcttttaaaatggcatgcccctttttgttggttaccgcaaaatgcaaatataagtccccatatgattaataggatcaatttccatttcatatccccacaaagtcactgtaatgacttgtaggcaccaaaaatttccttgcttcgttttctgccaccgatcattggctagtcgaaaatcttgaagtccaatatttctctatctcttctgcagttcttccaggaattcttccagcaatcaaagaccacctctccccaaccagattatacaccatggcaataaggatttcctcagcttcagaaaattcaacatctgaaacttggcttgatttctcagtagaaacagcagaaacattattatcaaaggagcgatctatgtcagccattgcaataacaagttctcaaaagagctttgaaagtttcagtgttgtatattgcccacgcgacacgcccacgcgtccgcgggcgcgt

SEQ ID NO: 1046 - DNA, 728 bp, Glycine max
tcgggattcttctctgtttcactccctccctgccacccaatcttcacgagcaaccatgttgtcctagcaatgaccttcttctattaataccacccaaataaccttgtccgggaaaccacttaattctccacgcctccttgcaatggctgactcggatctctcttcaagtcaaatttctacacattctactgattcaggaaatcgagggtcttccaaagttgaattttctgaagatgaggaaaccctcatcatcaggatgtataaactggtaggggagaggtggtctataattgctggaaggattcctggaagaacagcagaggaaatagagaagtattggacttcaagattctcgggctctagtgaatgaagctccggagtactacgattggtgttcagtctaggacgagcaagaagattttgggtgcaagattagtgtgattttgtgggacataaaaactgaattaaagttggcatagtttataggtatttgtattggctataaaaaaagaagtggggcagcaactatagaagctggtttgtgttatatttctccatcttgaaatgttccttggtgtgatattttccatcttgaaatgttccttggtgattggtcttttctgaattgtacttagtgctgttcatcttcgtgtatcttattcatttaccattttggctttttatcttgcgtctgaaatctgtattggaaatgagaattaattagagac

SEQ ID NO: 1047 - DNA, 680 bp, Glycine max
ttcgggatcgcgcccttaatttttccacgccttcaatacaccacactcttctagctccttgcaatggctgactcggatcgctcttctagtgaagtttctacacattctactgattcagggaagcgagggtcttccaaagttgaattttctgaagatgaggaaactcttatcatcaggatgtataaactggtaggggagaggtggtctttaattgctggaaggattcctggaagaacagcagaggaaatagagaagtattggacttcaagattctcaggttctagtgaatgaggtgccaagagttctactaccattggtggtcagtctaggatgagcaagaagattttgggtgcaagattagtgggattttgtggggcataaaaactggattaaaggtggccctattttatagggatttggatttggattggctataaaaaaaaaaagtggggcagcaactatagaagctgggttggggaatattttccatcctgaaatggtgcccggtgggatattttccatcttggaatggtacttggtgggtgggcttatctgaattggacttattgatggccaccttcgtgtatttttcttattcatttaccattttgggtttttatcttgtgtctgcaatctgtattggaagagtccaactatggaaatgagaattaattagagat

SEQ ID NO: 1048 - DNA, 652 bp, Oryza sativa
gagaaaagttcaaagcattttttcgtctattcacataaaggtttaagacggggtgtatggtgacccaactctgatgtacctttctttacgtttcgatgaagctcaagattcgatgaaccatggtctttcacatttggtgaaattgggcataggtttggactatctctttcgatgttctttaggaatatctcacgtgtgttctttttattttgggagcaatgtcagttagaccacaactattgcaaagtattacaaggtcacccgtggacattatttgtttagcatcaaaactgtcacttcataactgattacatccttctgggaaatgtttccaaacaccaaatttccccttcagtgtactgctcttttgctgttcttccagggattcttccagctataagttcccacctgttcccaacaagcctgtgcattctgaaaacgagatcttcctcttcttccgtgaaatgaacaaaattctgtgcagtgttattaacttcttttgtttcacaaccatcactggttttggaattctttccctggctaccactgctgctatccattaggcgtgaaaaactccaatgaaatgccgagttgagatcttgtgctagctaagatcctcagacccttgttatgaccttatgttttctagggc

SEQ ID NO: 1049 - protein, 107 aa, Oryza sativa
MESSGGSQLGKNSKTSDGRETKATSSLLLLITAIHFVALCPKGENEDARKEVNSTAQNFVHFTEEEEDIVFRMHRLVGNRWELIAGRIPGRTAEEVEKFWAIKHQAT

SEQ ID NO: 1050 - protein, 78 aa, Oryza sativa
MDSSSGSQGKNSKTSDGCETKEVNNTAQNFVHFTEEEEDLVFRMHRLVGNRWELIAGRIPGRTAKEVEMFWAVKHQNT

SEQ ID NO: 1051 - DNA, 895 bp, Zea mays
  misc_feature (819)..(819): n is a, c, g, or t
attgggaccattgggtacctcgaggccggccgggaccttgtccagggactcaataggccagtaggcgattacaagggtggaagaaacatctagccttaacattccaggctacagcctaacccctctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatttatatagatgatatatgcaagcatgtgctgataaataatgttaaactgggcctacgatgttaccggtttttcagcctgtgcacatcttgttatgacatgatgctaattttgcaaaagcacagtaagaaaatttacagaacgtcagaaaatatcaatcatgttttagaagatgtgtaacagtatagtatgccttaagaaaagatgaattttgcctcttgcaaaaaaaaaaaaaaaaaagcggccaacttcagtaacgcagcttctcatggaggatgtgagctgttaccagcggtctttagatttctccccggcctgtatggaaaagaaagattcagcatcagaaacaaattcttaactagtcaactaccagcgaaagttgtccacaagtaatttgaggagcatggcgctcacaatggctagcgccctggacatccaggncattaacctatactggtcaggttcgttctttctgaggctttgaccacccggatcgtatatgacatgtgttttgcat

SEQ ID NO: 1052 - DNA, 1372 bp, Zea mays
ccggccgggatcttgtccagggactcaatagatcagtaggcgattacaagggtggaagaaacatctagccttaacgttccaggctactgcctaacccctctaatggatagcagcagtggtagccaggacaagaaattcagagacaatgatcgccctgaagcaaaaggttcaccattttcttgctttgctttgttttgctttacctttgctcgctgcctcttctgaagtctgaacttgtagctttttagttagtaccattgtgttcaagataatagctcatatgactttgttatttcaagagatctcacaccaacatatattctaatcctccgtgctttattttctctccgtcccaaaaagaatacaattctagcacagtgttatgtcatagtatcgtaaatttgatcaattatagataaaaaaagtaccaatatctatgataacaaataaatacgattagattattataagatgtgttttcataataaatttatttggagccataaatctaaatactattcactaaaaacgtgatcaaacatgaaccaatttagccggcatgtaacccatagttgcattctttttgggacagagtgaatacatgaaaactaaaacagatggtaaacagtgaccatttaggatacactataactgacaaaaactgtggggacaaacaggacgccatgtgatttaccatctgaccagcctaatgaagtgcagaggatttagccccttcgaaatagggggaaattattcctaggaaaattgcaaattctcttggcgaacataggattggcaaaccataatatatttctatatgggttggttaatggttttttttttcttactctcgtgatcaactatatcctttcacaattattgcagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatttatatagatgatatatgcaagcatgtgctgataaataatgttaaactgggcctacgatgttaccggtttttcagcctgtgcacatcttgttatgacatgatgctaattttgcaaaagcacagtaagaaaatttacagaacgtcagaaaatatcaatcatgttttagaagatgtgtaacagtatagtatgccttaagaaaagatgaattttgcctcttgcaacttcacttgtgtaccggcagaaaacttcagtaacgcagcttctcatggaggatgtgagctgttaccagcggtcttt

SEQ ID NO: 1053 - DNA, 1422 bp, Glycine max
tacggctgcgagaagacgacagaagggggaagttgaaggggaaagagagaaaagaactagctagctggagtctgagaactctagcatgtactagtactactcctacattcctccatcttcctttgtactattttttttttaaccataaaagcaagagcacaaagatggtgagagctccttgttgtgaaaagatgggtttgaagaagggtccttgggctcccgaggaagatcaaatcctcacatcttacattgacaaacatggtcatggcaattggcgtgccctcccaaagcaagcaggcttgttaaggtgtgggaaaagctgtagactccgctggattaactatttgaggcctgatattaaaagagggaatttcacaattgaagaagaagaaactatcattaagctgcatgacatgctggggaacaggtggtcagcaattgcagccaaattgccaggaagaactgacaatgagattaaaaatgtttggcacaccaatttgaagaagaggctgctgaaatcagaccagtccaagccaagttccaaaagagccactaagccaaaaatcgaacgttctgattccaattccagcatcataactcaatcagaacctgacaattttaatttcagagaaatggacacaataacatcatcagcatgcactacttctagtagtgatttttcatcggtcacggttggtgacagcaaaaatatcaagagtgaagacacagagtctacggaaacaatgcctgtgattgatgagagcttttggtcagaagctgcaattgatgatgaaacccccaccatgtcatcatctcagtctttgacaatctcaaatgagatgcgacttcaatacccttttgctaactatgaggaaactttccagcagggtcatcatgcttatgattcaaactttgatgatggcatggatttctggtatgacatatttaccaggaccaatgattcaatagaattgctagagttctgaagttttcatgtgacacgttgaacgagggcattattgaatttggcagatagagtagtttaaatggcatggtataacttgaatttgaccgttacaacaaaagggtacgataatttctggtgtggggacagcattatcaccagctgcaagatctagaggcataatccattgacaaagaaactagccagggtaatgcgaaaggctaatgaatgatatgtaatgtacacatgtaatcaagtagtgaaacactgactttctttctttttagtggaaaacagcaatgctctaacatttttgtattttacaaattagagtttaattaggctagagttacttgattgtaatatcaataaatgatgtattatgtgaattattcaaaaaaatttatgcccttgttgagctctcttttctaaaaaagaaaaaaaaaaaaaaaaagaaa

SEQ ID NO: 1054 - DNA, 1102 bp, Glycine max
ctcgagccgcaagagagagctagcagtgcaagctttcaacatccaaaacaacagagagtttttggctttagaagctgaaggaatatagttatcacaatggggagagctccatgctgtgagaaaatggggttgaagagagggccatggactccagaagaagatcaaattctcatcaattacatcaacacttatggccatgctaattggcgtgcactgcccaaactagctgggctattaaggtgtggaaagagttgtagactccggtggataaattatctgagaccggacatcaaacggggcaactttaccagagaagaagaggacactataatcagtttgcatgaaatgttgggaaacagatggtcggctattgcggcaaggttgtcagggagaacagacaacgagataaaaaacgtgtggcacacccacttgaagaagaggctgccacaaaattaccaacaaagccatcacactaaaaaacgaagcaaaaaacaaccaccaaagttggatgcggacgcctccaaatccaaccaagacgccaaactagaacaacaagaccccgttaatattcatggatcgaactctgaggacatgatgatgccactatctcctcctcattgttctagcgacatgtcctccttcctcaccaccagtgacaacaataggaacgttaatattattaataataatcatgatatgtccttaaatgttaatgattatgatattgacaccccagagaataatcttgcattggacgaggatttctggtcggaagttttgtcatctgataattccggcgtgacaagcggatttccgacccttgactatgatcagtttcaaccaatgtctcctctagtgacagaagaaggggtccttatagattgttcgtcgagtacgtgcgacgatggcatggatttttggtgcaatgtttactcgagagctgaggaatttacccagttactggaattgtgatgttagctattgttgttgttcttaaatagagaccaagtccttcattcaacatgtcgttgttcttctgctgtttggacttgaattaattcccttgttagaaattaataaatcgtgtacattgatgattgcc

SEQ ID NO: 1055 - DNA, 492 bp, Glycine max
cggctgcgagaagacgacagaagggggaagttgaagcggggaagataaaaagaactagctagcttgctagagtgtgagaactctagcatatactaggggtactacattccttcatcttcctttttatttttcaccataaaaaaacaagagcacaaagatggtgagagctccttgttgtgaaaagatgggtttgaagaagggtccttgggctaccgaggaagatcaaattctcacatcttacatccaaaaacatggccatggcaattggcgtgccctcccaaagcaagcaggccttctaaggtgtgggaaaagctgcagactccgctggattaactatttgaggcctgatatcaagagagggaatttcacaattgaagaagaagaaactatcattaagctgcatgaggatgtgtggaacaggtggtcagcaattgcagccaaattgtcaggaagaactgacaatgagataaaaaatgtttggcacaccaattt

SEQ ID NO: 1056 - DNA, 643 bp, Oryza sativa
ggaattcggcacgaggagcatcagcaacacacacacacaccgagcagtcaatccatcacacacaaacacaaacaaacgcacagggcgcgagagctcgaacgagaggaggaaaggtcggcaatggggagggcgccgtgctgcgagaagatggggctgaagagggggccgtggacggcggaggaggacaggatcctggtggcgcacatcgagcggcacgggcacagcaactggcgcgcgctgccgaggcaggccggccttctccgctgcggcaagagctgccgcctccggtggatcaactacctccgccccgacatcaagcgcggcaacttcacccgcgaggaggaggacgccatcatccacctccacgaccttctcggcaaccgatggtccgcgattgcagcgaggctgccggggaggacggacaacgagatcaagaatgtgtggcacactcacctcaagaagcggctggagccgaagccgtcgtccggccgggaagccgccgcgcccaagcgaaaggcgaccaagaaggctgcggcggtggcggtggcgatcgacgttccgaccaccgtgccggtgtcgccggagcagtcgctctcgaccacgacgacgtcggccgccaccaccgaggagtactcgtactcga

SEQ ID NO: 1057 - DNA, 1344 bp, Zea mays
ccacgcgtccgcccacgcgtccgcccacgcgtccgggacagtgctccctcccgtccccaaagacaaacaggcgagcagcaaacacacacgctcgaaccgagacaagccaatccaataatggggagggctccgtgctgcgagaagatggggctgaagaaggggccatggacgcccgaggaggacaaggtcctggtcgcccacatccagagcttcggccacagcaactggcgcgcgctgcccaagcaagccggcttgctgcggtgcggcaagagctgccggctccggtggatcaactacctgcgcccggacatcaagcgcggcaacttcagcaaggaggaggaggacgccatcatcagcctccacgagcagctcggcaacaggtggtccgccatcgccgccaggctgcccgggcggacggacaacgagatcaagaacgtctggcacacgcacctcaagaagcgcctggatcccaccaagcaggaacagcagcagcagcacgggacgacgccggtggctggcgccggcaagaagcacaggcccgcggcggcggcgaagcgcgggggcggcggagccaggaaggcgacggccgacgccgtcgtcgtcccggccaccgctgcgccggcgtcgcccgaacggtccgcggcctcgtcgtcggtgaccgagtcgtccatgacggagcaggagcaggagcacggcaacacggggagctcgcccgcgttccccaaggaggagagcttcaccacctcctcctcggacgccgaggagttccagttcgacgacagcttctggtccgagacgctgtcgatgccgctggacagcctcgacgacgtcgtccccatggagccctccgacgacgcgttcggcgacgtcgacgtcgacgtggccgccgcctcctcctcgtccgtcggcgccgacggcgacctggactactggctcagagtgttcatggagtccggcgacgcgcacccagaactgccgcagatttagaccgctcgcgcgagaattttcggctcctaattgattcatcgttcttttctctctctctctctctctctgcacgtcttgcatcagaggggacggacaaggacagcatcagctgattaacagagaaggaaatcaggcaggaacaacgcgacacgccgttgcaacttggatcgatcttgtttgccttcttgttgtatagatactagaatccatccaagtctatgcgttctgagaacagaagcacgctgtgctgtgcatgcagattcccatgtatgtacagtagccacggccgccgccagaacagaaatggatccggcctcttccaaattccaaaaaaaaaaaaaaaaaaaaaaaaaaaag

SEQ ID NO: 1058 - DNA, 662 bp, Zea mays
attactccgcggcatcaggcaggcaggctagccgtgctccctcccatctcttctcttctctcctctcccccgaagagtcaaagacacagggagagagaggactcctccgcatctgcatccgcgcacacgaattcgagagggagaggagcgataatggggagggctccgtgctgcgagaagatgggcctcaagaggggcccctggacgccggaggaggacaagatcctggtcgcccacatccacagccacggccacagcaactggcgcgcgctgcctaagcaagccggcctgctgcggtgcggcaagagctgccggctccggtggatcaactacctgcggccggacatcaagcgcggcaacttcaccgacgaggaggagcagtcaatcatccagctgcaccagctgctcggcaacagatggtccgcgattgccgcccggctgccggggaggacggacaacgagatcaagaacgtgtggcacacccacctcaagaagcggctcgaccccagcgcgcaggagcagcaccaggaggccaagaagcgcgagaagccggcggcggcggcgcggaagcgcgagggcaaggtcaagatgaggaagctcgacgcgctgaccgccaaggcggcgcccgtgctgtcctcgcccgagcgctccgtctcgtcacg

SEQ ID NO: 1059 - DNA, 1084 bp, Zea mays
gtgtccacacagcaaaccacccgcgctccgccaatccagagagccagccagcccgagctcacacagcagcgagctcggtcttctcgccaggacacgaacacgaccccagcaggcggcaggcaagccacgctctctcgacggacggacgttaatcgagacatggggcgctctccgtgctgcgagaagatggggctgaagaggggtccgtggacggccgaggaggacaggattctggtggcgcacgtcgagcgccacggccacagcaactggcgcgcgctgcccaagcaggcgggcctgctccgctgcggcaagagctgccgcctccgctggatcaactacctgcgccccgacatcaagcgcggcaacttcagccgggaggaggaggacgccatcatacagctccaccaaatgctcggcaacagatggtcgacaatcgctgccaggctgccggggaggacggacaacgagatcaagaacgtctggcacacccacctcaagaagcgcctggagccacagccagccagccagcaggcgcccaagcgcaagcccacgaagaagcagcagccgcagccggagcccgagcccgtaacgacgctcgaggggccggccggggccgtgccgccggtgtcgccggagcggtcactctccacgacgacgtcgaccaccaccagcaccgcggactactcggccgcctcgtcgctggagaacgcgggcgacagcttcacgtcggaggaggactactaccagatcgacgacagcttctggtccgagacgctggcgatgacgacgacggtggacagcttccagtccggggtgcagcaggcggagggcagcttccgcgcgtcggcggcggcgccgtcgtcgaccaacgacgacatggacttctggctcaagctgttcatgcaggccagcgacatgcagaatttgccccagattatttaggcgggaaacggacctagacggtttgttatctctcggctgatgatgatattctttggcgcgcgctcacgattctttgaatctttgttctgctccgttttcggtggatgtatatatcccactgaaaccttgtgaagcggaaagc

SEQ ID NO: 1060 - DNA, 1492 bp, Zea mays
gggacctcgagccgcccccctttgcttcgcacagcacgaccaggacacagtgctccctccccaaagacaaacaggcgagcagcaaacacacacgctcgaaccgagacaagccaatctaataatggggagggctccgtgctgcgagaagatggggctgaagaaggggccatggacgcccgaggaggacaaggtcctggtcgcccacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaggaggacgccatcatcagcctccacgagcagctcggcaacaggtggtccgccatcgccgccaggctgcccgggcggacggacaacgagatcaagaacgtctggcacacgcacctcaagaagcgcctggatcccaccaagcaggagcagcagcagcagcacgggacgacgccggcggctggcgccggcaagaagcacaggcccgcagcggcggcgaagcgcgggggcggcggagccaggaaggcgacggccaacgccgacgccgtcgtcgtcccggccccggccccggccaccgctgcgccggcgtctcccgaacggtcggcggcctcgtcgtcggtgaccgagtcgtccatgacggagcaggagcaggagcacggcaacacggggagctcgcccgcgttccccaaggaggagagcctcaccacctcctcctcggacgccgaggagttccagttcgacgacagcttctggtccgagacgctgtcgatgccgctggacagcctcgacgacgtcgtccccatggagccctccgacgacgacgcgttcggcgacgtcgacgtggctgccgcctcctcctcgtccgtcggcgccgacggcgacctggactactggctcagagtgttcatggagtccggcgacgcgcacccagaactgccgcagatttagaccgctcgcgcgagaattttcggctcctaattgattcatcgttcttttgtctctatctctctctgcacgtcttgcatcggaggggacggacaaggacagcagcagctgattaacagagaaggaaatcaggcagaaacaacgcgacacgccgttgcaacttggatcgatcttgtttgccttcttgttgtatagatactagaatccatccaagcctatgcgttctgagaacagaagcacgctgtgctgtgcatgcagattcccatgtatgtacagtagccacggccgccgccagaacagaaatggatccggcctcttccaaattccaattcgttgagttaattcaaacaaaaaaaaaaaaaaaaaaccccaaaaaaaaaaaaaaaaccaaaaaaaaaaaaaaaaaaaaaaaaaaaaaaaaaaaaaaaaaaaaaaaaaaaaaaaaaggggggggcccccgcttaggggcctcgcccccccggttttttt

SEQ ID NO: 1061 - DNA, 1352 bp, Zea mays
cattgggtaccccgcgccccccggacagtgcagtgctccccgaggtccccaaaagacaagcaggcaagcagcaaagacacgcctccctgcttgcactccccacacgcccagtcgcccacacctccaacagacaaagacaatctagcaagcacacacagcatcaggaggaggagatcgagtaggagcagaagcaaagaatggggagagctccgtgctgcgagaagatggggctcaagagggggccatggacgccggaggaggacaagatcctggtcgcgcacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaggaggacgccatcatcaccctccacgagcagctcggcaacaggtggtccgccatcgccgccaggctgcccgggcggacggacaacgagatcaagaacgtctggcacacgcacctcaagaagcggctggagcccaccaccaagcagctggagcaggagcagcacggggcgcatgcaggtggtgacgccgccaggaagcgcagcaggcccaagcgcgcgggtgccaggacgaagacgacgacggccgccgtcgccccggccaccaccgcgccggcgtcgcctgaacggtcggcggcctcgtcgtcggtgaccgagtcgacggagcaggagcagggaaacacggggacgagctcgcccgggttccccaaggaggagagcttcacctcgtcctcggaggccgccgaggagttccagttcgacgacacgttctggtcggagacgctgtccatgccgctggacagcttcgacgacgtccccacggagccctgcagctccggcgcgttcggcgacgtggccgcctcctcctcctcctcgtccgttggcgccgacgccgacttggactactggctcggagtgttcatgaagtccggcgacgcgcaccaacaactgccgcaggtttagagcgcgcacgcgcgcccgagaattttcagttccctggctaattgattcatcgttctttctctctccctgcacgtcttgcaatcggaattcggaggggacagtcacaatagcagctaattaatagaggggtgtgtgtgttgaggaccacgacgagattaggaagaaacaacgcgacatgccattgcatctatctcttgtttgccttcttgtatataaagatcgatcgatcgacaagatatcggtgatcgaaacctatatatgctacccattttgagaggaattcttctgcacgcgcgcgcccgcctccgcggtgga

SEQ ID NO: 1062 - DNA, 694 bp, Glycine max
tttgagagggcgagcaaatcgaaagacaagagtcacagcgcacccccaaacagaaacagagttattgggagcacgaaacactaactgattcgattcgattgaggttacaaaacactaaactgattcgattcgattcgattgaggtttcggtttggtcttgatggtgtcggtgaacccaagccctgctcaaggcttctacttcttcgatccctccaacatggtccttcccggcgtcaacaatcttccaccgcccccgccgcctgctccgccttctcacgccgccgtggaggatccgagtaagaagatcaggaaaccctacacgattaccaagtccagggagagctggactgagcaggagcacgacaagtttctagaagctctccaattatttgatcgggactggaaaaagattgaagcatttgttggttcaaaaacagttatccagatacgaagtcatgcacagaagtattttcttaaagttcagaagaagggaacaagtgaacatgtacctcctccccggccaaagagaaaagctgctcgctcataccctcaaaaagctcctaaaactcctactgtatcccaagttatgggcccattgcaatcttcatcttctttcattgaacctgcatacatatatatcccggattcttcatctgcgcttggaactccattactaacatgccttacgtcatct

SEQ ID NO: 1063 - DNA, 555 bp, Glycine max
gaaataaaaagagaagaaagaaaacacgatagtatcatcatatcaccaccacacacatagatagagagaggaaaacgacctatattttttttcctttgagagcttcaggggctaggaaaattagaaggacagccacaagtataaaggcggtgaaataaaagagaaagacaagaaggagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggacgaattacctgaggccatgaatcaagcgtggtaacttcacagaacaagaggagaagatgataatccatcttcaagatcttttaggaaacagatgggctgcaatagcttcataccttccacaaagaacagacaatgacataaagaactattggaatacccatttgagaaagaagctgaagaagatgcaagcaggcggtgaaggt

SEQ ID NO: 1064 - DNA, 583 bp, Glycine max
ccaaaagagataaaagaagagagggagatagatattatagctagctagatagagattagaagctatataatatacataaaattgtattatagtgaactaaaagaaaagggtacaagggaagatgggaaggccaccatgttgtgataaagaaggtgtaaagaaaggaccttggactcctgaagaagacatcattttggtgtcttatattcaggaacatggtcctagcaattggaaagctgttcctgccaatactgggttgtcaaggtgcagtaagagttgtagacttagatggactaattacctgagaccaggaatcaaaaggggtaacttcacagaccaagaggagaagatgataatccatcttcaagcacttttagggaacagatgggctgcaatagctgcttacctaccacaaagaacagataatgacataaaaaactattggaacacctatttgaaaaagaagctgaacaaattggaagcaggttctgatcagggacataatattggggtatcagtttctcagccaatgtcaagaggccagtgggaaagaaagcttcgaacagatatgtcgatgggtaaa

SEQ ID NO: 1065 - DNA, 662 bp, Glycine max
ggcagaaccttgtctctgcatcatcataattctctcaattgaggagcccaaagggatcaaatctcttcaacccagaagaagaaaaacaaaagagaaattatagaattaagttgctatagctaatagctataactggcttagatataccatttttattttatttttattttggggtgtacaaaatgggaagaccaccttgctgtgataaaattgggattaagaaagggccttggactcctgaggaagacatcatcttggtctcttacattcaagaacatggacccggaaattggagatcggttcccagtaacacaggtttgatgagatgcagcaaaagctgcagactcagatggaccaactatctccgacctggtatcaaacgaggcaatttcaccgatcatgaagagaaaatgataatccacctccaagctcttttgggtaacagatgggctgctataacttcctaccttccacaaaggacagacaatgacataaagaactattggaacacccatttgaagaagaagctgaagaagatgcaaaattggaggtggtaatgagatgataataatgatggacagagaaactcttctaacaattcaccaaattagggttcaatgcgaagaagaacttatacagatttccacatggcaagacatgct

SEQ ID NO: 1066 - DNA, 1342 bp, Glycine max
ccccgcgcccccaccagtccgtaagaagaaaatcatgaaaagagagaaaagaagagagggagatagatatattatagctagctagatagagattagaagctatattattatatacataaagttatattatttatattgaactaaaagaaagggtacaagggaaagatgggaaggccaccatgttgtgataaaggtgtgaagaaaggaccttggactcctgaagaagacatcattttggtgtcttatattcaggaacatggtcctggcaattggaaagctgttcctgccaatactgggttgtcaaggtgcagtaagagttgtagacttagatggactaattacctgaggccaggaatcaaaaggggtaacttcacagaccaagaggagaagatgattatccatcttcaagcacttttagggaacagatgggctgcaatagctgcttacctaccacaaagaacagataatgacataaaaaactattggaacacatatttgaaaaagaagctgaacaaaaaattggaagcaggttctgatcaaggaagcttgttgggaggaggacataataatattgggttttcatcagtttctcaaccaatgtctagaggccagtgggaaagaaggcttcaaacagatattcacatggccaaaaaagcacttagtgaagcactctcaccaaacaaggcatcatcatcatcatcaaccttgttagctgaatcaaattcaaacctctccaatgaaaatagtaccttctataatagtaacactaataaaccaacaacaacacaatctatgtgctatgcttcaagtgctgataacatagctcgtttgttgaaagggtggatgaaaaacacaccaaaatcagcctcatgtgctgcctcggctgtgactcaaaattcctgttcttctagtgaaggaattacaacaacaaagggaagcacaacaagcactagtactgttgaattgtctgagacttttgagtccttgtttggttatgagtctttcgataattactcttcaaattctgagttctcaccatctctttctcctgaggctactcttttccaagatgagggcaagccagatataactacaggattaatagacatgcctttctctttgcttgagaaatggcttctagatgttgatgctggtagtcaagagaaacttggcttctagattattagttcaatttgatatgttttttcttagttacaggagagtaagttaaatctctctctcactttggccctcaacccttcttttggttctagaagtgtatattccaatccaatgttcacattattatatgataaatctataataccactatcctataatt

SEQ ID NO: 1067 - DNA, 1671 bp, Glycine max
catcgcaggatcaactttacatcttagttgcttgttttccagtgtggcatctaacacagtatgataacaataatcataatttcaatagttattaacatatacacgtctagcaccaaaggcttgaaaaacttctctctctaaggccaaagcgaagattaattgatgaggccctacctataacttatgaaataaaataaaaaattccacagtctcatatatgtcacaaaatgaacccaacttagaaaaacttggcatcatcaccacaaccaactaatttctcttggcaaccagcctcatcaagaagccatttctcaagcaaagagaatggcataatttctgcaccaataacatcaggcttgctttcatcttgcaaaacagtggcctcaggagacaatgaccgagagaattcatcagagtttgaagactccaaagactgatcaaaatcaaacaatgattcaaaattgttttcagacaattcagcactgcttggtggtccctttgctccaatactagaagcagtatcagcacctgctgcagcaaagttgttgaaggagttctgagtcacagatgatgagtttgttcttgaggactttggtgggtttttcatccaaccctttagcattctagctatgttgtcagcacttgaggcatagcacacagtttgtgttgttgttggttttgtggaagagaaggagctgctactatctgaagggtttgagtttgaggcagataaattacaagatggcttctctggtgaaagagcttcactgagggctctctttgccatttggatatcagtttggagccttctttcccactggcctctagggatttgccttgaggctgaaaacccttctccaaagctaccaccttcacaacctacttgcatcttcttcagcttctttctcaaatgggtgttccaatagttctttatgtcattgtctgttctctgtggaaggtatgaagctattgcagcccatctgtttcctaaaagatcttgaagatggattatcatcttctcctcttgttctgtgaagttgccccgtttgattcctggcctcaggtaattagtccatctaagtctgcaactcttgctgcatcttgacaaccctgttttggcaggaactgccctccaatttccaggaccatgttcctgaatataagacaccaatatgatgtcttcttcaggagtccaaggccctttcttgaccccttctttgtcacaacaaggtggtcttcccatgtcttcttcttgtctttctcttttatttcaccgcctttatacttgtgtgtccttctaattttccttagccccttcaggtctcaaggaaaaagaatattaagtcgttttcctctctctatctatgtgctgtcggctttctctttttatttctctaaccctctttacttgatagggttctaatcggacgctcggagcctaacctttgcttgatgcacatttatagctaaaaatgaaaggggtaaggatatgtatggtgtggggtgtgatgagaagctgacttaaactagtaaaccaggtagccaagtcaaaagttgacagcaagagcattaactgaaggagtaaggaccaaaattattcacctcatagatacctctctctcgaaaccgcgtgacattcaatgtagctgcactgggaaaagctcaattatc

SEQ ID NO: 1068 - DNA, 1537 bp, Glycine max
cctttttttttttttttttttttttttactttaaaaacaattaattcataaagcaagatctcgtcgcaagatcaactttacataagagaagcaagtttgccagtgtatggcaactaacacagtatgataataatcatcataatgtcaataataattaacatatacacgtctagcaccaaaggctggaaaacttctctctctaataaggccgaagcgagattaattgatgaggccctacctataacttatgaaataaaataaaataaaataaaaaaatcccacaggctcatatgtcacaaaatgaacccaacttagaaaaacttggcatcaccacaacaaccaactaatttctcttggcaacctgcctcatcaaggagccatttctcaagcaaagagaagggcataatttctgcagcaatattaatatcaggcttgctttcatcttgcaaaacagtggcctcaggagacaaggactgagagaattgatcagagtttgaagactccaaagactgatcaaaatcaaacaaggattcaaaattattctcagacaattcggcactgcttagtggtccctttgctccactactacaagcagtatcagcacctgctaagttgttgaatgagttctgagtcatagacgagttggttcttgaggactttggtgggttcttcatcccacccttgagcattctagctatgttgtcagcacttgatgcatagcacacagtttgtgttgttgttggttttgtggaagagatggagctgctcctatctgaagggtttgagtttgtgccagataaattacaagatggctttttctctggtgaaagagcttcactgagggctctctttgccatttggatatcagtttggagccttctttcccactggcctctagggatttgccttgaggctgaaaacccttctccaaagctaccaccttcacaacctacttgcatcttcttcagcttctttctcaaatgggtgttccaatagttctttatgtcattgtctgttctctgtggaaggtatgaagctattgcagcccatctttaacatagccaatgtgatccagttaagttaagcatgtggatccaaaagatagaacttcccaaatcaaaatactcaaaaacagttataaaaaataaatcttcaaaacaaagtttttttcttttttataagctaaaagatttcattagtaacttaattgcttgaattgaacacaaaactccaagtaagtaggtgcttggaagattgacttgtacctgtttcctaaaagatcttgaagatggattatcatcttctcctcttgttctgtgaagttaccacgcttgattcctggcctcaggtaattcgtccatctaagtctgcaactcttgctgcatcttgacaaccctgttttggcaggaactgccctccaatttccaggaccatgttcctgaatataagacaccaatatgatgtcttcttcaggagtccaaggccctttcttgaccccttctttgtcacaacaaggtggtcttccctcgagccgaat

SEQ ID NO: 1069 - DNA, 1659 bp, Glycine max
attcggctcgaggaaggatggtaaaactcattagtttccttccatcaaggtcatggagtatataaagcactcacatgcattggtactatttgcaatacaagctcatctcttgggaagaaattagtttaagccttagctagaaaaaggagagtgagttagtgagttgagaggcagaagaaaagaagaagaaaggtggagtgagtgagtgaatagaaaaaaaaaacccaccatggggaggcctccttgctgtgacaaagttggcatcaagaaaggtccatggacacctgaggaggatattatccttgtctcttacatccaagaacatggtccaggaaattggagatcagtgcctactaatactgggttatcaaggtgcagcaaaagttgcaggcttagatggacaaattacctaaggccaggaatcaagagagggaacttcaccccccatgaggaagggatgataattcatttgcaagctctactgggtaacaaatgggcagccatagcttcctatcttccacaaagaacagacaatgacataaagaattattggaacacacatctaaagaagaagctgaagaaatttcaagcagctttggatcctcactcagcatcagactcaacagccagtggtcaatttctaccaaagagctttagtgacagaagaagtactttagacatcagcagcaacaacaacaataatcatggctcgtccattaggcttagtcatcatcaatctcagtcctcttccacaacaacatatgcctcaagcactgagaatatctcaagactcttggaaggttggatgagatcttccccaaagcaactcaacaagggatcatcaatatcccaagatgatgaagatcttcagctccaaggcatcaatgatgatgatgataataacaacaacaactttgtaagcactactaagctagtgaaccttcatcatcttcatcagcacaaagttagaaacaaagatcagcagcaagagggtggtggtggtggcgtagataataacatggtttctcatcatgaagagttcgattctattttgtcctttgagaaccaaaacaatgctgcttgggacaagtccacttgtgattccatgccagaaaagagttctgaagcttctgctgctgctgatcatcatcatcatcatcatcatgatatagctgctgctcatgagaggaacaatgtcaggcaaaaatctgagaatagtagtggtgctcctccattgtcatttcttgagaagtggctcttggatgaaaacgttggtcatcaagtggaggagatgatggagttgtctccgatgttctaaattaacatggaattgggtcaccaatttaatccctttaagtttgggatgtgacattcaaatgatcatatgatattagtcagatgaaagaagagatcaaaggaatgaaattcttttgaaatctgactagggtttaatccattacaatggtggagagattcacagaagctataagggatctctttcaacttgtaacttggaagtctatgaagaatggtttaattatttcaagtaatactatatgcttagtgcatgttgctctctttgtcttgtagaaaaattacaaattaatgttaacttcagctcaaataataatactacaataacagttatattttcaaaaa

SEQ ID NO: 1070 - DNA, 553 bp, Oryza sativa
gcacgaggctctcactctccaccaccaaactctcctcctctcttgcaacatcaaactcatccatccatccatcgatctgagaaatccagctttccagttcttggatctccatcgaccatggtgaggccgccgtgctgcgacaaggacggcgtcaagaagggcccgtggacgccggaggaggacctcgtcctcgtctcctacgtccaggagcacggccccggcaactggcgcgccgtcccgaccagaacagggctgatgcggtgcagcaagagctgtaggctccggtggaccaactacctgaggcccgggatcaagcggggaaacttcaccgaccaggaggagaagctcatcgtccacctccaggcgctcctcggcaaccgctgggcggccatcgcgtcgtacctccccgagcgcacggacaacgacttcaagaactactggaacacccacctcaagcgcaagctgcagggcggcggcgccggcggtgacggagacggtggcgccgccggcgacgcggtctccccgaagcccgccgcgcagaggcccgcgtcgt

SEQ ID NO: 1071 - protein, 307 aa, Oryza sativa
MGRPPCCEKEGVKKGPWTPEEDMVLASYVQEHGPGNWRAVPPRTGLLRCSKSCRLRWTNYLRPGIRRGGFSHHEERLILHLQALLGNRWAAIASYLPHRTDNDVKNFWNTHLKKKLALTSSSSSPPTPTTPLVARGQWERKLQTDIDLARRALRDALSVDDAASPAMISSGPPAPAAAAAYALSERNISVMLSGWAAPPPARKGLSACNPAAATTTPGGAAAESASTAGTSLELTADCCSGGGDSSASNCLPSSMLLACDDGDATATAAGVAPLSAIESWLLLDDSGEPQLALDEQLLDVALRNYAF

SEQ ID NO: 1072 - protein, 341 aa, Oryza sativa
MVRPPCCDKDGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQGGGAGGDGDGGAAGDAVSPKPAAQRPASSSKGHWERRLQTDIDMAPRASREALTSLEDVKPPHQPDAANAAAGGGGATTGAAASAGADSPAASSTSGASQCSPSSAGYVLTTENISRMLDGWARKKGGGGGRRAAGSGPATPGATESASGSSEASEVSYGGTALSAAAAPASAFEYETKPTVTAAAAADAGDETQLSAIESWLFADADGIESGSLLDAAMDYTF

SEQ ID NO: 1073 - protein, 341 aa, Oryza sativa
MVRPPCCDKDGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQGGGAGGDGDGGAAGDAVSPKPAAQRPASSSKGQWERRLQTDIDMARRALREALTSLDDVKPPHQPDAANAAAGGGGATTGAAASAGADSPAASSTSGASQCSPSSAGYVLTTENISRMLDGWARKKGGGGGRRAAGSGPATPGATESASGSSEASEVSYGGTALSAAAAPASAFEYETKPTVTAAAAADAGDETQLSAIESWLFADADGIESGSLLDAAMDYTF

SEQ ID NO: 1074 - protein, 321 aa, Oryza sativa
MGRPPCCDKVGVKKGPWTPEEDLMLVSYIQEHGAGNWRAVPTNTGLMRCSKSCRLRWTNYLRPGIKRGNFTEQEEKLIVHLQALLGNRWAAIASYLPERTDNDIKNYWNTHLKKKLKKMQAAEGGEDSGAASEGGGGRGDGDGGGKSVKAAAPKGQWERRLQTDIHTARQALRDALSLDHPDPSPATAAAAATPAGSSAAYASSADNIARLLQGWMRPGGGGGGNGKGPEASGSTSTTATTQQQPQCSGEGAASASASASQSGAAAAATAQTPECSTETSKMATGGGAGGPAPAFSMLESWLLDDGGMGLMDVVPLGDPSF

SEQ ID NO: 1075 - protein, 385 aa, Oryza sativa
MAGGGGSLAVGGGLNGWRGVSGSVGAAGLEEGSGPAWWRGHLTANGSRMKKGGGSRRHAIPTGEAVGGGGAVVGIDGEAAVLREGGGEEGAVDAGGGPMLVAYVQEHGPGNWRAVPTNTGLMRCSKSCRLRWTNYLRPGIKRGNFTDQEEKLIVHLQALLGNRWAAIASYLPERTDNDIKNYWNTHLKKKLKKMSATGGGGDYGEGGGAGEVKTRAAAPKGQWERRLQTDIHTARQALRDALSLDPSPPAKPLDSSSGATAPPSSQAATSYASSAENIARLLEGWMRPGGGGGKTTTTPSSGSRSSAASVLYGEASHSGGATAPTPDGSTVTSKTKDEETAGAPSSSPPPAFSMLESWLLDDGMGHGEVGLMDVVVPLGDPSEFF

SEQ ID NO: 1076 - DNA, 829 bp, Zea mays
ggaccccttgtcctcaacctcaagccgccacgcaccaccaacacgcgcgcgctggcttcttcaacctcggttgctcgctcgcaacaagacacggatcgtcagagcaagagctctggtgacctgacgattctgctcttgttctcgtacggcgccggtgcctagcgtctgtagcctttttgtgtgtgtgtttttcgcccatatctctccccaccaccaccaccaacctagctcagccgcagttcacccgcgtcaccgcacgagtacacgagcaatccgcaagcgataacctgcaagctgaggggccagctgttttgctcacggagaaagaggttctagctagtcgttcatcaacacggacacaccatggtgaggccgccgtgctgcgacaaggagggcgtcaagaaggggccatggacgccggaggaggacctcgtcctcgtctcctacatccaggagcacggccccggcaactggcgcgccgtcccggccagaaccgggctgatgcggtgcagcaagagctgccgtctgcggtggaccaactacctccggccgggcatcaagcgcggcaacttcaccgagcaggaggagaagctcatcgtgcacctccaggccctcctcggcaacaggtgggcggccatcgcgtcgtacctgccggagcggacggacaacgacatcaagaactactggaacacgcacctcaagcgcaagctgcagagcggcggcgacggggcggccaagccgccggcgcacaggccgccgtcgtcgtccaagggccagtgggagaagaggctgcagacggacatcaacctggcgcgccgcgcgcttcgcg

SEQ ID NO: 1077 - DNA, 987 bp, Zea mays
gaatccccggggattatctagctcagctattcttcccggggatcaaactgtgttgccagcacgtgccagggtgtgtgtagccagccactactgtacaatagctctcttctttctctcgccgtagcttcgctcgtgctgtgcgtgtgtgtatatataagcatcctgcccccactccttttatctctctactcgtctccacgggatcgatcgatcggggcgtggatctctgagcctgagcaagcgggcgagctcaccaaccgccacgctcaagacaggtcgagtagctagctagctgccggagtggaaaaggaggcggtgcagtggcatggggaggccgccgtgctgcgacaagatgggggtgaagaaaggcccgtggacccccgaggaggacctcatgctcggctcctatgtccaggagcacggccccgggaactggcgcgccgtgccgaccaacaccgggctgatgcggtgcaccaagagctgccgattgcggtggacaaactacctccggccgggaatcaagcgcggcaactttaccgagcaggaggagaagctcatcgtccacctccaggctctccttggcaacaggtgggcggccatagcatcctacttgccgaagaggacggccaacgatatcaagaactactgcaccgcgcatcttaagaagaagctgaagaacatgcaggccggcgaagggggcgcgggagggaagcgcccggccgttcccaaggggcagtgggagcggcggctgcagactgacatccacacggcgcggcaggctctgcgcgacgcgctctcgctggagccttcggcagacgccgctggccaaggtggagcctctgccgacggctccggggtgcgcgacgtacgcgtctagcgccgacaacatcgcgcggctgctggaggggtggctgcgcccgggcagcggcaaggggccggaggcgtcgggttcgacgtcgacgacggccacgacgcgccagcggccgc

SEQ ID NO: 1078 - DNA, 955 bp, Zea mays
ccacgcgtccgccacggaatcgatcgatcggtgctttgatctctgagcctgagcaagcggtcgagctcaccaaccgccacgctcaagacaggtcgagtagctagctagctgccggagtggaaaaggaggcggtgcagtggcatggggaggccgccgtgctgcgacaagatgggggtgaagaaaggcccgtggacccccgaggaggacctcatgctcgtctcctatgtccaggagcacggccccgggaactggcgcgccgtgccgaccaacaccgggctgatgcggtgcagcaagagctgccgattgcggtggacaaactacctccggccgggaatcaagcgcggcaactttaccgagcaggaggagaagctcatcgtccacctccaggctctccttggcaacaggtgatggtcactcgcctgtcgtcgtcttaaagcttttgttcccgttttgttttttccgctgtaacaaatggatcggacaaaccaaatcatccacggcacgaggtgatcgtgtgctgagcttgttgatctgcatgccgtgcacttgttgatgtgtcgtgcaggtgggcggccatagcatcctacttgccgaagaggacggacaacgatatcaagaactactggaacacgcatcttaagaagaagctgaagaacatgcagggcggcgaagggggcgcgggagggaagcgcccggccgttcccaaggggcagtgggagcggcggctgcagactgacatccacacggcgcggcaggctctgcgcgacgcgctctcgctggagccttcggcgacgccgctggccaaggtggagcctctgccgacggctccggggtgcgcgacgtacgcgtctagcgccgacaacatcgcgcggctgctggaggggtggctgcgcccgggcagcggcaaggggccggaggcgtcgggttcgacgtcgacgacggccacgacgcgcca

SEQ ID NO: 1079 - DNA, 847 bp, Zea mays
cgtctgcaccgaatcgatcgatcggtgcttttaatctctgagcaagcgatcgagctcaccaacaaccaccgcgctcaagagtagcagccggccggagccgaaaacgacgaggcggtggcatggggaggccgccgtgctgcgacaaggtgggagtgaagaaagggccgtggacccccgaggaggacctcatgctcgtctcctatgtccaggagcacggccccgggaactggcgcgccgtgccgaccaacaccgggctgatgcgctgcagcaagagctgcaggttgcggtggacaaactacctccggccgggaatcaagcgcggcaactttaccgaccaggaggagaagctcatcatccacctccaggctctccttggcaaccggtgggcggcgatagcgtcctacttgccggagaggacggacaacgatatcaagaactactggaacacgcacctcaagaagaagctgaagaagatgcaggccggcgaagggggcgggggagacggcgacggcgcagcaggtgcctcggaaggcggcgccgtcgccaccgcaggcgcgggagggaagcgcccggccgtgcccaaggggcagtgggagcggcggctgcagaccgacatccacacggcgcggcaggctctgcgcgacgcgctctcgctggaaccttcgccttcggcgccgccgccggctaaggtggagcctctgccggcgaccgccccggggtacaagacgtacgcgtctagcgccgagaacatcgcgcggctgctggagggctggctgcgccccggcagcggagggggcaaggggcccgaggcgtcgggctcgacgtcgacgacggccacgacgcagca

SEQ ID NO: 1080 - DNA, 1600 bp, Zea mays
ccggccggacctccggcgcccccctgtcctcaacctcaagccgccacgcaccaccaacacacgcgcgctggcttcttcaacctcggttgctcgctcgcaacaagacacggatcgtcagagcaagagctctggtgacctgacgattctgctcttgttctcgtacggcgccggtgcctagcgtctgtagcctttttgtgtgtgtgttttttcgcccatatctctccccaccaccaccaccaacctagctcagccgcagttcacccgcgtcaccgcacgagtacacgagcaatccgcaagcgataacctgcaagctgaggggccagctgttttgctcacggagaaagaggttctagctagtcgttgatcagcacggacacaccatggtgaggccgccgtgctgcgacaaggagggcgtcaagaaggggccgtggacgccggaggaggacctcgtcctcgtctcctacatccaggaccacggccccggcaactggcgcgccgtccccaccagaaccgggctgatgcggtgcagcaagagctgccggcttcggtggaccaactacctccggccgggcatcaggcgcggcaacttcacggagcaggaggagaagctcatcgtccacctccaggccctcctcggcaacaggtgggcggccatcgcgtcgtacctgccggagcggacggacaatgacgtcaagaactactggaacacgcacctcaagcgcaagctgcaggccggcggcggcgacggcgacggcgacggggcggccaagccgccggcgcacaggccgccgccgtccaactccaaggggcagtgggagaggaggctgcagacggacatcaacctggcgcgccgcgcgctccgcgaggcgctcaccccgctcggcgacctcaagccgcagccgcagccgcagcgcgacggcgctggcgtgggcatcgtcggcggtgacagcccggcggcctcgagcttgtcgtcgcagtgctccccgccgccagcgcctgccgccttggggacgtacgttctcaccgcggacaacgtctcccggatgctggacggatgggccggcttgaacgggaagcgccgcggcggggctccgggcacgcccggcggcgccgagaccgcgtccaccgggtcctcctcggaggtgtcgtacggcggtggcaccgccgtcgtcgcgccggccgctggtggcccggtgttcgagtacgagacgaagccgccggccgcgccgttccagctgatgatgccgctgtctgcgatcgagtcgtggctgttcgacgacgacacccacttccaccgtcctgtccagagcgccagcttgctggacgccgcccccatggattattacctgttgtagctagcgtgtccagcagctgatccagaccaagctaatccgttcaagcaaggaagtcggtggctgattagtcggctagctagctacctgtttctaaagttgttagttttcattatatttagccttttcttttctaggtgggtaaaagttgagtgcgtacttccccttgtgcaagctgcatgttgcatgggaaaataacatatatagctcttgcttgagacccaaaaaaaaattaccacggcggccgc

SEQ ID NO: 1081 - DNA, 1632 bp, Zea mays
gaattcccgggtcgaccctcgcggccgcggacgcgtgggcggacccgtggggccacaactccggccagaagctagctagccaagttattagctagtacatactagtggccggccggacacgatcgatgggcaggccgccgtgctgcgacaaggcgggggtcaagaaggggccatggacgccggaggaggacatcgtcctggtgtcctacgtccaggagcacggccccggcaactggcgcgccgtgcccgtcagcacgggcctcatgcgctgcagcaagagctgccgcctccgctggaccaactacctccgccccggcatccggcgcggcaacttcacaccccacgaggaaggcatcatcgtccacctccaggccttgctaggcaacagatgggcggccattgcttcttacctcccacagagaaccgacaacgacatcaagaactactggaacacccacctcaagaagaagctccggaagcagcaagccatcggcgccatcttcgcgccacctcccccctccgaacccaccgccggccatgccgattgccgtcgtcacgacatggcccgctcctccaaggacagccacgcttgcctggccgacagcacaccagcggctgatgaggtcgtcacccagctcatcgcccagcagttcgccgccaccgacggtgacacctcgtcgtcgtcgtcgtactcgtacgcctccagcacggacaacatctccaagctgctcaacggctttcatgaagagcgcctcgccggcgcgggacgacgctaccgacaccatcaagacttcctcggccattgacatcgaccctttcgaccacaagtccggcggggcactactaccaccacccaagaagcggcagcagcagcagcatctgtcctccatagagaactggttgttcgacgatgccactgagcaggtcgttgtccagctgatggaggagatctccggcggctcatgctcagttcccatgctgctttattagcaccaagaaaaagaagcgaacatgcatgatagccgatcgatagatgtgacttggataggagaatgaatgtgtgcatgggtgcaagttacccagctgataggagaattttatatacacccatgcatgtttagttttatttacacaaccatgagccatgagataagaacaatatatatgcatagtcaatcaaaactcccaagcgagaggcacctcaaagagcgcggaaaaaaaaaaaaaaaaaaaaaagacaacgcctggtccaacaagtcttggtgacctggtccggccttccagatgagttggctacgtgggaggatcaggaagccttgcatcagcgctttccattggctcctgcttggggtcaagccggctttccagggtgagggaatgtcacgagctcatccacaccacacaagccacatgaacctgaagaagcagcaaggagaggagagcgtgtccgtcggacaaatgtgagaattactgggcctgaatgggtgtagtgcgttgaatgggccactgttgggctggctttgtaggattcctgtgtgacccttgtaatgggagatagttaaactctgcagtagccagggagatgaggaagaaagaaatagacactgctcctatctacctcctccttccttc

SEQ ID NO: 1082 - DNA, 2491 bp, Glycine max
ccacgcgtccggggaatttagaatgcttagaataaatgaatgaataaagttgagttccctctaacagttatgttagagtttagttgagttatcatgaataatcatcagtgacactgtaggagcatggatcctctatgtgagttttgtcgggtggtgagagctgtggtttactgtaagtcagattctgctcgtctctgcttgcattgcgatggctgtgtacactctgcaaattctttgtctcgcaggcattcgcgttccctcctatgcgataagtgcaattcccagccggcaatgatccgctgcatgaatcataagttgtcattatgtcaaggttgtgactggaatccaaatgactgttctgcattgggacataggcgccttgcattgaattgctacactggttgcccctctttggctgagttttctaggctctggtcttttgtgtttgatgctaattcctcacttggtggttgggaatcggttggtactttgccaaaaagtgagagctgcactagccagtgtttggagcaaactgatcataatggtggttattttggtttggtgagtgacaagttggatgaaattgaatcttgtgtcagatatcaacctcggatggatcagtctcaaatcattccatcaaatccaaattacacaccgtactgcaaagacgaagcatttttctttcctcaagactcaaaccagccaaagctgcaggaatgtcctaatctaggaattcatgatgggaatgaactttgtgaaggtttcaatgtggataacgttcaattaaactttgaaattgctgatgaaatattttactgttcacaagttgccacaagataccaccttgaagatggaggaatggactgtttattgatggataaaaacatagcagttacagaatctagttcacttattgagagtgccatggaggcatcatcatctatccaacaagattgtgtggcttttcaatcatcgagggctggtgggtcagctagtgtgatgcaggttatcaacagcaataccaattgtgcacttatgaatcctagctgcactaaaaacatcagtctgggatttcctcagggcctagttcattcaaacatgccacttcaatttcccaacatagttggtgaaaataattctactgaatatcaagactgcgggttatcgcgagtgggtgaatccccctgggaatcaaatttggagggtacatgcccacaagcaagggataaagctaaaatgagatacaatgagaaaaagaaaactcgaacctttggtaagcaaataagatatgcttctcgcaaagcaagggccgatacaagaaaacgtgtgaaaggtagatttgttaaagcaggtgaagcatatgattatgaccctcttgggacaagggacatctaagcatattatctacaataactatcttttccatgaaagatattcttctgactggtaaggtggtccctggaccttgtgagtacattgctttgttgccaattcttcatcaacagacgttttgtttatcttgtgaaagtgggagagttataatgcagctagatatttattcaaaacttgactgcttaggtgattgatacagatctattagagattttaacatatttagaagataacaaagatatgaaggtgttgcaattgggaattgcagaggaagggattggatgtatgccaagataatgcgtttaattatacataggaagtgtgagaggtaacaggcatgggacatagaggagcagaacatttgaacagatttcaaacagcatcacagtcattgtcaattcagacaaaaacagagggcctggatattcctccttgcatttagaggagatgtgcagagtgatccatcctgaatttcaaatgtgatattgtgagtctctgagcctatgtgttctatataaataaacactgcctagtgtaatgaataaaagagaaactggtgtttggcaagcaacaatagccaacctcacactttctgctttcagtttggtccttccgtcctcatggggatccttcacacgaccttattctgtcatcttaagccattgttcaaggacagcaacaccatattttggaacctcttcatttattccattttcatcagattagtgagcacgatcgactgttgattgagatactattgttcttgacttgctggaagccagttttacctgccgcaactattggcatctttgacattgcctcaactatttcatttgttgtattcctctatatttgctttgaggatggcacctatttcttcaataattgtacaaacattgtgtacaaactttcctgatttcaagggacgtttgtttctcctatgaaataggagatattaatgactgttttattgttttgtaatttgcacaaatctgttattattcattaaatttctgtagaatgttgataagaaagaaactacagtctttactgttccgagtaaaaaaaaaaaaaaaaaaaaaaaaaaaaaaaaaaaaag

SEQ ID NO: 1083 - DNA, 2264 bp, Zea mays
  misc_feature (10)..(10): n is a, c, g, or t
gccggccggngtccaaaaggagacttcctctttcttcctttcctcagccttcccctctcttctctgctctttgcatctctctcttgttcctcccttcctctctctaaaaaagggttctgatccctttctagaagctcctgggtttctgttgccgacccgagctccccaggggcgctcaggaggcgccgagccggcgaccgctccggcggatctgaggagccgccgcggtcgctttgcctccggttccttgtaaactattgattgggaaacactctgaagaagagtttgttggctgcataacatctcctgaagctggtttgaagtttgctgataggaaagatcatgggcgctctctgtgatttctgtggggagcagaggtctatggtttactgccgatcagatgcagcatccttgtgtttatcatgtgaccgtaatgtgcattcagctaatgctctttctcggcgtcatacaaggacacttttatgtgaccggtgtgcttcacagcctgctatggtccgctgtctagcagaaaatgcctcgctttgccaaaattgtgattggaatggccacattgcaggatcctcatctgccggacacaaaaggcagactataaattgctattcaggatgtccatcgtctgcagaactttctagaatatggtccttcgtttcagatattcctaatgtagcacctgagccaaactgtgagcaaggaataagcatgatgagcatcagcgacagtggtgtcagtaatcaagataatgctgcaggggacagtattttgttagatatagctagtgcaacacttgtaagtgatattggtacttgtgacaagcttttggtaggttcctcttcaggagctggagtgaacctacttccactggctactggtcaaacagaaacagctggatctgtggattccacaccagataaggttccctatacgccagataaagatatgttcagtaaggacagcatatatgaagatttttgtgtggatgacgctgaccttgctttcgaaaattatgaagaactctttggtacctctcatattcaaacagaacaactctttgatgatgctggaatagacatttactttgaaatgaaggaagcacctgctgggaattccactgagtccaagctgaagcaacctgcaaatagcaatgcggtatctgccgactctgggatgtcgaaccctggagtgaaaggtgattccagtgtttgtacccctttgaggcaggctaggtctagtctgtctctttcctttgctggtttgactggtgagagtagtgcgggagaccaccaagattgtgtggtatcatcattgcttcttatgggtgagcctccttggcagcctcctggccccgagggctcaattgctggaggtagtagagacagtgcactcacacgatacaaggagaagaaaatgagaagaaagttcgacaagaaaatcaggtacgcttctcgtaaggctagagcagatgtgcgaaagagggtaaagggtcggtttgttaaggctggtgaagcatatgactatgatcctctctgccaaacgaggagttactgaagcatatgatctttatccagttttaaattagcaaactgcaaccaaggctcgttgcagctagaacaaaagcactggcaatccaagctattgggccaaactgtgccttcgaaaagaaaaaaaaaaggagaaagctgtcggcatgataaaatatagagaaatatttggatgttgcagaagtttttgggtgaggatcctcctttttcctcctgtacagtggttggaagcggtttgagtctctccatcttttgtgaattagcctgaatccagctaaacagacttgttgcattttgatctccattctgcattcctgctgactgccatcagtctacgtacacgggctggcggctgcggtgtttttggaggtgttcgtccagattagacaagatggctagatgtgatctgtgaaatatccttctattataataatgtaaaatttgctgggacctggatgtttctgctattatcaatgtgcaaatacccggtcgtagccaaactgggcgtcagtttgttctttttaagttggtgatggaacccatccaactggacagtggacaccaactttctgtgctcattctgtccaaaccaacctccaaactgactcgatgttagtactatttgtattatgtgactcctgagcaagtgagcttgtgctcaaacctcaaatacgtcctcttgtaccaaaccacgatatggagggt

SEQ ID NO: 1084 - DNA, 1088 bp, Glycine max
gtactaagtgaaataaataattcgcttgaaaaaataggaagtgaatatgaaaatgtacactatatgaagctgaaacagccatgatatgcctttaaacggcgcgtcaagcctgaacaaagagactactattagactcacagtcacagaatttcaagccgagccgagagatgagggcgcagctggcgcaagactaaggtgcaagtccaagccccatgcatcatcaaatttgggcccactgtcacctttggaaaacctactcaaagagggcccatcaatcctagcgtggtgggcccgggcctgaacctgcaccgttgacaaagctaatgacgaagaatctcctacaacgccaacatagggaaacatcccagcacccgcagatttcacacccgttgttatggtcacgttattactattattactactactgctgctgaagccgttgttgttgctgttgccaggcgccgacgggaacgcacaaccgtgcgacactgacacgtggaagggaggaggcgcggcacgtggtggcacgtacacccacgagggaggtgccgccgggaccaccacggtccccggcggagccagaaggtgcggcggaggggcgaaggcggagatcatcggattccgaacgaacgaaacggcggcgtttcgggaggcctgtaactgcgcccgcttcagctgctgacgctccttcttgtgcgcgttctggtgtccgccaagtgcttgtgaatttgcgaactctcggcagcagtattggcactcgtatttccggtcggcggaggaaggtggtccggcaccggcgacggaggagtccggcgagtcagacggggaagaaggggaagtggaagaagtgaccttggtggtggagtctgccacgtcatcatgcgccacctcgtcttcgtccatgatgtcttcgtggtgtacgctgaaaccgaagagcttcaagcgcgttggggaagtggggtttgtttttttagtgttgtagtcaagttgggtggtttccatgagaaggaaggaaggggtagtagtgaaagtgtggaacaagaaagaagggtagttaatgtgtttcccgagccggatcgggctcgagc

SEQ ID NO: 1085 - DNA, 1020 bp, Glycine max
  misc_feature (935)..(935): n is a, c, g, or t
cccacgcgtccgtacggctgcgagaagacgacagaaggggattgctaaacaaaagaagcatgtctaatcatcatcacgtagttcagacctcgccaccgaaactattcggtttcccactaacagagcaggaggaattgaattcagatgcagaaagaaaatacgaggttggagaggacagaaaattcagatgccactactgcaaacgagtattcggaaactctcaggccttagggggccaccaaaacgcccacaagaaagagcgtcagagggcgaggcgtttccaaatccacactcatagacgctccattgcagcaccatcttctgcttctgttctcaactcacatgcaataataagatcagtaccttcagttacagttactacgctaccctcctccatttacttacgaggaggccctcctactacttcttctcttctacccatcttccatcctcgtcaacccaataacactaagcacttcccatcacggcccattttgattccttcttccacctaccaccgtgctaattgcactccatcctttccttttcagctttatgcctcaccctctgtactgcaatctgctcctaacgtccgtgatttttctgctgagagcagggaagttgatgtccatctcaaattataactcttagattgattattattaatttttttagtgctagtttctagctgcttcagccttctttgctccaaatagatcttatctttttttctcgccccttcagattatgcgagcttgctttaccaattattggctcgaatagttaaacagtactttccagagtaggagctagacactgtagtgtggtaaatcccccagtccttatatttcattttactactatatagccaaaacttgcatgtaaatcagatcagcaaaaaaaaaaaaaaaatgaaacattagcattccctgctnaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1086 - DNA, 676 bp, Glycine max
tgccactactgctgccgcaacttccccacctcccaagccctcggcggccaccagaacgcccacaaacgcgaacgccagcacgccaaacgcgcgcacctccagtccacgatggtgcagggcagcaccttctccgacgcgcaccatgtctacaatctcatgaactaccgctacggttcttccattccaacaccaccaccaccaacaatgccttatccaacatggaacaacaacaacaacaacacgcgcttctacggaacaacaacaacgacgtcgttttctcaccaccaccaacaccaacaacaacctattaacggaagccccttagcattttggcgaattcctaatggcaccaccattaataataataaccctagtttcagccacgagcgttcttcgacgttgccgcctttgttcgcgactgaggaaatagcgaacgtgagagcctcctcgcaggttgttgtcggagcctcggggccgatgacgacgcaaaaccgctacgtgtatgactcgaaacaacgcgaccatgtgagtttggatcttcatctgtaatagtagtaacatgtttcatgttttcgtacatagtattatcatgagccagtaataacaactctattatgatgatgatgatggcatggcgctacgagagaatcgagggatttgcaggcagcgactcttt

SEQ ID NO: 1087 - DNA, 882 bp, Glycine max
tttttacttattaaataaaatttacattcacatacaattcagagtacaaaggttgctattaacaagtcgatacttttaaggaagattttatgtttgagtacctgaagaaaaaaaatatgaccgagaagagattcactaaagtgacttgtcaggttcaatctttatagcagagacacaccaacaacatggtgataaaaagaaaaaagaaaaaaaaaatagaaaagctgctacacatttggtgctaaattgaatgaaaaaactgattcacaaaactcacaggctaagatgcaaatccaaacctaaccctcgttcacgaccaccaccactaccttcacccccgttgaagccaccgaactgcggcagagggtggcggtgaccatggccatcagtgatggaggcaccagctgctgcaacatagattcgtcttccagaagccacaaaggcagctcctgaatgatatgcaccaccatgtggtgtgcataaccacgacaaaggtggctgagactgtggtgagaagcttgatatgattgtgttgtgaatctgtgaagaaacaaaaccacgagcagcttgcatttgggcacgtttcaagagctgtctttctttcttgtgcgcgttttgatgccctcctagtgcctgtgagtttgcaaattctctgcaacagtactgacactcgtactttcttgaactgaaaggctcagaattcgaacctgcttcatgagtttgatcttctggggacttgctaatgttgatgccaaagagctttaggggttgagtgttagtattggattttgcatggtattcaatttcagccatgatgaattgtgtgagggaaaaagaaaagatgcaccaaaatatgtggttaagtagtaacagcggctcgag

SEQ ID NO: 1088 - DNA, 619 bp, Glycine max
cggttcggaatttccggttttacttacgcgtccgccactcgtccgcccacgcgtccgcactaacagaggaggaggatttgaattcagatgcagaaggaaaatacgaggttggagaggacagaaaattcagatgccactactgcaaacgagtattcggaaactctcaggccttagggggccaccaaaacgcccacaagaaagagcgtcagagggcgaggcgtttccaaatccacactcatagacgctccattgcagcaccatcttctgcttctgttctcaactcacatgcaataataagatcagtaccttcagttacagttactacgctacccttctccatttacttacgaggaggccctcctactacttcttctcttctacccatcttccatccttgtcaacccaataacactaagcacttcccatcacggcccattttgattccttctttcacctaccaccgtactaattggcactcatcctttccttttaaagtttatgccttaccctttgtactgcaatcttgttctaacgtccgtgatttttctgctgagaagcagggaagttgatgtccatcttaaattataactcttaggatgatcattattaaattttttta

SEQ ID NO: 1089 - DNA, 463 bp, Oryza sativa
  misc_feature (439)..(439): n is a, c, g, or t
  misc_feature (452)..(452): n is a, c, g, or t
ccatttctcatcactgagctgagctcagttcagttcagttcatggaagtatatctccttcttggcttcatttgacaacttccaacacaagcagaacaaggtgatcaaatcatcctcaaggcttgtcttttttttccttctctggttatctccaatggaggctcccccttctctttccatcgtcgacgaagacggcttcgtcatcgacctctcgctgacgctgggcctgacatcgcctccgccctctccaggcggcgcgtctccttccattcctccgggaagaggcggcggcggcggcacgagtggtggtgacaacaacagaggcagcagaggtggtggcaatggtggtggtggtggtggtgtgaagctcttcccttgcctcttctgcaacaagaagtttctcaagtcgcaagcgctaaggggacaccagaatgcacacnagaaggagaagancgtcgggtgga

SEQ ID NO: 1090 - protein, 242 aa, Oryza sativa
MAGVVQTVQCDQPSKQQLTEAAEAAAAAAAAASLRIFGYEVGGGGGGGGVAAAAGARREAADVVVGAGRRFECQYCCREFANSQALGGHQNAHKKERQQLKRARLQLAVAAAGTPAGMGFAAAQAPAPPPGHVIAVGHHAGSVASYALPRWVYLAAHHLQPPAVGLPFHATVQAAAGACHGGGDVETRLLSVAAAGRGSSTAGSSAHSYEVCAPAAPADDSDEEASAMGLDLHLSLAPASSA

SEQ ID NO: 1091 - protein, 210 aa, Oryza sativa
MEAPPSLSIVDEDGFVIDLSLTLGLTSPPPSPGGASPSIPPGRGGGGGTSGGDNNRGSRGGGNGGGGGGVRLFPCLFCNKKFLKSQALGGHQNAHKKERSVGWNTHLYLPAGVAAATTTTTTTTAMAVPDMVGMPTHQMSSMALHSCRPHQGSHVTAADIATLAAPPHYTVDHGVAGIASGGGDSSVGWRQRQREAGGEKQRQVDLNLKL

SEQ ID NO: 1092 - protein, 267 aa, Oryza sativa
MSMTSPRLKLFGFDVSEEETAEHEEQYSAEPESAPVCGGNGGGGGGGSDSSSSSTTTTTTATAGGDGRRYECQYCCREFANSQALGGHQNAHKKERQQLKRAQLQAAAAAAGRVAGGAAALYPRANPMVSAFAPTPHLLGGGEAGPTSWVYFSPRAAAVAGGAQGQQFHVSHGCVFPARGAGPAAVAAASPAVFSYTPATSAAAVAAASAPYVTTDEHHGRRIHASSAASLARYPGPAMVVAEPVATVPEDTCLGLDLQLSLAPAGL

SEQ ID NO: 1093 - protein, 128 aa, Oryza sativa
MSMTSPRLKLFGFDVSEEETAEHEEQYSAEPESAPVCGGNGGGGAVGSDSSSSSTTTTTTATAGGDGRRYECQYCCREFANSQALGGHQNAHKKERQQLKRAQLQAAAAAAGRVAGGAAALYPRANPM

SEQ ID NO: 1094 - protein, 279 aa, Oryza sativa
MAKPQDMRSVDSFSQLPFIRPAPPPQQQARDTIRLFGCEFSNDLQLRPTEAGAGSPDAANGSTVTSEGSNGGDGGTKNGGAATAAAERKFECHYCCRNFPTSQALGGHQNAHKRERQHAKRAHLQASLAMHRYMPGHMYGLFNYHHHIGGRFDHHPPPPPPPPPPAHYPMWTSAAPGAFAGPGSMAQPINGSPVQAGLWSVPPPTENFGSTAGRQGADKLATTVAGTPAAGEVACKDEMVPMSLLSSSPSLSSCSSTSPEMLGRCELGQKEGVSLDLHL

SEQ ID NO: 1095 - DNA, 824 bp, Zea mays
  misc_feature (731)..(731): n is a, c, g, or t
gccggccgggccgggatcagagcagctcgcaccatgccaacataccaccataaacgcaacagcagccgggcagtcgagagaactcctggagccgtgggtgcctgggtggctagctgtaggtcttccttcttgcttccctacacatccgatcccttaccctaggggcacatctcgcgctcttgcgctgcgacggcgaattggcaatgagtgagcaagacgggcagcacgtcgggggcagcccgccggacgcggccatcgagtccttctcacagctccccttcgtgcgccccaagcccccgcagccggcgtcctcgtccagtccgtcgtcgatccggctgttcggcttcgaggtcccacccgacgccgccacgtcctccaccgcaaccagtgacgctaccgccgccagcgccaccgtagcgggccaggcggcggcgtcgggcgcggcgggtgcaggtgcaggtgcaagcgatggcaccggcggagggcgcaagttcgagtgccactactgctgccggaacttcccgacgtcgcaggcgctgggcgggcaccagaacgcgcacaagcgggagcggcagcacgcgaagcgcgcgcagtaccagagcgcgatggccatgcatcacgcccactacccaggccacccccacgcggaccccgccttcactagctaccaccagcagcagcgcttcggcatggcgcgctacgagcccccaccgccgggaccgccgccgcantaacccctcgtggtccccgcaggctgctccgccagtggtgccagatactacgggaggggctgctccctgtcgcagcccatcacggcaccccat

SEQ ID NO: 1096 - DNA, 1414 bp, Zea mays
tacctcgaggccggccgggccttcagctcctcgctctcctcagtccttaccatccatcgatcgcgaaggaagggtgctgaggaggctttcccatgcaccctcgttcctactagccacaccagctatgagacaccccggctacttccttcttggtacgtactggtggcggtactgaaaactactccgcagagatacacgagaagacgtatagttctgtacctagccaagccaagctacctccctcgctcgctccacacctgcctgcatgggcggcggcggcgaaggcagagacagcggcggcggcggcggcgcggcgagctttcgggaggcggctcgtgacttcagcaacgtcgcgtccttctccgagcttccgttcctgcagcgctccgccgccccgccccgtggaagcccccacaactccggcatccgcatcttcggcatcgacgtcccgcactccccaccggagagaaactctaataaagatgccacggccgctactactactaccgccgccgcttccgccacgcagagcagcggcggcggcggggccaccaccgacagcagcagcagcagcagccgcaagttcgagtgccactactgctgcaggaacttcccgacgtcgcaggcgctcgggggccaccagaatgcgcacaaacgcgagcggcagcacgccaagcgcgtgcagatgcagtccgcgatggccgccgccgcagccgcggcggcggcggctggcggcgcgcaccaccaccacctactcggctacccgcagcaccgcttcggcgtcgcaggccccacggtggcgacattgtacccctcgtggccaacaatgaggcctccagctccagcaggcgccggtgccggtgccgtcgccatcggcggcccgcagttctacagcgggatcggctcgatcgcccagccgatcaacgggagccccctcctcacggctgccgggctctggaggggcccgccgccgcctgctgccgggcatgggaacgcgagcttgccgtcgtcaccaggcggagagcgccgccggccggtcgcgctctcgtcctcgtcccccgtgttccgcggagacgatccgagggcttccacttctcttttggcggcggcgtcgtcgccctcctcttcctcctctttgctgctatctccacaaggtcagtttgtctgtgagcagcctgctgccaccactgcggccgagggcgtgagcctagatttgcatctataattgtttccttttggtcgtctatgctgcttttagcggacgacggtggtgtgagcctagattttcacttgaattcagatcgtgccttgtttcctgacacgggtgcacaagaatttcatctatcgaagtttcggaactttttgtctgtgtgcatacacatatacagaaagattcagacaatatgttagggtt

SEQ ID NO: 1097 - DNA, 3416 bp, Glycine max
ccacgcgtccggaagaacaaccgctaactgtggttgcactaaaatatactcactctttttctctgtctccattcgtttctctccgctttaacgttgccccagttaagttttcttatgtaaaggcacaccctttacctaattactagtaccaacaccaaacaaccttgcctttttattctctccttcttgtgttacctttgttgtgtagtgagtgagtgaaagcatggctatggttgtggctcaacacagagaaagtagcagcagtggaagcattgacaagcacttagattctggtaagtatgtgaggtatactgctgagcaagttgaggctcttgaaagggtctatgccgagtgccctaagcctagttctctgcggaggcaacaattgatcagagagtgccccattctctccaacatcgagcctaagcaaatcaaggtttggttccagaaccgtaggtgtagggagaagcaaagaaaagaggcatctaggcttcagaccgtgaaccgcaaactcactgcaatgaacaagttgttgatggaggagaatgatcggttgcagaagcaggtgtcacagcttgtttgtgagaatggttttatgaggcagcaattgcatactccatcggcaacaactactgatgctagttgtgattcggtggttaccactcctcagcataccctgagagatgctagtaaccctgctggactcctatcaattgcagaggaaactttgacagagttcctttcaaaggctacaggaactgctgtagattgggtccagatgcctgggatgaagcctggtccggattcggttgggatctttgccatttcacaaagttgcagtggagtggcagctcgagcctgtggtcttgttagtttagaacctacaaagattgcagagatccttaaagatcgtccatcttggttccgtgactgtcggagcctagaagtttttactatgtttcctgctggaaatggaggaaccattgaacttgtttacacacagacatatgctccaacaacactggctcctgctcgggatttctggactctgagatataccacaagtttggaaaatggcagtcttgtggtttgtgagaggtccctgtctggttctggaactggccctaatccagctgctgctgctcagtttgtaagggctgaaacactccctagtggctacttgatccgaccatgtgaaggtggagggtcaatcattcacatagtagaccacctaaatctcgaggcatggagtgtgccagaagtgttgcggccactttatgaatcatccaaggtggttgctcagaaaatgacaattgcagcgcttcgctatatcaggcaaatagctcaggaaacaagtggtgaggttgtttatggattgggtaggcagcctgctgttctgcggactttcagccagagattgagcagaggcttcaatgacgctgtaaatggattcaatgatgatgggtggactgtattgaactgtgatggtgctgaggatgtaattattgctgttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcaatgttgatgcttattctgctgcatcactgaaagctggcacctatgcctatccagggatgaggcctacaagattcactggcagtcaaataattatgcctcttggtcatacaattgaacatgaagagatgctggaagttattaggctggaaggtcactctcttgctcaagaagacgcttttgtttctagggacattcatctcttacagatatgtagtgggattgatgagaatgctgtgggggcttgttcagagctcgtatttgctccaattgatgaaatgttccctgatgatgctccattggttccttctggtttccgcattatcccattagattcaaaaccaggtgacaaaaaggatgctgttgctacaaatcggaccctggatttgacatctggttttgaagttggtcctgcaacaactgctggtgcagatgcatcatcaagtcaaaacactcgatcggtgttgactattgccttccagttcccttttgacagcagtctgcaagacaacgtcgcggtcatggcacgccaatatgtccgcagtgtgatttcctccgtgcagagggttgccatggctatatctccatctggtataaacccatcaattggagctaaactttctcctggttctccagaggctgttacactagctcactggatctgccaaagttatagttactatttagggtccgacttactgagatcagattctcttgttggtgacatgatgctgaaacaactgtggcatcaccaggatgccattctatgctgttcactgaagtcattgccagtgttcatatttgcaaatcaagctggccttgacatgttggaaacaaccctagttgccttacaagatatcacattggataaaatatttgatgaggctggacgcaaggcattgtgtacagactttgccaagttaatggagcagggttttgcttatctgccagctggaatctgcatgtcgacgatggggcgccatgtgtcatatgaccaagccattgcatggaaagttcttactggggaagacaacactgttcactgcttggctttctctttcataaattggtcatttgtatgaaaaatccaattcgtgtgccctgctttttcccacttgaacataaaaatgaaagggttaaaagggagacaagacaagtttggggggaaaaagaagtcgtaaatttttgtataacacatcaggatcaggtttgcatttaattcgatttaatttatttcttatttagtgcagagaccaaattgaattaatcttgtaaattatttagtgctagagtgaagttgagacttttgaatgacacatgttgagtactttgtttttgtctctactatctttccctcgaccttgagctcatacacagaagaacttgtgtgatgacaaagcgcgtttgtaatgtttattcttacacaatcacagttctgacttgtgtgtccaatgtagtactttgtttttgtatgtagtatgatcatatctttcaactcgagttaaatattagcacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccccccttttgggtctcgtccccccggaatttaattccggcccggtccctgggggggtcccagttttccttttaggggggcgttttaaagctgggggaaaaaagggaaatagttgt

SEQ ID NO: 1098 - DNA, 2837 bp, Glycine max
cggacgcgtggccggccgcctgcgtgcttggcagatcgttgcacagattcctccatcctagtttagtgctagaaagagtaaagtatgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacacccagattactacgcaggcaaccaaagacacaaactgtgaatcagttgtgacgagtggtcagcagcacaatttgataactcaacatcccccacgggatgcaagtcctgcagggcttttgtccattgcagaagagactttagcagaatttctttctaaggctactgggactgctgttgagtgggtccaaatgcctggcggctgcgagaagacgacagaaggggggaatcgttgctatttctcacagttgcactggagtagcagcaagagcttgtggtttagtgggactagaacccactagggttgcagaaatcctcaaagatcggcctttgtggtttcaggattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggcagcttagtgatctgtgagaggtcacttaaaaatactcaaaatggtccaagcatgcctcctgtgcagcattttgttagagcagagatgctgcctagtgggtacctgatcagaccttgtgaaggaggtggttccatcatccacattgttgatcatatggatttagagccatggagtgtgccagaagtgctacgcccactgtacgaatcatcaacagtactggctcagaagacaactatggcggccctacgtcatctaaggcagatttcacatgaagtttctcagtccaatgtcactgggtggggtagacgaccggcagcactacgagctcttagccaaagattgagcaggggtttcaatgaggcactcaatgggtttaccgatgagggatggacaacaattggcaatgatggtgtagatgatgttactattctagtgaattcatcccctgacaagttaatgggtctgaatctttcctttgccaatggatttccgtctgtcagtaatgcagtgctatgtgccaaagcatcgatgctattacagaatgtgccccctgccattctcctaaggttcctgcgggagcatagatcagaatgggcagacaacaatatggatgcttacacagctgctgctattaaagttggcccttgcagcctatcaggatctcgtgttggaaactatggaggtcaagttatactccccctagcacacacaattgagcatgaggagtttttggaagtcattaaattggaaggaatagctcattctcctgaagacacaataatgcccagagaaatgtttcttttgcaactctgcagtggaatggatgagaatgctgttggcacctgtgctgaacttatatctgctccaattgatgcttcctttgctgatgatgccccccttctaccttctggatttcgcatcattcctcttgaatctggaaaggaagcttccagccccaatcgcacccttgaccttgcatctgcccttgacgttggtcccagtggaaaccgagcttcaaatgaatgtgctggaaattccagctatatgagatctgtgatgacaatagcatttgaatttgcatttgaaagccatatgcaagagcatgtagcatctatggcacgtcaatatgttcggagcattatatcatcggtccaaagggtagcattagcactttctccttctcatttgagttcacatgcagggcttaggtcaccattgggtactcctgaagcgcaaacccttgctcattggatctgcaacagttataggtgctacttgggtgtggagctacttaaatctaataacgaggggaatgaatctttgctcaagtccttgtggcatcactcagatgcaatattgtgctgcactctaaaggcattgccagtgttcactttctcgaaccaggctgggcttgacatgctggagaccaccctagttgcattacaagatatacctttagagaaaatatttgatgatcatggacgaaaaattctcttttcagagtttccacagattattcaacagggttttgcatgtcttcaaggtggtatttgtctttcaagcatggggcgacctgtctcgtacgaaagagttgttgcttggaaggtgctgaatgaagaagagaatgctcattgtatttgctttatgtttgtgaactggtcttttgtttgacatcttgttctgagtacactagtgcttattgtaatctaaagtgttagataaagatttactccagacacttgtgctttgttggttggtgttttactgtatttgcactaaatacttggattgcacatttaatgactatttatgtgttattagcttatgtaacttgtttccttattcaacatccagctaatatttatgcattcttaagaagtgttgcagcttcttatgtgtgtgg

SEQ ID NO: 1099 - DNA, 3118 bp, Glycine max
ccacgcgtccgctcttataagcaaccccatctctctgtcccaatcccaacataccccccactggtccttttccattctttatacagacacacacaataaagaaaaagaaaaactacgttttcctttcactattctttttcaccctctccctctctcccatatatgatccaatatattgctataatacaatagaaccaacaactgtgacagacaaactctgagtagtacctcttttattctcctcctccttctctttcattctcaaaccactctgccatagtcttttctttcacctcttaatgaaacctcttggtttgtgtggttgaaacaaacaaagataagtcataataataaatcgggttggattcggaagggatgatggcggtgagttcagcctgcaaagatgggagcaaggtggcactggacaacggcaagtacgttaggtacacacctgaacaggtggaagcactggagaggctctaccatgaatgtccaaaaccaagttctcttcgccgtcaacaactcatcagagagtgtcccattctctccaacatcgaacccaaacagatcaaggtttggttccaaaaccgaaggtgcagagagaagcagcggaaagaagcgtcacggctgcaagctgtgaacaggaagctaacagcaatgaataaattactgatggaggaaaacgacagattgcagaagcaggtgtcacacctcgtctatgaaaacagctttttccgccaacagacacacaacaacaacgctacgcttgccacaacagacacaaacacaagctgtgagtcggtggtgacgagtggtcagcggaacttgacaccgcagcagcattccgcgagggatgctagccctgcaggacttttgtccattgcagaggagactttagcagagtttctttcaaaggccactggaactgctgtcgagtgggtccaaatgcctgggatgaagcctggtccggattccattggaatcgttgctatttctcacggttgccctggagtggccgcacgtgcctgcggccttgtgggtctagaacctgccagggttgccgaaatcctcaaagataggctctcatggtttcgtgattgccgaactgtggatgttctaaatgtgatgtccactggaaatggtggaaccattgagctgctttacatgcagttgtatgcgccaacaactttggcacctggtcgtgacttctggttgctgcgctacacatcacttttggaggacggtagtcttgtggtctgtgaaagatcacttaacaacactcagaatggtcctgctatgcccccagtgcagcattttgttagagcagacatgctgccaagcgggtatttgataagaccctgcgaaggagggggatccattattcatattgtcgatcatatggttctagagccctggagtgtacctgaagttttgcgcccactgtatgagtcatcaatgctgctagctcaaaggacaactatggcggccttacgtcatttgaggcagatttctcaagaggtttctcagccaagtgtaactggatggggaagaaggcctgcagcttctgcgtgcgctgagccagagattgagcaagggctttaatgaagcagtcaatgggtttgcagatgatggctggtccatgttagagagtgatggcattgatgatgtcacccttcttgtgaattcctcacctagcaagatgatgggagttagccttgtctataacaacaatggatttccttctgtgagcagttctgtgctatgtgccaaagcatccatgttgctgcagaatgtccctccagcaattcttcttagattcttgcgggagcaccgatcagaatgggcagacagcagtattgatgcttactcagctgctgccatcaaagctggtccctgtagcttgccaggggcccgatcaggaggttttggcgcgcaggttattcttccactagctcacacaattgagcatgaagagttcatggaggttatcaagcttgaaaacatgggctactatagggacgacatgagtatacctggtgatgttttcctcttgcaactttgcagtggagtggatgagcatgcggttggcaccagtgcagaacttgtttttgctccaattgacgcatctttctctgatgatgcacccattttaccttctggttttcgcatcatacctctagattctggcacagatgctgctagtccaaaccgtacacttgatttggcttctgcacttgaggttggcacaacagcaaacaaagcagctagtgacaactcagctcattctgggagcacaaagtctgtgatgacaatagcattccagtttgcattcgaagttcaccttcaagagaacatagcaaccatggccaggcaatatgttcgtagcatcattgcatctgttcagagggtttcattagcactttctccttcgcgctttggttctcacaatgcttttcacttaccacctggcactcctgaggcacaaacacttgctcgatggatctgtaacagctatcggttctatcttggggtagaacttctaaaatgtgaaggcagtgagtccattctcaagtctctttggcatcactcggatgcagttttgtgctgctctttaaaggcattacccgttttcacgtttgcaaatcaagctggacttgacatgcttgagacaactttggttgcacttcaagacatcactctggaaaagatttttgatgacaatggaaagaaaactctgtgcactgagttcccccagataatgcagcagggtttcatgtgtattcaaggtggtatctgtttatccagcatgggaaggccagtgtcctatgagagagcagttgcatggaaagtgttaaacgaagaagaatccgcccattgcatctgttttatgttcatcaattggtcctttgtctaatatattaaacagtattaggatgtaggaaagaaaagtagagcacaagagtacctaactttggcgaatccctagaatgctttaaaactctagtgggcatatgcgccaccaagatctatctatggccccatttgttttatttttaaaaaaaaaaaaaaaaaaaaaaaaaaaaaaaaaaaaaaaaaaaaaaaaaaaaaaaaaaaaaag

SEQ ID NO: 1100 - DNA, 1005 bp, Glycine max
  misc_feature (972)..(972): n is a, c, g, or t
ccaaaaaagacattgttgcttttcattttggcatcacagagtatcagagagaaagagagagagagcggttttgcagaaaaaatccaagtaaatttaaggagccaccactgttccaatcagcccctttcattttgcagtgcccgtttattttttcgtgtttgcattcaccgttccacagaaggaaaaaagagtgctttgttccatctctttctgtggtgtgtctcaagataaaaagctcactcactcacagcagcaacaacccttttaccttaactcttgaaactttgttcagagtttggattttgagagagcatgatctgatgaaggagtgtggaggctctcttgggggagagggcaaggaagaagaggactacacaaaacaagtgttgtctttttgaaccccaaaaaaaaacgtttttttttgttttgttgttatggcactttgtatgcagagtcagcagagagattcagcatcaaacaagctgctcatggattgtggcaagtatgtgaggtacacacctgaacaggtggaggctttggagagggtgtatgttgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtctgcaatgaacaagttgttgatggaagagaacgaccgactgcagaagcaggtctcacagttggtttatgataatggattcatgaaacaacaaatacatactgcatctgctactactactactgacaatagctgtgaatctgtggtagtgagtggtcaacgccaacatcaaaaccccaaaattcagcatccccagtgggatgccaacaacccagctggtcttcttgcaattgctcaggagaccctggcggctntcctttcaaaagctactggaactgctgtcaact

SEQ ID NO: 1101 - DNA, 2252 bp, Glycine max
cctcgtgcccacgccgccgcctcgggagaccctggcggcgttcctttccaaagctactggaactgctgtcaactgggtccagatgattgggatgaagcctggtccggattctattggaatcgttgctgtttcccgcaactgtagtggcgtagcggcaagagcctgtggccttgtgagccttgagcccactaaggttgccgagattctcaaagatcgtccatcatggtatcgtgactgtcgatgcctcaatgtactgagtgtaatccccacagggaatgggggcacgatagagctcatgtacatgcagacatatgcaccaacaacattggcagctgcaagagacttctggactctgagatacactactagtttggaagatggaagtcttgtgatttgtgaaaggtccttgacttcttcaactggtggccccacagggcctgctgcttcaaacttcgtgagagctgaaatgcttcctagtggctatctaattagatcctgtgagggtggtggatctattattcacattgttgatcatgttgatttagatgtttggagtgttcctgaagtacttagacccctctatgaatcaccaaaattcttggctcagaaattgactactgctgccttgcgacatgtaagacagattgcacaagaatcaagtggagaagttcagtatggtggtggacgccagcctgctgttttaagaacatttagccagagactttgcaggggctttaatgatgctgtgaatgggtttgttgatgatggctggtcactgatgggtactgatggagtggaagatgtgactatagccataaactcatctccaaacaaatttttgggctccaattacaacgcatcaatgtttccagcatttggaggtggggtcttgtgtgccaaggcatcaatgctcctgcagaatgttcctcctgctttgcttgttcggtttttgagggagcatcgatcagagtgggctgattatggagttgatgcatactctgccgcatgccttaaagctagtccctatgcagttccttgtgcaagacctggaggcttccccagcacccaggtcattttaccccttgctcatactattgagcacgaggagttcctggaggtagttcgaatagagggtcatgcattttctcctgaggacgtagcgatggcacgcgatatgtatctattgcagctgtgcagtggagttgatgaaagtgcagttggggcatgtgctcaacttgtgtttgcacctattgatgagtcatttgctgatgatgctctgttactgccatctggttttcgtgtcattccgttggatcctaaatcagatggtccagctccaactaggacattagatttggcatcaacgatggaagtaggttctggtaatgcccgtccagctggggaagcagacttgaatgggtacaaccttaggtcggtcctcactattgctttccaatttacctttgagaaccatacacgggacaatgtggctgctatggctcgccagtatgtgcgtagtgttgtgggatcagttcagagggttgccatggctattgctccctccaggttcaatacccagctggggccaaagtcactttctggatcacccgaggcccttaccttagcgcgatggatctgtagaagctacagggttcacactggcacagagctttttaaagctgagtccacagctggtgatgcaatccttaagcaactttggcaccatcccgatgcaatcatatgctgttctgtgaaaacaaatgcatctccagtgttcaccttttcgaaccaggctggtttagacatgcttgaaactactcttgtttcccttcaagatataatgcttgataaagttcttgatgaatctggcaggaagattctctgctccgagttctccaagataatgcaacagggttttgcatctctccctgcaggaatatgtgtatctagtatgaatcggccagtgtcctatgagcaggttgttgcatggaaagtcctcaatgatgatgattctaatcactgcctagccttcatgttcatcaattggtcttttgtatgatggatgaaccatatctagagactactacttattttatctactaatcagatgatactatcacagacagatgtactgatgtcagcttttctttatgccctatgtatgaagtatgctaatgttacttattcgctatatatataaaatatctagttaatttggtgaaaaaaaaaaaaaaaaaaaaaaaaaaaaaaaa

SEQ ID NO: 1102 - DNA, 1824 bp, Glycine max
ccacgcgtccgctctttctcctttctttttctctctttctctacaatctcgagattggtgtgccgcgcgcccgaaagaccactgtttcccccctttagtttctcttctaagttggattttgaaggaactgagcagcatctaatgaaggagagtggaggctctcttggagaagagagcctgcccgagactaacaccaagaacagtgaagaagaagaaccaattaactagttcctttttttctttctttctttctcactcactccctccctcccaatcccattttcttcaaatagtgtgcgtgtgtgtgttaagagaagaatagggtgtgtgtgtttagagtgatggcactttctatgcacaaggactcagccaacaaccagatggattcaagcaagtatgtgaggtacacaccagagcaggttgaggctttggagagggtctatgctgaatgccctaagccaagttccttgaggaggcagcaactcatcagagagtgccccatactttccaacattgaacccaaacagatcaaagtttggttccagaatagaaggtgtcgtgagaagcagaggaaggaagcttctcgcttgcagacagtgaacagaaagctgactgcaatgaacaagctgttaatggaggagaatgaccgtttgcagaagcaggtttctcatctggtgtatgagaatggttacatgaagcaacagatacacactgcttctgcaggtactaccacagacaatagctgtgagtctgtggtaatgagtggtcaaaaccaacagcaaaacccaacacctcagcatccggctcgaggattatttgtttgtttcagtcttctcgccatagctgaggagaccctggcagagttcctttccaaggctactggaactgctgtcgactgggtccagatgattgggatgaagcctggtccggattctattggaatcgttgctgtttcccgcaactgtagtggcgtggcagcacgagcctgcggccttgtgagcctagagcccactaaggttgctgagatactaaaagatcgacagtcgtggtatcgtgactgtcgatgcgtggatgtgttaagtatagtccccactgggaatgggggcaccatcgagctcctgtacatgcagacatatgcgcccacaactttggctgcagcacgggacttctggacactaagatacacgacaagtttggaagatggaagtcttgtgatatgtgagagatcattgacatcctcaactggtggccccacagggcctccttctacaacctttgtacgagctgaaatgcttcccagtggttttctagttagaccttgtgagggtggtggatccattattcacattgggctccaggttgatttagatgtctggagtgtccctgaagtactgaggcccctctatgaatcaccaaaattcttggctcagaaattgactactgctgccttgcgacatgcaagacaaattgcacaggaatctagtggagatgttcattatggtgggggtcgtcaacctgctgccttgaggacattaatgcaacggctacgcaaagggtataccgatgcctgcaacgggtttgtggatgatggttggtcactgatgggtaatgatggggtggaagatgtgaccatagccataaactcgtctcccaacacgatattcggttcccattacaatacatcaatgctttcagcatttggaggtggggtcatgtgtgccaaggcatcaatgctgctacagaatgatcctcctgctttgcttgttcgttttgtaggggagcatcgttcaaagtgggctaattatgaagttgatgcatactctt

SEQ ID NO: 1103 - DNA, 1271 bp, Glycine max
  misc_feature (255)..(255): n is a, c, g, or t
ccccggcttttgcctttaaggtttcgggtcggattttttttgggaattggaacgggaaaccattttcccccgggaaaaggtaaggccatggttttgcccaggtttaattttaattcctataaggaaaaatgggacgccttcaggttccggttccggatttattttcgggttgggggggtccatatttggggggcgccccttttctttttttttttttttttctgtgttttttttctcagtatttcaatttttatnttttttttttaatttttttttattttgccagtgttggtttttttttaggaataagtaggctatacttcaacaaggagtttatatagtaagaaaggtacatccttggtaaaagcataaagcaaagctaatctaatggcacacacaaccatgagttcatgaaatccagtcattagttacattcgttgttggtgtgacaatatcttagtaaagtactcaaaatataaattaatagatataataaagtatctaaatgatggttcccccatcagacaaaagaccagttcatgaatacgaaggcaaggcagtgattggaatcatcatcatcgagaactttccatgcaatggcctgctcataagacactggtcgattcatacttgatacacatattcctgctggcagatatgcaaatccctgttgcattatcttggagaactcaatgcagagaaacttcctgccagcttcatcaagaactttatccagcattatgtcttgaagagcaacaagagtggtttcaagcatgtcaagtccagcttggtttgcaaaggtgaacactggagatgcatttgtttttacagaacagcacaatattgcatctggatggtgccaaagttgcttcaagattgcatcaccagatgtggactcaacgctgaaaagctctgtgcaggtgtggagcctgtagcttctgcagatccatcttgctaaggtaagagcctctggtggaccaggaaatgactttggccccaactgtgtactgagcctagagggagcaattgccatggcaaccctctgaacagatcgcacaacattacgcacatactggcgagccataacagccacattgtcccgcaaatggttctcaaaggtaaattggaatgcaattgtgaggaccgacctaaggttgtagttattcgagtcactttcaccagctgagcgggcattaccagatcctgtttccagtgttgatgctaagtccaatgtcctagttgaagccaaaccatctgtttatgcaaccaat

SEQ ID NO: 1104 - DNA, 578 bp, Glycine max
  misc_feature (8)..(8): n is a, c, g, or t
  misc_feature (39)..(39): n is a, c, g, or t
  misc_feature (41)..(41): n is a, c, g, or t
  misc_feature (363)..(363): n is a, c, g, or t
ggtccggnaattcccggcgtcgaccccacgcgtccgggngnaagttcagtatggtgggggtcgtcagcctgctgtcttgaggacatttagtcaaaggctttgcaaagggttcaatgatgctgtcaacgggtttgtggatgatggttggtcattgatgggtaatgatggggttgaagatgtgaccataggcataaactcatctcccaacaagtttttcagttcccattacaatacatcaatgcttcccgcatttggaggtggggtcttgtgtgcgaaagcatcaatgctgctacagaatgttcctcctgctttgcttgttcgttttctgagggagcatcgttcagagtgggctaattatggggntgatgcatactcttctgcatgtctcaaagctagtccttatgcagttccttgtgcaagacctagtggtttcccgagcagccatgtcattataccacttgctcatactattgagcatgaggagttcttggaggtagttcgtattgaggctaatgcatttccccctgatgatgtagctttggcatgtgatttgtatttaatgcagctgtgcagtgcaa

SEQ ID NO: 1105 - DNA, 628 bp, Glycine max
ccacgcgtccggaatgccctaagccaagttccttgaggaggcagcaactcatcagagagtgccccatactttccaacattgaacccaaacagatcaaagtttggttccagaatagaaggtgtcgtgagaagcagaggaaggaagcttctcgcttgcagacagtgaacagaaagctgactgcaatgaacaagctgttaatggaggagaatgaccgtttgcagaagcaggtttctcatctggtgtatgagaatggttacatgaagcaacagatacacactgcttctgctggtactaccacagacaatagctgtgagtctgtggtaatgagtggtcaaaaccaacagcaaaacccaacacctcagcatcccaaccgggatgctaacaacccaactggtcttctcgccatagctgaggagaccctggcagagttcctttccaaggctactggaactgctgtcgactgggtccagatgattgggatgaagcctggtccggattccattggaatcgtagctggttcccgcactgtagtggcgtggcagcacgagcctgcgggcttgtgagcctggagccccttaaggttgctgaaattctcaaagatcgacagtccggggtttcgtgactgtcg

SEQ ID NO: 1106 - DNA, 739 bp, Glycine max
  misc_feature (704)..(704): n is a, c, g, or t
catgcttggcagatcgttgcacagattcctccatcctagtttagtgctagaaagagtaaagtatgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacaccacccaaaatactaagcagcagccaaccaaagacacaagctgtgaatcagctgtgacgagtggtcagcagcacaatttgacaactcaacatcccccacgggatgcaagtcctgcagggcttttgtccattgcagaagagactttagcagaatttctttctaaggctactggaactgctgttgagtgggtccaaatgcctggaatgaagcctggtccggattccattggaatcgttgctatttctcacagttgcactggagtagcagcaagagcttgtggnttagtgggactagaacccactagggttgcagaaat

SEQ ID NO: 1107 - DNA, 2901 bp, Oryza sativa
cgttctgagtaaaccacccccaccacgagcacgagcacgagcaaccatggcggtggcagagggagctgcgactgcgagctacgggccatgactgcggcgagttcttgctgggttgttgttgtacaagcagcgacgaggaggatgggagcagaggaggaggaggcggagggatggcagcggcggcggtggggggaaggggggagaggctgtcgtcctcctccccgacggcggcggcgccgcaggtggacgccggcaagtacgtccggtacacgcccgtagcaggtggaggcgctggagcgggtgtacaccgagtgccccaagcccagctcgctccgccgccagcagctcatccgggagtgccccatcctcagcaacatcgagcccaagcagatcaaggtctggttccagaatcgcagatgccgggagaagcagcgcaaggaggcctcccggctgcaaactgtgaaccggaagctgaatgcgatgaacaagctgttgatggaggaaaatgaccggctgcagaagcaggtgtcccgtctcgtctacgagaacggctacatgcggactcaactgcacaatccttctgcagccaccacagatacaagctgtgagtctgtggtgacaagtggtcagcaccatcaacagcaaaacccagcagttctgcatccgcaaagggatgcgaacaacccagcaggtcttctcgctattgctgaggagaccttggcagagttcatgtcgaaggcgacaggaactgctgtcgaatgggtgcaaatggttgggatgaagcctggtccggattccattggaatcatcgctgtttcgcacaattgcagtggcgtagcagcacgagcttgcggccttgtgagccttgagcccacaaaggttgcggagatcctcaaggatcgcccctcttggtaccgcgattgccggtgcgtcgatatcatccatgttatccctacgggtaacggcggaaccattgagctaatctacatgcagacttatgcaccgacaactttggcggcaccacgcgacttttggactctccgctacacaagtggacttgaagatgggagtcttgtgatctgtgaaaggtcattgactcagtccactggtggcccatctgggcctaacactccgaattttatcagagccgaggtacttcccagtggttatctgattcgaccatgtgagggaggtggctccatgatttacattgttgatcatgttgatttggatgcttggagtgtgcctgaggttcttcgaccgctctatgaatctccaaagatccttgcacagaagatgaccattgcagcattgcgacacattaggcaaattgcacatgagtcaagcggtgaaatcccctacggtgctggtcgccagcctgctgttttcaggaccttcagtcaaaggctcagcagaggtttcaatgatgctgttagtggatttccagatgatgggtggtctttgttgagcagtgatggtagtgaggacattacaatttcagtaaactcgtctccaaacaagcttgttggatcccatgtcagcccgaaccctctgttttctactgttggaggtggcatcttgtgtgcaaaggcatcaatgctacttcagaatgtacctcctgctctacttgtgcgatttctgagggagcatcgttctgaatgggctgatcctggtgttgatgcttattctgctgcttctttgcgagccagcccatatgcagttccaggcttaaggaccagcgggtttatgggcagtcaggttatactacccctcgctcataccttagagcatgaagagttcttggaggttattaggctcgaaggacatggtttcagccatgatgaggtgcttctatcacgggatatgtaccttctacagctttgcagcggggttgatgagaatgctgcgggtgcatctgcccagcttgtctttgctcccattgacgaatcttttgctgatgatgcaccactgctaccctcaggcttccgtgtgataccactggatggcaagacggatgcaccatctgcgacacgcacacttgacctggcatctactcttgaggttggatcgggtgggactacacgggcttctagtgacacctcgagcacctgcaacacaagatcggtcctgaccatagctttccatttctcatatgaaaacccccctcgtggaagcgtagcggcaatggccaggcagtatgtccggaccgtggtggcatcagtgcagagagtggccatggcaatagctccttcacgtcttggtggacagattgaaacaaagaaccctccaggatctcctggggcccatacgcttgcaaggtggattgggaggagctaccgattccacactggagcggatctccttcgcacagactcacaaagcacggattcttccttgaaagcaatgtggcaacactctgattcaatcatgtgctgctccctgaaggctgctcctgtgttcaccttcgccaaccaagccggcctcgacatgctggagacgacgctgattgctctccaggacatctcgctcgagaagatccttgatgatgatggccggaaggcactatgtacagagttccccaagatcatgcagcagggtttcgcctacctcccgggcggcgtgtgcgtgtcgagcatggggcggccggtgtcgtacgagcaggcggtggcgtggaaggtcctgagcgacgacgacacgccgcactgcctcgccttcatgttcgtcaactggtcattcgtctgagaaccaccctagtagaatcgatcccccctcttgtttgtctgtcctaaagaccttatgtagtattgcttttgtgtatcatcaccatgaacatgtcaagaacctccccagtttctatcatcatgaacttccgtttgaatctagtactgctaaaaaaaaaaa

SEQ ID NO: 1108 - protein, 148 aa, Oryza sativa
MAASDRPPAQDCRGEGGNFGGGGGRSGGWRQRWRCPMRSGSGSDGSGYDKAGMDSGKYVHYTPGQVEALERVYAECPKPRFSRRQQLLCELSILANIEPKQKIKVWFPKQKWKELIGVPLLKWLLCILIVSHVCFISVFKGLALLKVV

SEQ ID NO: 1109 - protein, 886 aa, Oryza sativa
MDASKYVRYTPEQVEALERLYYECPKPSSLRRQQLVRECPALANVDPKQIKVWFQNRRCREKQRKESSRLQALNRKLTAMNKLLMEENDRLQKQVSQLVYDHGRHGVAAAGMMRRVPAFPPQAAAAAGHQLATATDTSCESVVTSGHHHQQQQHNVVQPPPRDASPAGLMSIAEETLTEFLSKATGTAVEWLQMPGMKPGPDSIGIIAISHGCAGVAARACGLVGMEPAKVAEILKDRPLWLRDCRSMDVVNVLPAGANGTIELLYMQARTHKPENSEPEPEILKLKFVFDLQLYAPTTLAPARDFWLLRYTSILDDGSLVVCERSLSSKQGGPSMPLVQPFIRGEMLPSGFLIRPSDVGGSVIHIVDHMDLEPWSVPEVVRPLYESSAMVAQKISMAALRYLRQVAHEDTRSVITGWGRQPAALRALSQKLTRGFNEALNGLADDGWSVIESDGVDDVCISVNSSKVIGCNATFSSGLPIVSTGVLCAKASMLLQDVSPPSLLQFLREHRSQWADSNLDAFFASTMKPNFCNLPMSRLGGFSGQVILPLAHTFEPEEFLEVIKLGNASNYQDTLVHRDLFLLQMYNGVEESSAGTCSELIFAPIDASFSDDSPLLPSGFRIIPIDSPLDTSSPNCTLDLASTLEAATPRSRISGVNGGGGGCAAAAASSSSKAVMTIAFQFAFDGHLQDSVAAMARQYMRNIISSVQRIAVALSSSRLVPPGAGAAAAQLSPVTPEAATLPRWICQSYRFHFGDELIKSVDANSSNESILKAVWHHPSAILCCSLKAMPVFTFANQSGLDMLETTLVALQDMTLEKVFDDQGRKNLCTELPNIMEQGMACMEGGVCVSSVGRAASYEKAVAWKVVDGDGGGAHCICFMFINWTFL

SEQ ID NO: 1110 - protein, 855 aa, Oryza sativa
MAAAVAMRSGSGSDGGGGGYDKAGMDSGKYVRYTPEQVEALERVYAECPKPSSSRRQQLLRDCPILANIEPKQIKVWFQNRRCRDKQRKEASRLQAVNRKLTAMNKLLMEENERLQKQVSQLVHENAYMKQQLQNPSLGNDTSCESNVTTPQNPLRDASNPSGLLTIAEETLTEFLSKATGTAVDWVPMPGMKVDCQLLRFTLPASNDPGPDSFGIVAVSHGCRGVAARACGLVNLEPTKIVEILKDRPSWFRDCRSLEVFTMFPAGNGGTIELVYMQMYAPTTLVPARDFWTLRYTTTMEDGSLVVCERSLSGSGGGPSTASAQQFVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSVMGGDGIEDVIIACNAKKVRNTSTSANAFVTPGGVICAKASMLLQSVPPAVLVRFLREHRSEWADYNFDAYSASSLKTSSCSLPGLRPMRFSGSQIIMPLAHTVENEEILEVVRLEGQALTHDDGLMSRDIHLLQLCTGIDEKSMGSCFQLVSAPIDELFPDDAPLISSGFRVIPLDMKTDGTPAGRTLDLASSLEVGSTAQPTGDASMDDCNLRSVLTIAFQFPYEMHLQDSVATMARQYVRSIVSSVQRVSMAISPSRSGLNAGQKIISGFPEAPTLARWICQSYQFHLGVELLRQADDAGEALLKMLWDYEDAILCCSFKEKPVFTFANEMGLNMLETSLVALQDLSLDKIFDEAGRKALYNEIPKLMEQGYVYLPGGVCLSGMGRHVSFEQAVAWKVLGEDNNVHCLAFCFVNWSFV

SEQ ID NO: 1111 - protein, 806 aa, Oryza sativa
MAAAVAMRGSSSDGGGYDKVSGMDSGKYVRYTPEQVEALERVYTDWPKPTSSRRQQLLRECPITANIDPNRSRCRDKQRKESSRLQAVNRKLTAMNKLLMEENERLQKQVSQLVHENAHMRQQLQNLYQLGPYASVPLELIYELILRMLLSIAEETLTEFLSKATGTAIDWVQMPGMKPGPDSVGIVAISHGCRGVAARACGLVNLEPTKLYAPPPLVPARDFWTLRYTTPMEDGSLVVCERSLSGSGGGPSAASAQQYVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSIMGGDGVEDVVIACNSTKKIRSNSNAGIAFGAPGGIICAKASMLLQSVPPAVLVRFLREHRSEWADYNIDAYLASTLKTSACSLTGLRPMRFSGSQIIIPLAHTVENEEILEVVRLEGQPLTHDEALLSRDIHLLQLCTGIDEKSVGSSFQLVFAPIDDFPDETPLISSGFRVIPLDMKTLELIEAFGFKYSLGKIKQDGASSGRTLDLASSLEVGSATAQASGDASADDCNLRSVLTIAFQFPYELHLQDSVAAMARQYVRSIVSAVQRVSMAISPSQTGLNAGQRIISGFPEAATLARWVCQSYHYHLGVELLSQSDGDAEQLLKMLWHYQDAILCCSFKEKPVFTFANKAGLDMLETSLVALQDLTLDRIFDEPGKEALFSNIPKLMEQGHVYLPSGVCMSGMGRHVSFDQAVAWKVLAEDSNVHCLAFCFVNWSFV

SEQ ID NO: 1112 - DNA, 687 bp, Oryza sativa
gagcaagaagccgaaaggtaaggatcaggctataacgttggggcattggcaactcaattaaaaggggtagggtagttgtctggttgttcatgttctgatttaactcattagtgttgtgctaaatggaaggtcaagctgctctacatgcaggcaagaacagacaagcctgaaaatttttgtggcaaattcttagctcaacctgaaattccgaagctgaaatctgtattcagtcttcaactctatgctccgacgacgctggcgccggctcacgacttctggctgctgcggtacacctccattctcggtgatggaagcttagtggtgtgtgagagatcactcagtagcaagcaaggaggcccaagcatgccacttgtccagccttttatcagagatgagatgcttcccagtgggttcttgatccgacctagcgatggtggaggcagcgtgatacacatcgttgatcatatggacctggagccttggagcgtgcctgaagttgtgcgacctctgtatgaatcttctgccttggttgcgcagaagatatcgatggcggttgcctacaaagatacccgttctgtgatcacaggatggggaaggaagcttgcggctttgcatgctctgagccaaaaagctcaccacaggcttcaatgaagttctcaatgggcttgcggatgatggatggtccgt

SEQ ID NO: 1113 - DNA, 3498 bp, Zea mays
attgagccaagcagataaggtctggttccagaaccggaggtgccgcgataagcagcggaaggagtcttcgcggcttcaggctgtgaacagaaagttgacggcaatgaacaagcttctcatggaagagaatgagcggcttcagaagcaagtctctcagttggttcatgaaaacgcgcacatgcggcagcagctgcagaatacttcattggccaatgacacaagctgtgaatcaaatgtcactacccctccaaaccctataagggacgcaagtaacccttctggactccttgcgattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggtctgtgagagatccttgagtggttctggtggtggtccaaatgcagcctctacacaacaatttgttagggctgagatgcttccaagtgggtatttagttcgcccatgcgaaggtggaggatcaattgtgcatatagtggaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagttgagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgtgaaaacagatggtgtatcctctggtaggacgctagatttggcatctagtcttgatgtgggctctgctgcaccccaagcctcaggggatgcatctccagatgactgcaatttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgaagtccaacccgtcgggtggttatggcgagctgacccatttttttttttgtatggaaaatcatcagctgtgacaaaaggcatatgttgcatgcactagttgaagaaactggtccaattgcttttttggtctgtcattccattcagatgttgctaggtgtggagtggaaatggggcaatagtgatgcacggctacacatgacccagcattaaccaaacaaccgcgtcgccagtttctttctattcgatcagggagatgcatttttctggcaaaaatcttccattttttttcgttgcaaatttggtctgtatatggaactgctgctggacgccgagaaagcaaaacatatgcggaaactcactatggctcgaggaagatatatgcctacactgtcttcagaaaacataatgcagtaatgcttttcgaacccgaagcacactagacacaaaagccagatgagcaggtaggtccctcgcaaggctgatgccaacaattaaaccgacgacccttcacaacaaaattacgattctttcttctcatcctgctccagttgaggctccttctctgcagcctcctcaaatgtctctccttggacaagctcagggacgtcgtcatcatcctgtgcagctgcttcagcaccaggtacctgcctctggaaaatctcagccagcttcttaaggttgtccaggttatcaggacccagttggttgataattgatggcagaaggtcttgcagactttttgtctggggtactccactaaccacccatgtatttgcaggaatggatgcttgcactttagggttctgaaactggataacaacatcgtccttgaagatgttgacctcctcgataccaggaatggtgttccccccgatccttttcaaggtgctctgaagccgcttgtcatctgtggtcgtggtcttgtgaactgccttcttcttcctgcgcatgctgcccttccctccggtgcgtacagcgccagccatcttcttgagcttctccacattcatcttgcacaggcggcggcggcggcggcggatggagtggtggatggggaggcggaaggggtttgagctacagcaggaagcagatagagatagaagaaggagagtcgagtcggaaggccagtcactgtaacatttaggggctttttccggccgaacctcggggg

SEQ ID NO: 1114 - DNA, 3126 bp, Zea mays
gtcgacccacgcgtccgcccacgcgtccgcctgctcccgcccctcaatcaatcacgacgccacagccgcacccccgcgaaccctagctcgcagtcgcaccgcgcgccggacgctgaccaggtgcctgctctatctcctgcggtggccgtcgcgctgccgccgccagacccgatccgtccgaccgtgccaagcgccccccctccggcgatcgatgcgaggcgccgcgggaggcggctcgggctcgggcaggctgtgagctggagcctgtccgctcgctgcgtcgtgcgcctgccttccctctcacggtcggcctcgccgcgcgtttgctttcccgcccacgcagggatcttcgcgggcggggagttgaagcgcgagatttgcgcggctacgattctgcgttgccgagggagcaagggaaccaatggctgcagcggtggcgatgcgagggggaagcagcgacagcggaggatttgacaaggttcccgggatggactcggggaaatacgtgcgctacaccccggagcaagttgaggtgctcgagcggctctacatcgattgccccaagccaagctcctcacggcggcagcaactgctgcgcgagtgtcctatactctccaacattgagccgaagcagatcaaggtctggttccagaaccgaaggtgccgcgataagcagcggaaggagtcttcgcggcttcaggctgtcaacagaaagctgacggcaatgaacaagcttcttatggaagagaatgagcgtcttcagaagcaagtctctcagttggttcatgaaaatgcgcacatgcggcagcagctgcagaacacttcattggccaatgatacaagctgtgaatcaaatgtcactgcccctccaaacgctataagggatgcaagtaacccttctggactccttgcgattgcggaggagaccttcacagagttcctctcaaaggctactgggacagctattgattgggtccagatgcctgggatgaagcctggtccggattcggttggtattgtggccatttcacatggttgccgtggcgttgctgcccgcgcctgtggtttggtgaatctagaaccaacaaaagtcatagaaatcttgaaagatcgtccctcttggttccgtgattgtcgaagtctggaagtgtttacaatgtttccagctggaaatgggggaacaattgaacttatctacatgcagatgtacgccccaacaactttagttcctgcacgtgacttttggacgttgcgatacacgacaacaatggaagatggcagccttgtggtctgtgagagatccttgactggttctggaggcggtccaaatgcagcttctgcacagcaatttgttagggctgagatgcttccaagtgggtatttagtgcgcccatgcgaaggtggaggttcgattgtgcatatagtggaccatctagatcttgaggcatggagtgttcctgaagtgcttcgaccactatatgagtcttctagagtagttgctcagaaaatgactactgtggcactgcgccaccttagacaaattgctcaagaaacaagtggagaagtagtgtatgccttgggaaggcaacctgcagttctacggacctttagtcaaagactaagcagggggtttaatgatgccattagtggtttcaacgatgatggttggtctgtaatggggggagatggcattgaagacgttgttgttgcttgcaactcaaccaagaaaattaggaataatagcaatgctgggattacatttggagcgcctggaggcattatttgtgcgaaggcatccatgttactgcagagcgtcccaccggcagtactggtccgatttctgagggagcatagatctgaatgggccgattacaatattgatgtgtatttggcttcatcactgaagaccagtgcgtgctcacttcctgggttgcgacccatgagattttctggggggcagatgatcatgccacttgctcacacagtggagaacgaggagattcttgaagttgtccgccttgaaggacaacctcttactcatgatgaagcccttctttcaagggacatccaccttctccagctttgcactggaatagatgagaaatctgtgggttcctccttccagcttgtgtttgcaccaattgatgagcattttccggatgatgctccattgatttcctctggctttcgtgtcataccacttgatatgaaaacagatggtgtatcctctggtaggacgctagatttggcatctagtcttgatgtgggttctgctgcaccccaagcctcaggggatgcacctccagatgactgtaatttgagatctgtgctgacaatcgcctttcaattcccttatgagatgcaccttcaggacagtgttgctactatggcccgtcaatatgtgcgtagtgttgtttctgctgtgcaaagggtgtcgatggctatatctccctcccaatctggtctaaatgctgggcagaggatgctttccggcttccctgaagctgccacacttgctagatgggtttgccagagttatcactaccatctaggtgtggaattacttaaccaatcagatgaagctggtgaagcattgttgaaaatgctctggcatcatccagatgctattctgtgctgctcttttaaggagaaacctatgtttacgtttgcaaacaaggcagggctcgacatgttagaaacatctcttattgcgctgcaagacctgacgctagacaagatcttcgacgagtcaggaaggaaagcaatattctcagatatctcaaaactaatggaacagggctacgcgtacctgccgtcgggcgtgtgcatgtcaggaatgggtcggcatgtctcattcgaccaagctgtagcgtggaaggtgctcggcgaggacagcagcgtccactgcctggcgttctgcttcgtcaactggtccttcgtttgacacgccatcccatggcctgtgtgatgagcaggccaatttttttgtatggtgatcccaatatggggaaaccatcagctgtgacagaaggctttatgttgcatgcactagttgtacgtcttgaatcgagtgtatttatgaagaaattggatactgcgcaaaaaaaaaaaaaaaagggcggccgc

SEQ ID NO: 1115 - DNA, 1816 bp, Zea mays
ccggccgggtggttgcccagaagatgacaaccacagcgctacggcaccttagacaaattgctcaagaaacaagtggagaggttgtatatgcgctaggaaggcaaccagctgttctacggacatttagtcagaggctgagtagaggctttaatgatgctataagtggtttcaatgatgatggttggtccgttatgtgtggagatggcatggaagatgttatcattgcttgcaactcgaagaagatcaggagcagtagcaatcctgctactggttttggagcccctggacctggaggtatcatatgcgctaaagcatcaatgttgctgcagagtgttccaccagcagtccttgttaggttcctgagggaacatcgatctgagtgggcagattataactttgatgcgtattcagcttcagcattgaaaacaagcccttgttcccttcctgggttgcggcctatgaggttttctgggagtcagatcatcatgccccttgctcacacggtggagaatgaggagatcttagaagttgttcgtcttgaaggacagactcttacacatgacgagggccttttgtctagagatatacatctgcttcagctttgcactggaatggacgagaaatcaatgggatcctgcttccagcttgtctttgcaccaatcgatgagcttttccctgatgatgctccattggtatcttcaggctttcgcgtgatcccgttggacataaaaacagacggaccaccctctggaagaacgttggatttggcctctagccttgaagttggcgcaaccacgcaacaagtggcaggggatggatctcaggacgtttgcaacctgcgatctgtgctgacaattgcctttcagtttccctatgaaacacatctccaggacaccgttgcagctatggcccggcaatatgttcgaagcatcgtttctgcggttcaaagagtatcaatggccatttctccctcccattctggcttgaatactgctgggcagaagctaatttctggctcccctgaagctgctacacttgttcgctggatttgccaaagctaccggtatcacttgggggtggatttggtcagccactcggatcaagctggggaatcacttttgacaatgttctgggaccatcaagacgctgtcttgtgctgctctttcaaggaaaagcctgtgtttactttcggcaaccagatgggagttgacatgttagaaacgactttagtcgctctgcaagatctcacccttgacaagatctttgacgagcctggtagaaaggcactacatgcggaggttccgaaactgatggaacagggctatgcgtacctgccggctggggtgtgcctgtctgggatgggccgccatgtctcctacgagcaagctgttgcttggaaagttctcggtgaggacggcaacgtgcactgcctcgccttctgtttcgtcaactggtccttcgtctgatgtgatccaatgcaccgcggaaactttacgatcagcgtccatttttgcattctctgtagacgagaatggtgcggtgttgctgctactgttagctaggcaacggcatgttcaggtaaggtagtcttggggaaagccagtattgtgaagatgtaaatttgcgcccgtttccgctaatttaacccgctgaacttgctgttgtttgttaaggccaggggcactcgtacgtgagattaaatgttgtgaaattgtatgtgctgaaacataggtttacattgaaattggcataaaaaacggaatcatgtgggctaaacggcccctaaaaagttttgatattaattaaggggggtttg

SEQ ID NO: 1116 - DNA, 784 bp, Zea mays
gggccccctctcgagttttttttttttttttttttttttttttagcaaatagtaatactgcaacctgcaacagtgatcaatatcgccggcgacaggccggggagacgagaccactaccaggcacggatacagctgttgtagttgtttgtcacgcacacacacacacacaaacaaacagagtcagttctcgatcatccacacagtacacaaattcttaacacaagcggcacaacggaaaagcaactaatgatacgtagtagggcaaaaggcggcatccggtctggcgctgccgagcgatgttgcgagcctcagatgaaggtccagttggcgagcatgagcgccaggcactgcggggcgccgtcgtcgcccaccaccttccacgccactgcctgctcgtacgacgcctgccgccccatgctcgacctgcacacgccgccggggaggtacgccaggccctgctgcatgatcgcggggagctgcgcggacagggccttctggccctcgtcgtcgaggaccgcctccagcggcaggtcctggatgttcaccatcgtcgtctccaggatgtcgaagccggcgctgttggcgaacttgagcgtgaaagccggcgacttcagagagcagcagagtatcgcgtcgctgtgcttccagaacagcatcagcggagagtccgcgccttcggtgtccgaccagcggatctccgttccggtgtgcgccctgtagctcctgccaatccacgtagctagtgcaagtgcctcgggagagcccggcggatgatatcagttcg

SEQ ID NO: 1117 - DNA, 2346 bp, Zea mays
gatcacaaagattcaatgataacagcagtagtaatagggttaagtctcacacataaacagacagcaggggcattgttctccaactcccgatccaccacagtagacttaggccataaacagacagcaggggggcattgtctcgagcagttgtagtacacaggtgcaacggaaagcaactagtaatacgtagtcggataggataggataaaggcggcaaccgatctgacgctgccgagtgaggcatcgaggctgtgaacgtcaagagcggaggagcatcagatgaaggtccagttgacgaacatgagcgccaggcactgcggcgcgccgtcgtcgcccaccaccttccacgccaccgcctgctcgtacgacgcttgccgccccatgctcgacctgcacacgccgccggggaggtacgccaggccctgcagcatgatcttggggagctgtgcgaccagggccttctgtcccccgtcatcaaggaccgcctccagcggcaggtcctggacattcgccaccgtcgtctccagtatgtcgaagccggcgcggttggcgaacttgagcgtgaaagccggctttagagagcagcagattatggcgtcgctgtgcttccagaacagcgtcaggggagagcccgccgcgtcttcagtgtccgaccagcggatctccgatccagtgtgcgccctgtagctcctgccaatccacgaagctagtgcgagtgcctcgggagagcctggcggatgcttcagttcgacatgcgggccaaggcgagagggagaaatcgccatggccaccctctgcacgatcgccatcactgccctgacatactgcctggccatcgctgccacgctctcgcggaggtggttctcgaacgagaactggaaggcgatggtcaggaccgacctcgtgctgcgcgtgcctgacccgctatcgcttaaagcacacagacctccgcctgatccgacctcgagcgcagaagcaaggtcaagggtacgtgtggcagatggcacatccgtcttagcatcaagcggtatcacacggaagccagagggtagcaacggtgcatcgtcagcaaaagattcatcgataggagcgaagacaagctgtgcacaagcacccggcgcatcctcatcgatgccgctgcacaactgcagaagaaacatatccggggacataagaacctcgtcatggctaaagccatgtccttgaagtcgaataacctccaagcactcttcatgctccacggtgcgtgcaaggggtagtataacctggttgcccataaacccaccagcccttaaacccggaacattatatgggttggccctcagagaggcagcggaataagcatcaacaccagggtcagcccattcagagcgatgctccctcaaaaatcgcacaagtagagcaggtggcacattctgcagtagcattgacgcttttgcgcacatgatgccgccccccatggcagaaaagaatggggaagggctgacatcagacccaataagtttgtttggagatgagttgattgtaattgaaatatcctcagcaccatcactgctcaacaaagaagaccagccatcgtctggaaagccactcacagcatcattgaagcctctgctgagcctttgactgaaagttctgagaacagctggctgtcgcccagcaccatagggcgtttcaccacttgattcgtgtgcaatttgcctaatgtgacgcaacgccgcagcagtcatcttttgtgccagtatcttaggagattcatagagcggtcgaagaacctcagggacactacaagcattcagatcaacatgatccacaatgtaaatcatggaacctcccccatcacaaggtcgaatcagataaccactaggaagcacctcagctcttataaaatctggagttttaggtccagaaggacctccagtggagtgggtcaatgacctttcgcagatcacaagactgccatcgtcaagaccactagtgtatcgtagtgtccaaaagtcgcgcggttccgccagagttgtcagtgcataagtctgcatatagatcagctcaatcgttccaccgttacccgtagggataacatggaggatatcaacacgccgacaatcgcgataccacgatgcgcgatccttaaggatctcggcaacctttgtgggctcgaggctcacaaggccgcaagctcgtgctgctacgccgctgcagttgtgcgaaacagcgatgattccaacggaatccggaccaggcttcatcccaaccatctgcacccagttgacagcagttccggtcgccttggacatgaactccgccaatgtctcctcagcaatagcgagtagaccggacgcgtgg

SEQ ID NO: 1118 - DNA, 1669 bp, Zea mays
cactcccccagttttttttttttttttttttcgagcaagcagaactagcaaatagtaatactgcaacctgcaacagtgatcaatgtcgccggcgacaagccggggagacgagaccacgaccaggcacgcatacagctgttgtagttgtttgtcacgcgcacacacacaaacaaacagagtcagttctcgatcatccacacagtacacaaattcttaacataggcggcacaacggaaaagcaactaatgatacgtagtagggcaaaaggcggcatccggtctggcgctgccgagcgatgttgcgagcctcagatgaaggtccagttggcgagcatgagcgccaggcactgcggggcgccgtcgtcacccaccaccttccacgccactgcctgctcgtacgacgcctgccgccccatgctcgacctgcacacgccaccggggaggtacgccaggccctgctgcatgatcgcggggagctgcgcggacagggccttctggccctcctcgtcgaggaccgcctccagcggcaggtcctgggatgttcaccatcgtcgtctccaggatgtcgaagccggcgctgttggcgaacttgagcgtgaaagccggcggcttcagagagcagcagagtatcgcgtcgctgtgcttccagaacagcatcagtggagagtccgcgccttcggtgtccgaccagcggatctccgttccagtgtgcgccctgtagctcctgccaatccacgtagctagtgcaagtgcctcgggagagcccggcggatgcttcagttcgatacgcgaaccgaggcgagaaggagcgatcgcccatggccaccctctgcacggagggccatcacggcccctgacgtactgcttggccattgccgccacgctctcgcgaaggtggttctcgaacgagaactggaaggcgatggtcaggaccgatctcgtggcgcacgtgccggaaccatcgcatgaagcgcgcatgccgcttccacctgatccaacctcgagcgcagaggcaaggtcaagcgtgcgtgtggtggcggcagttggcacatccatcttagcatcaagcggtatcacacggaagcctgagggcagcaacggtgcatcgtcggcaaaagattcatcaataggagcaaagacaagctgtgcacacgcaccaggtgcatcctcgtcgacgccactgcacagctgtagaagaaacatatcccgggacataaagaacctcgtcatggctgaaaccatgtctttgaagtcgaataacctccaagcactcttcatgctccacggtgcgtgcaaggggtagtataacctggttgcccataaacccaccagcccttaaacccggaacagcatatgggttggccctcagagaggcagcggaataagcatcaacaccagggtcagcccattcagagcgatgctccttcaaaaatcgcacaagtagagcaggtggcacattctgcagtagcattgacgcttttgcgcacatgatgccgccccccatggcagaaaagaatggggaagggctgacatcagacccaataagtttgtttggagatgagttgattgtaattgaaatatcctcagcaccatcggtgttcaacaaacaagaccagccatcatctggaaagccactcacagcatcattgaagcctctgccggacgcgtgg

SEQ ID NO: 1119 - DNA, 3186 bp, Zea mays
ggtccaatcaatttttcaggagcaaaccaggatccatcataagatagcaagcaagcgaagacgaacaactagtacaaagctgtttgttccacgggggtgatgaacaactacaaaggtgtgtttcataggttgcctggacacaggcaaaagcgacggtacatggggtacagagttcaaacaacagagccgcaaacgctaggcaacttggctctactgactactaggggaccgggttctcacacgaaggaccagttcacgaacatgaaggcaaggcagtgcggggtgtcgtcgtcgctcaggaccttccacgccaccgcctgctcgtacgacaccggccgccccatgctcgacacacacacgccaccggggaggtacgcgaagccctgttgcataatcttagggtactcggtgcagagcgcccttcctgccatcgtcatcaaggatcttctcaagggagatgtcctggagcgcaatcagcgtcgtctccagcatgtccaggccggcttggttggcaaaggtgaacacgggagcagccttcagggaacagcacatgatcgagtccgagtgttgccacagcgctttcaaggaagcatccgtgcatttgggtgtcccgtgcggaggagttcggctcccagtgtggaacctgtagctcctgccgatccaccttgccagcgtgtgtgcctcaggagatcctggagtttgcttcatttcaagctgtccaccaatgcgcgaaggagcctattgccatggctaccctctgcaccgatgccaccacggtcctgacgtattgcctggccatggctgcgacgctctctcgtaggtgattttcatatgagaactggaaagcaatggtcagcactgatcttgtgttgcaggtgctggaggcgtcactcgaaagcacgcgttgttccccaccagatccaactcgagggggtagatgcaaggtcaagtgtgcgtgtgcctgatggtggatccgtctttgcatcccagtggaatgacacggaagcctgagggtagcagtggcgcctcctccgcaaaagattcatcgatgggtgcaaacacaagctgtgcacatgccccagctgcattttcatccaccccactgcacaactgcagaagacacatatctcgtgacagaacaacttcgtcatggcagaggctgtgtccctcaagcctaataacctctaagaactcctcgtgctctaaaggtatgtgcaaccggcagaataacctggctgcccgtaaacccactagcacgcaaaccaggaactgcatatgacccagccctcaaagcagcagcggaataagcatcaacaccaggatcagcccatttgggagcgatgctccctcagaacccgtactagtagggcaggtggcacattctgaagcagcattgatgccttagcacacaggatgcctcctccaattgcggtaaacagctgggaggagttgacatgaggaccaataagtttgtttggagaagagttgatagcaatagtaacatcctcagcaccgtcactgctcatcagtgaccaaccatcatctggaaacccattgacagcatcattgaaacccctgctaagcctctggctaaatgttcttaaaactgctggctgtcggccccctaagggaggcatttcccccactcgattcatgcgcaatttgcctaatgtgacgcagtgcagcaatagttgttttctgtgcaagaatctttggggattcataaagtggtctaaggacctcaggcacactccaagcatctaaatcaacatgatccacaatgtgaatcatggagccacctccctcaccagggtcgaattagatagccactaggaagcacttcggctcttacaaaatttggagtgttgggtcctgatggacctccagtcgattgtgttagtgatctctcacagatcacaagactgccatcctcaagaccactagtgtatcggagagtccaaaagtcgcgcggtgccgccaaagttgtcggtgcgtaagtctgcatgtagataagctcgatagttccaccattacccgtagggataacatggagaatatccacacaccgacaatcgcggtaccaagaagggcgatccttgaggatctccgcgacctttgtgggctcaaggctcactaggccgcaagctcgggctgctacgccactacaattgtgcgaaacagcgatgattccaatggaatccggaccaggcttcatcccaaccatttgcacccaatcgacagcagttcctgttgctttcgacaggaactctgccaaggtctcctcagcaatagctagtagaccagctgggttattcgcgtcccgctgaggacgcgggagctgctgggttttgctgttggtggtgctgaccacttgtgaccacagactcgcagctcgtgtctgtagtcgcagcagaaggattatggagctgctgtcgcatgtacccattctcgtagacgagtcgggagacctgcttctgcagcctgtcattctcctccatcaacagcttgttcattgcagtcagcttccggttcacagtctgcaggcgcgaggcctccttccgctgcttctcgcggcatctgcggttctggaaccagacccttgatctgcttgggctcgatgttgctgagtatggggcactccctgatgagctgctgcctgcgcagcgagctgggtttggggcactcgctgtagacgcgctcgagcgcctcgacctgctcgggggtgtagcgcacgtacttgcccgtgtccacctgcggcgccgccgccgccgccgggcgacggccggtccttgccgcccccgaccaccgccagcgccgtcgacatctggctagcaccgccgcccagggaggagtcggagtcggaggaggaggggttgtcgtcgtcgcggggagacggagaatacggagagccacggccacgggcggcgccgagtcatagcctcggggcgagagcgcagccgcccgacgccatggtggtggtgcgagagagagagagagagagagagagagacgagagagagagaggagtggcggcggtgctggggggttgtgcagctgttgcttgcttggctgcctgccgagccgcgcggcgcgcggggagggtgaggaggaggacggaggggaggagcagcggggggaaagggaaagctagcggcgagacggggatgggagagcccggccggcctc

SEQ ID NO: 1120 - DNA, 721 bp, Zea mays
  misc_feature (512)..(512): n is a, c, g, or t
gtcagccacggtgctcctgctgctggtccggaggcagccacgcttgcaagatggatctgccagagttacaggttccatttcggggctgagcttatcaaatccgcagacggtagcggctgtggtgaagcagtgctgaaaactctctggcaccatgccggcgctatactctgctgctctctcaaggccttgccagtgttcacgttcgcgaaccagtccgggctcgacatgctggagacgacgctggtggcgctgcaggacatcgcgctggagagagtgttcgacgaccaagggaggaagaacctgtgcgcggagctccccggcgtcatggagcaggggttcgcgtgcgtccccggcgggatgtgcgtgtcgggcctaggccggccggtgtcgtacgagaaggcgctggcgtggaaggtgctcgacgacggcagcggcggcgtgcactgcgtctgcttcatgttcgtcaactggtcgtttgtgtgacgcgtctgctaccaggtccgtcgcgctcnaggggaaaatcagttgatcggtgacgtgcttgagggtacgtacgtctcaaatcgccctttggttattgggatgtaaaatggtttcggttttttttttgttttttttttgaagaaaaatgtgaaatggtagaaggaaggacctgaatagcagtattgtacacggatggatcgtgtgatgtcaaacaagaatgactttttgtttgatggtg

SEQ ID NO: 1121 - DNA, 674 bp, Zea mays
tccaatggcggccttgcgctatctcaggcaggttgctcacgaagataccgcccattctgtgataaccgggtggggacggcagcctgctgctctacgggctctgagccagaagctcaccagagggttcaatgaagctctgaatgggctcgctgacgacgggtggtctgtgatcggaagtgacggggtggacgatgtctgcgtctctgtcagttcatccccgagtagagtggtcagctgcaatgcaactttcagtaccggacctgtagtcggcactggcagcagcagtgtgctctgcgcaaaggcatcgatgctgagctaggacgtttctccgccagagctcctgcgcttcatgcgggagcagcggtcgcagtgggccgacagcaatctagacgcgttcttcgcttctgcgatgaaaccggatttctgcagcttgcctattcctcctcgccttggagggtttggtggccaggtcatacttcctctagcccacacgtttgaccctgaagaattcctcgaggttataaaagtaggaaatgccggtaactaccaagacgcgctcctgcaccgtgatctgtttctgttgcagatgtacaacggggtagacgagaacatggcaggcacttgttcagagctcatgctttgcccctatagacgcatcgttcagcgacgactcg

SEQ ID NO: 1122 - DNA, 467 bp, Zea mays
ggttccagaaccgcaggtgccgggagaagcagcggaaggagtcgtcccggctgcaggcggtaaaccggaagctgacggccatgaacaagctgctcatggaggagaacgaccgcctgcagaagcaggtctcgcagctcgtctacgagaacggctactaccgccagcagacgcagagcgcggggctggcgaccacggacacgagctgcgagtcggtcgtcaccagcggcccccagaacgtggccgcggtgctgccacaagcccagccgcgcgacgcgggccctgccgggctcatgtccatagcggaggagacactgacggagtttctgtccaaggccaccggcaccgccgtcgagtgggtccagatgcccgggatgaagcctggtccggattctattggaatcattgccatctcgcatggctgccccggtgtcgccgcgcgagcttgcggcctcgtgggcatggagcct

SEQ ID NO: 1123 - DNA, 1896 bp, Glycine max
gtcgacccacgcgtccgccctcgcgtccgcccacgcgtccgtacgggcgagaagacgccagaagggggaactccaaaacacaaacaaaaactcccgttttctctctctgtttttccatggccatctgatcaaacttttcttgattctctctctcagtttttgctattctgagtgatgggtatgccctgccgctgttcccacacctcccacatcactgaaatcatcatcaccagcttcttccgccacaagtcttaaattacaacaatttccctcaattattcatcaaccaaccaccttaatagccttttccaatggttccttaaagatccaacttggtcggagtaaacatggcggctagtggaagttccttttccaacatcactagcttccttcgcaaccaacaaccctcttcccaacctctcgattcttctctcttcctctctgctccttcaatttttgtttcaggttcgagatccatggtgagttttgaagcagaaggagggaaggggtgtaacggctccttcttccgcgcgtttgacatggacgacaatggggacgagtgcatggatgagtactttcataaacccgagaagaagcgtcgtctctccatgaaccaggttcagtttctggagaagagtttcgaggaggagaacaagcttgaaccggagagaaagaccaagcttgccaaagaccttggtttgcggccacggcaagttgctatttggttccagaaccgtcgagctcgctggaagaccaagacgctggagaaggattacgaggctctgcatgcaagttttgagaatcttaagtccaactatgacagcctcctcaaggagaaagacaacttaaaagctgaggtggcgagcctcaatgagaaggtgcttgcaagagggaaacaagaggggcacatgaagcagcaggctgaaagtgaagaagaaacaaaaagattattgcatttgcaggaacaggaaccaccccagaggcttttactggaatcagtttcggagggagaaggatccaaagtctcttctgttgtcgggggttgtaaacaggaagatatcagttcagccaggagtgatattttggattcagatagtccacattacaccgatggagttaactccgcactgctagagcatggtgattcttcttatgtgtttgagcatgatcaatcggatatgtcacaagatgaagaagataacctcagcaaaagtctctacccttcgtacctctttcccaaacttgaagaagatgtggattactccgacccgcctgaaagttcttgtaattttggattttctgaggaagatcacgccctttggacctgggcatactaagttttcttccatgttcatgtgtgtgtttgtgtcatatgtttttttagtaattagtatttagtatttgcactttttgtccaggcttcaaaaatggctatagctttagctttatcaggaaagaaatgtttgttttctttttgcctcattttgttagtacttgtaatcaaactgttggttccaatgtaattaaataatgtcttctcgttgagaatgtaactatggatttcatttaatttcactaagaaaatcaagtaagaaacttgatgaaatggggaaaaaaaaatggaagccaattgcttggtagagtggaaaagattgaggcctatagtatttatactatttaagatgactatgattcattgattcttcttcacttgggttctggacttctgggtccatgttgttttgattggtaagcaaccctgcatgacgaagttgacttgcttgcacctttgcaatactttcctacttgagagcatttaagttttgtgacagaaggggtgtcactttcactatgaattggacaaaaatggccactctccattggatgaggatcacc

SEQ ID NO: 1124 - DNA, 1042 bp, Glycine max
cggtccggaattccccggtcgacccacgccgcacaaacacatacaaacatagtatccgcttctctctctctctctctctctctttttccatgtccatctgataaccctttcctgattctctttcgtggttgttgctattctgagtgatgggtatgccctgccgctgttcccacacctcccacatcactgaaatcatcatcaccagcttcttccgccacaagtcttagatcaacaatttccgtcaattattccaaaaccaccttaagagccttttccaaatggccccttaaagatcgaacttggtcggagtaaacatggcgggtagtggaagtgccttttccaacatcactagctttcttcgcacccaacaaccctcttctcaacctctcgattcttctctcttcctctctgcaccttcctctgctcctttcctcggttcgagatccatgatgagttttgaaggagaaggagggaaggggtgtaacggctccttcttccgcgcgtttgacatggacgacaatggggatgagtgcatggacgagtactttcatcaacccgagaagaagcgacgtctctctgcgagccaggttcagtttctagagaagagcttcgaggaggagaacaagcttgaacccgagagaaagaccaaactggccaaagacccttggtttgcggccacggcaagttgctatttggttccagaaccgtcgagctcgctgggagaccaagccgctggagagggattacgaggctctgcatgcaagttttgagaatcttaagtccaactatgacagcctcctcaaggagaaagacaacttaaaagctgaggtggcgagcctcaatgagaaggtgcttgcaagagggaaacaagaggggcacatgaagcagcaggctgaaagttcttgtaattttggattttctgaggaagatcacgccctttggacctgggcatactaagttttcttccatgttcatgtgtgtttttgtgtcatatgtttttttagtaattagtatttagtatttgcactttttgtccaggctt

SEQ ID NO: 1125 - DNA, 1772 bp, Glycine max
tacggctgcgagaagacgacagaagggggaagaatctctctttatttctttcactctctcagaaccaaaattttccaaactcctcaactctcatcagatatcaaccttctctctctccaaactctcgcacctttctgctctgcccttcaatttattcatctctgacaccctcttaattctgcttccagttcctctgagtgatgggttcaaaacccgtggttgattttgagaatgtaagtgggagcaggatgacggataggcctttttttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaggtccaacttgcaaaagagcttggcttgcagccaaggcaagttgctatatggttccaaaaccgaagggcaaggttcaagaccaagcagctagaaaaagactatggcgtgttgaaagctagttatgacaggctcaaaggtgactatgaaagtcttgttcaagagaatgacaagttaaaagcagaggtgaattctctggagagcaaattgattctttgttaaaagcagaggtgaattctctggagagcaaattgattcttagagataaagagaaggaggagaattcggatgacaagtcatctcctgatgatgctgtcaattcttcaccccacaacaacaaggagcctattatggatttattaatttcaaaaaatgcaacaacatctgaaaatggaaccgaagtgtcaacactcccactccctattatggtaacatgcaagcaagaagatgccaattcagccaaaagtgatgtgcttgattcggatagcccacattgcactgattatgggaaccacccttcctcattcgtggagcctgctgattcctctcatgcctttgaaccagaagaccactcagaagacttctcacaagatgaagaggataaccttagtgaaaactttttgaccctcccttcttcttgttgcttacctaaggttgaagaaccctgctatgatgaccctccagaaaactcttgtaattttggcttccatgttgaggatcaaaccttctgtttctggccctactgaaccaaccaaccaaccaaccgcttccaatgttataaaaacttcgcagttgtaaccatgtactagaaatcaataaaaatggtattgttacttctactaaggaataaaaatcagaaggctaatgcaatgcatcatgctatcatcactggtggtgttaatagttagcagtgaaagtgtaacacaatgttactactagctaaaattcaaaaacttggttcaggtgtgcgcgtaggtatcccaaaatttcaggtggggtacagcaaccaatcgttgttttactttcggatgtggaaaatggaaaccctgttttctctttctctctgcactcctctggatcacaccgttgttttactcatgtattaggaagaccctttcatcatgattcacctgtcctcactgctcagcataaagttacagttttatatgcgtcccagtaatcattagagtcatcatagcaaccagagtttgagtagattaaataagatctcacattcaaattttcctgttgttattggacactgagaaaaacttgtgtctaagttgatgatgattatgtaagaaatatttggcatattttaatgaaattgaaaaactaaataaaaaaaaaaaaaaaagg

SEQ ID NO: 1126 - DNA, 1625 bp, Glycine max
ttaagagggtttctctctctttatttctttcactctctcagaaccaaaattttccaaactcctcaactctcatcagatatcaaccatctctctctctccaaactcaaatacctttctgttctgctcttcaatttattcatctctgacaccctcttaattctgcttccagttcctctgagtgatgggtatgatctctcctcactcccacaattcccacattatagtaatcctcatcacctgcttctttcgtcataaattctagatcaaactccactccctgatcctcccttttacttcttatgtagcatgtatgaactcaaatcatcaaatgaatatgaccctttaatctaagaagaagaaaaaaacacacacatacacacacacactttaaagtccaaagtctaaaccaacccaccaaaagtcttgttcccatggcgagtggcaagctttatgcgggttcaaacatgtcacttctcctccaaaacgaaaggctcccttgctcctctgaagtccttgagtctctttgggctcagacctctaaccctgcttccttccaaggttcaaaacccgtggttgattttgagaatgtaagtgggagcaggatgacggataggcctttctttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaagtccaacttgcaaaagagcttggcttgcagccaaggcaagttgctatatggttccaaaaccgaagggcaaggttcaagaccaagcagctagaaaaagactatggcgtgttgaaagctagttatgacagactcaaaagtgactatgaaagtcttgttcaagagaatgacaagttaaaagcagaggtgaattctctggagagcaaattgattcttagagataaagagaaggaggagaattcggatgacaagtcatctcctgatgatgctgtcaattcttcttcaccccacaacaacaaggagcctatggatttattaattatttcaaaaaatgcaacaacaacaacaacatctgaaaatgggaccaaagtgttgtcaccactcccactccctattatggtaacatgctgcaagcaagaagatgccaactcagccaaaagtgatgtccttgattcggatagcccacattgcacttcattcgtggagcctgctgattcctctcatgcctttgaaccagaagaccactcagaagacttctcccaagatgaagaggataaccttagtgaaaaccttttgatgaccttcccttcttcttgttgcttacctaaggttgaagaacactgctatgacggccctcctgaaaactcttgtaattttggcttccaggttgaggatcaaaccttctgtttctggccctattgaaccaaaccaaccaaccaaccgctagcaatgttttaaaaaactttgcagttgtaaccatgtactagaaagcaataaaaatggtattgttacttctactaaggaataaaaaaaaaaaaaaaaaaaaaggacgaccgctaagggggacccctgtatagg

SEQ ID NO: 1127 - DNA, 1240 bp, Glycine max
cttcaatttattcatctctgacaccctcttaattctgcttccagttcctctgagtgatgggttcaaaacccgtggttgattttgagaatgtaagtgggagcaggatgacggataggcctttctttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaagtccaacttgcaaaagagcttggcttgcagccaaggcaagttgctatatggttccaaaaccgaagggcaaggttcaagaccaagcagctagaaaaagactatggcgtgttgaaagctagttatgacagactcaaaagtgactatgaaagtcttgttcaagagaatgacaagttaaaagcagaggtaaaagaaattaagaagaaaaaagagagagacacacacaacacatacttacactcaattttgcttttgtgctttatgctactagtactacttgctttaataaagtgcaatctttattatttatcccactaatgggttaatgattggattggcacaaaatttttgttactgacaggtgaattctctggagagcaaattgattcttagagataaagagaaggaggagaattcggatgacaagtcatctcctgatgatgctgtcaattcttcttcaccccacaacaacaaggagcctatggatttattaattatttcaaaaaatgcaacaacaacaacaacatctgaaaatgggaccaaagtgttgtcaccactcccactccctattatggtaacatgctgcaagcaagaagatgccaactcagccaaaagtgatgtccttgattcggatagcccacattgcacttcattcgtggagcctgctgattcctctcatgcctttgaaccagaagaccactcagaagacttctcccaagatgaagaggataaccttagtgaaaaccttttgatgaccttcccttcttcttgttgcttacctaaggttgaagaacactgctatgacggccctcctgaaaactcttgtaattttggcttccaggttgaggatcaaaccttctgtttctggccctattgaaccaaaccaaccaaccaaccgctagcaatgtttttaaaaactttgcagttgtaaccatgtactagaaagcaataaaaatggtattgttacttct

SEQ ID NO: 1128 - DNA, 1296 bp, Glycine max
  misc_feature (1172)..(1172): n is a, c, g, or t
  misc_feature (1179)..(1179): n is a, c, g, or t
cgtaagccccgcgtttgcgcccacgaaagcactcacaaagacacagagtgcgttcgttgacgacaaacacacacaaacacacaacaaaagctcgccggaaaatctttctccggcgacctggaattccgacgaaggtagttgcggctccttcgtcccgaaactgaggccctcaaagtataaactttggtggtggtgggtaggatctggcggtgtatgatgggatcttgcatatgcccgttggagactccggcgaggttgctttggaccacaagcttcttccgtcataagcttatgatcttctaataattaataattcacgcacacaaacaaacaaacaaacaaacaaaaaacacttcataacaacaacaacaacccttctgaaattctcaacacaagtttcaaaaaacagagtaaaagaaacagagcaaaaacacacacacaaaaacacaaacacagacaccttttaagtattaaggtgtctctttctctccccggaaagtttctccgtcggcggtggtgattgaccggagtgccatggagtctggacggattttctttggtgcctctgcttcaagcggcaacaacatgctctttctcggcaacactgaacttgcttttcgagggagatcgattatgagcatggaggaagcctcgaagaggcgacctttcttcacctcaccggatgaactgtatgatgaagagtattatgagaagcagtcgccggagaagaagcaccgcctcagttccgaacaggtccatctgttggagaagagctttgaggaagagaacaaattggagcctgagaggaagacccagttggctaagaagctgggattgcagcccaggcaggtggctgtgtggtttcagaaccgcagggctcgatggaagaccaagcaacttgaaagggattatgatgttctcaagtcttcatacgataccctactttcatcctatgattcaattatgaaggagaatgagaaactcaaatctgaggtggtatccttaaatgaaaagcttcaagttcaagctaaagaggtgcctgaggaaccattatgtgacaagaaagttgatccaattccagtagatgaagatatggctccgattttcggcacaagggtggaggaccacctgagtagtgggagtgttggaagtgcggtggtggatgaaggtantccacangtagttattaacaatatgtattcatacattctatctaacaactattataaatatataaacccgtatcgagagattcaatcggatgagaatgatagcagtaatgattatcagacgtgc

SEQ ID NO: 1129 - DNA, 1033 bp, Glycine max
aagacccagttggctaagaagctgggattgcagcccaggcaggtggctgtgtggtttcagaaccgcagggctcgatggaagaccaagcaacttgaaagggattatgatgttctcaagtcttcatacgataccctactttcatcctatgattcaattatgaaggagaatgagaaactcaaatctgaggtggtatccttaaatgaaaagcttcaagttcaagctaaagaggtgcctgaggaaccattatgtgacaagaaagttgatccaattccagtagatgaagatatggctccgattttcggcacaagggtggaggaccacctgagtagtgggagtgttggaagtgcggtggtggatgagggtagtccacaggtggttgttgacagtgttgattcatacattctagctgacaactatggtggatgtgtgggcccggtcgagagggttcagtcggaggaggaggatgggagtgatgatgggaggagttacttggatgtgtttgtggtatctgaaactgagcaccaaaaccatgaggaaggagagacattgggttggtggactaatatgtattatgttggataaaatggtaatgcagcagtgctttcgaaattagatgcttaattaagaaaacgtaataatattgtataatgtatcatgtgggcgagggaggaaaaagtaaacgcctggattgggtggcttggacccctaggaggagttgaagtgtccttaacccgagtttaataaataaagtctagtagtaatttggtcaatggtgtcttgtgttggttaatggttgtactgccaaaattaaagtaagtatatttcttgttcaagtattaaaacatggttaattagtactatacaaaatttgggcggtttcttttttttttttgaatccaattttcgaaaaccattttgccaacttaatcaaaataaaatcgggggtaaggcccccaaaaaaggcaaagccctccccattgtcttgtaacccgtttcgaatagggcctattagcaaaaattattttccccccct

SEQ ID NO: 1130 - DNA, 1740 bp, Glycine max
ggctcgagatcatccccgtattataaacccaggattgcctcttcttccaggaaccccctcaacaaaaggaaactctcattcaccttcttctctctccctcactccctctctttcttaatacaccaccttcccaaccctcttccattctccttctccaactccaacccctgcttcccttttttcattttctcactccccatcttctgagagtgatgggtgtttgctaccgctgttcccacacctcccacatcaccgccatcatcatcaccagcttcttccgccacaagccttagaattatactattcccaccctccctctttcttcaacaacaaccgttgacttcactacagtcacgtggtctttctctgaggatccaaccatggcggctggaactgtcttctgcgctgctgctactgctgcttctaatttgacaacaaccacttttcttcacaaccaaacacctccttccacctcctctcagcctcctctcgattctcttttcctctctgcctcttcccctttcctcggttcaagatctatagtgagttttggagatgttcaaggagggaaggggtgcaatgattcattcttccgcccctatgatgagaatggggatgaggacatggacgagtacttccaccagcctgagaagaagcgcaggctctccgtggagcaagtgaagtttcttgagaagagctttgatgaggagaacaagctcgagcccgagaggaagatttggctagccaaggaactcggcttgcagcctaggcaggtggcgatttggtttcagaaccgccgcgcgcgctggaagaccaagcagatggaaaaggactatgattccctgcaggctagttacaatgatctcaaggctaactatgacaaccttctcagggaaaaggataaactcaaagctgaggtggcaaggctcactgagaaggtgcttggaagagagaaaaatgagagtcacttggaacaggctgaaaccaacggattgcaggagccgctgcacaagtctttggttgattcagcttctgagggtgaagggtccaaagtgacctttgaggcttgtaaacaggaggacattagctcagccaagagtgacatatttgattcatcagaaagcccacaatacactgatggagttcactctgcacttctagagactggtgattcttcttatgtgttcgaacctgatcgatctgatgtgtctcaggatgaagaagataacttgagcaagacccttctgcctcattacatttttcccaagcttgaagatgttgattactccgacccacctcatggttcatgtaattttggaattccggaggaagatcaagccatttggtcttggccttactgaattttctctatagcatatagagcatgtctctaccttctactctcaagttcttctgtttaaacttgagatcatgtggtagaaaagggtgagttaataataagccaaagaaaaaatggcactctactggtttgttcccaatggtggtttcttgccagctttttttttttttttttttactttgcaatgtaacttttggttcaaatgtaaataaataatatcttcttgttgaggatgtagctctgaatatcacttcaaggatgaatttacatagcaaattagatgagaaaaatgggaagataaaaaaaggttatgttttcaaaaaaaaaaaaaaaaaaaaaaaaaaaaaaaaaaaaaaaaaaaaaaaaaaaaaaaaaaaatt

SEQ ID NO: 1131 - DNA, 1858 bp, Oryza sativa
ttgacgcctgggcggacgcccataaaaatcccaaaaacaaaaaataataaaaaaaaagaaagagagagacatttcgcatctgctgccctgcctcctctcccatcacctgcccattttttcacattgaggcccctctgaaaatattatatttacaactaggtccctggccgggccggccggccaccggaaggagcacctcgccggagaaggctttgtctcttctttttcttctcctcctcctcctccatcggcggcggcatggggttctcgctgtaccccatgaagacgtcgacgcgcatgctgtggagcaccagcttcttccgccataaggtcgcctcctccttctaagcccacgccctctcgggcggcggcggcgagccggcggcggagcgcgcggttggtaggtgcgcgtgcgtgcgtgaacgggagagcagcttcgagatcgggttttcttgggttcttggagaagggaggagaagagggggaggagagcatggatcccggccgcgtcgtgttcgactccggcgtggcgcggcgggcgtgccccggcggcgcgcagatgcttctcttcggcggcggcggcagcgccaacagcggcggcttcttccgaggcgtgccggcggcggtgctggggatggatgaatcgcggtcgtcgtcgtcggcggcgggggcgggggcgaagcggccgttcttcacgacgcacgaggagctcctggaggaggagtactacgacgagcaggcgccggagaagaagcggcggctgacggcggagcaggtgcagatgctggagcggagcttcgaggaggagaacaagctggagccggagcggaagacggagctcgcccgccgcctcggcatggccccccggcaggtcgccgtctggttccagaaccgccgcgcccgctggaagaccaagcagctcgagcacgacttcgaccgcctcaaggccgcctacgacgccctcgccgccggccaccatgccctcctctccgacaacgaccgcctccgcgcgcaggtatctcattaaccgagaagctgcaagacaaggagacgtcgccgtcgtcggcgaccatcaccaccgcggcgcaggaggtcgaccagccggacgaacacacggaggccgcgtcaaccaccggcttcgccaccgtcgacggcgcattggcggcgccaccgcccggccaccagcagccgccgcataaagatgatcttgtgagcagcggcggcaccaacgacgacggcgatggcggcggcgcggccgtggtggtcttcgacgtcaccgagggcgccaacgaccgcctcagctgcgagtcggcgtacttcgccgacgccgcggaggcgtacgagcgcgactgcgccgggcactacgccctctcgtcggaggaggaggacggcggcgcggtcagcgacgagggctgcagcttcgacctccccgacgccgccgccgccgccgccgccatgttcggcgccgccggagttgtgcaccacgacgccgcggacgacgaggaggcgcagctcggcagctggaccgcctggttctggagctgatcgatggaagcatggagcattggagccatgctatcaatgaatgaatgaatcaaatgaccttgagaccctcctctccgtcctttcttttgccctatttttaatcgctgttatatgttaattatgtgcaattaaagtgtacgtgttttgtcgtaagttgtgtttgttcaaattgtatgttttgaaggtgtcatgtattcatacacgatatgatatatagacgggatcatgaatgatactcggaaagattggaataaaaaaaaaaaaaaaaaaaaaaaaaaaaacattttcctccggggggcctcgtgcaaaaaaa

SEQ ID NO: 1132 - DNA, 1926 bp, Oryza sativa
gtccggccccccgcgtccgcccacgcgaaaaaaatattataggaaataaaaaataatttcctggttagaataaacacatttttaaaaaaaccaagaaaagattttcctcttctgttacattccttcttccttctccggccaccggagccgtagccgaattgtgcctcttctccggcgaggggagagggagagagggggtgtgagttttgctccttccggcgagtggtctcctccccgcgcggctgaggagatctctcgggacatcggggttggggcggcgtgcatgatggggttctcgctcacgccgatgaagatctccacgaggcttctgtggagcaccagcttcttccgccacaagatcgccgccaccatcgcgtcctcctcctccttcttataagatcatcttctccgccacagcaatctgtaaatatatacacatcgaacgcgacaagcgcgtttgattgattggatttttctcccctctcctcacgacaagtaattaaggcgcgcgatctcgatctctagcgttgagaacttgatccgcgatggagtccggccggctcatcttcagcacggcgggctccggcgccgggcagatgctcttcttggactgcggcgctggcggcggcggcgtcggcggcggggccatgttccatcgaggggcgagaccggtgctcggcatggaggaaggagggcgcggcgtcaagcggcccttcttcaccacccccggcacgaggctcctcgaagaggagtactacgacgagcagctcccggagaagaagcggcgcctcacgccggagcaggtagatactccagctagctagctaagctgtaaagatcggcggcgcgcggtgctctgttcccgagttgtgacgtgacgactggatcgatcggcgtcggcgtgtgtgtatgtatgtgcatctgctggagaggagcttcgaggaggagaaacaagctggagccggagcggaagacggagctggcgcggaagctatggctgcagccgcggcaggtcgccgtgtggttccagaaccgccgcgcgcgctggaagaccaagcagctcgagcgcgacttcgaccgcctcaaggcgtcgttcgacgccctccgcgccgaacacgaagccctcctccaggaaaaccaccgcctccactctcaggtgagctagctacgcccgccgcccgcgccaccgcccaaccgcgcgttatcctcgatccgatttggccgggctccttgattctgactgaattcgtggtgatcttgtgccgtcaggtcatgttctttgaccgagaagctgccagagaaggagacgacgaccgagggcacccccggcgccggccgttgacgtccccgggctgccctgcggccgccgacgtgaaggtccccgtcccggacgccgaggaaccggcgctggaggaggcggcggcggcgttcgaggagcagcaggagcagcaggtgaaggccgaggacaggctgagcacgggcagcggcgggagcgcggtggtggacacggacgcgcaactggtggtcgggtgcggccggcagcatctcgccgccgtggacagcagcgtggagtcgtacttcccgggcggcgacgagtaccacgactgcgtgatgggccccatggaccacgccgcggggggcatccagtcggaggaggacgacggcgccggcagcgacgagggctgcagctactacgccgacgacgccggcgtccttttcgccgaccccggcccccccccccccccccaacacgcggacgacgacgaggagggcgggccccccgatcagctgctggtggatgtggaactagatttctcgcgcgcgcgcgtcgtcgggccttcaattctcgtgttaaaaaaaatcgttctctttttcctttttcaaaaaaaaggggggcccggcacccaatccctcccctcccccccc

SEQ ID NO: 1133 - DNA, 1500 bp, Oryza sativa
cagcaatctgtaaatatatacacatcgaacgcgacaagcgcgtttgattgattggatttttctcccctctcctcacgacaagtaattaaggcgcgcgatctcgatctctagcgttgagaacttgatccgcgatggagtccggccggctcatcttcagcacggcgggctccggcgccgggcagatgctcttcttggactgcggcgctggcggcggcggcgtcggcggcggggccatgttccatcgaggggcgagaccggtgctcggcatggaggaaggagggcgcggcgtcaagcggcccttcttcaccacccccgacgagctcctcgaagaggagtactacgacgagcagctcccggagaagaagcggcgcctcacgccggagcaggtgcatctgctggagaggagcttcgaggaggagaacaagctggagccggagcggaagacggagctggcgcggaagctagggctgcagccgcggcaggtcgccgtgtggttccagaaccgccgcgcgcgctggaagaccaagcagctcgagcgcgacttcgaccgcctcaaggcgtcgttcgacgccctccgcgccgaccacgacgccctcctccaggacaaccaccgcctccactctcaggtcatgtcgttgaccgagaagctgcaagagaaggagacgacgaccgagggcagcgccggcgcggccgttgacgtcccgggcttgcctgcggcggccgacgtgaaggtcgccgtcccggacgccgaggaaccggcgctggaggaggcggcggcggcgttcgaggagcagcaggagcagcaggtgaaggccgaggacaggctgagcacgggcagcggcgggagcgcggtggtggacacggacgcgcaactggtggtcgggtgcggccggcagcatctcgccgccgtggacagcagcgtggagtcgtacttcccgggcggcgacgagtaccacgactgcgtgatgggccccatggaccacgccgcggggggcatccagtcggaggaggacgacggcgccggcagcgacgagggctgcagctactacgccgacgacgccggcgtcctcttcgccgaccacggccaccaccaccaccaccaacacgcggacgacgacgaggaggacggccagcagatcagctgctggtggatgtggaactagatttctcgcgcgcgcgcgtcgtcgtgcattcaattctcgtgttaaaaaaatcgttctctttttcatttttccgcttctttgtctgtaatgttgagtttcgatcggctatgagaaggaaggaggtgtatgcatgtgcatggtatggtagggtaacacatcggtgaatcaaatctgtcatggtgatgtacgagaattgaagaacatgggggtagcaataagtgcatggaggcaagtactcttttcaatggcacataccaaatcatgtcgtcgaattgagatttttattagtcttgaattcttcttgaaaaaaaaaaaaaaggggcctcgtgcgggaggg

SEQ ID NO: 1134 - DNA, 691 bp, Zea mays
  misc_feature (6)..(7): n is a, c, g, or t
  misc_feature (646)..(646): n is a, c, g, or t
  misc_feature (649)..(650): n is a, c, g, or t
  misc_feature (654)..(657): n is a, c, g, or t
  misc_feature (662)..(665): n is a, c, g, or t
  misc_feature (680)..(682): n is a, c, g, or t
ggttgnngttgttctcatacatcgcacatcaccgccatcataatcaccagcttctttcgccataagccatagatctttcgatggttgcttgataatatcgtctgaagtctaaggaggaggagaagaagaagaagaagaagggttcctgatatggcggcgggtgggaatgtttcttcaaatttatgtactttgcttaagaatcaaactgttccttgcacttctcagcctcttgattctcttttcctttcttcctcttatcattttctcggttcaagatctatagtgagttttgaagatgttcaaggagggaaggggtgtaatggctctttcttccgtcattatgatcttgatgaaaatgtggatgaagacatggacgaatacttacatcgacctgggaagaaacgtaggctctcggtggaacaagttcatttccttgagaagagctttgaggaagagaacaagcttgaacccgaaaggaaaactagactagccaaggaacttggtttgcaacctcggcaagtggcgatttggtttcaaaatcgtagagctcgatggaaggcaaaacaattggagaaggattatgattccttgctagctagctataacgatcttaaagccaattatgacaatcttttgagggagaagnatnnattnnnnagcgnnnngtcaagactcactgnnnagatgcttg

SEQ ID NO: 1135 - DNA, 810 bp, Zea mays
  misc_feature (34)..(34): n is a, c, g, or t
ggccggccgggggagtgatttctgaccacgcctnttgagacttcaagtgggcaacgtttctcgcctctcagcgcaaaaagatagatcctctgctctaccggcctaccacgttcgtctcccgcgccggccacccaccgctgccaccgaggtctggacggctcatcttcaacgcgccgggctctggcgccgggcagatgctcttcctcgactgcggcgcaggcggcggtcccggcggcggcttgttccatcgaggcgggagaccgatgcttggccttgaagaagggcgcggcgtaaaacggcccttcttcacctcgcccgacgagctcctcgaggaagagtactacgacgagcagctgccggagaagaagcgccgcctcaccccagagcaggtgcttctgctggagaggagcttcgaggaggagaacaagctggagccggagcgcaagacggagctggcgcgcaagctgggcctgcagcctcgccaggtggccgtctggttccagaaccgccgcgcccggtggaagaccaagcagctcgagcgcgacttcgaccgcctcaaggcctccttcgacgctctccgagcggaccacgacgccctcctccaggacaacaaccgcctccgctcacaggttgtgtcgttgaccgagaagctgcaagagaaggaggatgcgacggagggcggcgccaccgctgacaccgccgcgcccggcggtggacgtcgaggcttccctggccgacgacgtcgaggagccagcaagccctgcggcgacgttcgaggtgtgccaggaagtgaagtccgaggacaggctg

SEQ ID NO: 1136 - DNA, 1671 bp, Zea mays
catcggggcctccgggccggccgggcctttagcagcgaaattcacccaaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcgcgcggcggggcggcggcgcgcagatgctgctcttcggcggcggaggcagcgccaacagcaacggcttcttccgaggtgttccgatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtgatctccctgacggagaagctgcaaggcaaggagacatccccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagtttttgtatgttcatatatataataatgtgcttcgaacatgacactcgaaaagttgaataattggacatgtcgacctgctgtgcactagcagctggcatgttttgtttaaaaaaaaaaaaaaaaaaaaatcgagaagggaattcatatttttcaaagggaaatgaactaattttacttaggaa

SEQ ID NO: 1137 - DNA, 1697 bp, Zea mays
cattgggtacctcgacgccggccgggcttttgtgtatatatatttcttgttattttcaaaggattaaaaaaaaaaaaaaaaaagccattggggaccgcgaccccggccggggccggtagccacaaatttcacccaaaaccaaaaaaaatcccaaattaaagaaaacgaggagaagaaaaacaactttcatcgccgtccgccaccggagctcccttcgtcggccttccttcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgggtttgcgttcttgggtttcaagattggcttttgttgcgttcttggcgagacgaagggactagggcgcggacaaagaatcagcatgcatccgagcgcggtcagtttcgactccggcgacgggcgggcggcgcggtggcgcgcagatgctgctcttcggcggcggaggcagcgccaacagcaacggcttcttccgaggtgttccgatggcagtcctggccatggacgacgcgacgcgcgtgggcaagcggcccttcttcacgacacacgacgagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatggctacccaagaggtcgaccagccagacgaacacaccacaggcactgagaaattgctggcgcagcagctcaaggacgacctgcacagcagctgcggttgcactggacatggtgccctgtcttcggaggaagaggatggtggcgtggtcagcgatgagggctgcagctttgatctccccgacgccatgtttgctgttggggtcaccaaccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgccctagccgccaaaaaaaaaaaaaaaaaaaaaaaaaaaaaaaaaaaaaaa

SEQ ID NO: 1138 - DNA, 1950 bp, Zea mays
  misc_feature (12)..(13): n is a, c, g, or t
  misc_feature (16)..(18): n is a, c, g, or t
ccggccaaaaannaannnaacaaaaaaaaaaaaaaaaaaaaaaaaaaaaaaaaaaaaaaaaaaccttacctggacggggtcgacgggcgatcaccaaggctcggggcctaggccaatggcccacattgcacttggggggggcgttggtttaccatctccccaagggggagaggggacgtcataatttggggtaaagggggtacgcgttcgcgcggcccctgccttaaaaaaagaaaaaaaaaaaaaaaaaaaaaaaaaaaaaaaaattttttagccacaaatttcacccaaaaccaaaaaaaatcccaaattaaagaaaacgaggaaaaaaaaaacaattttcatcgccgtcctccaccggagctcccttcgtcggccttccttcagggtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgggtttgcgttcttgggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcggtcctggccatggacgacgcgacgcgcgtgggcaagcggcccttcttcacgacacacgaggagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaaattgctggcgcagcagctcaaggacgacctgcacagcagctgcggttgcactggacatggtgccctgtcttcggaggaagaggtgggtgccgtggtctagcggtgagggccgcacagactttgatgtctccccgacgccatgtttgctgttggggtcaccataccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgcactagcagccagcatgcgtttttatgctgctttagacatgaaaatgtatatccaacacaggcctgtgaataagatgatgaaagtatatccaatcgctgcacttcatgggcgtcgcggccgcaaaaaaaaaaaaaaaaaaaa

SEQ ID NO: 1139 - DNA, 1240 bp, Zea mays
  misc_feature (680)..(680): n is a, c, g, or t
cctcgaggcggcgggcggttttcaggaattctccaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcacgcggcggggcggcggcgcgcagatgctgctcttcggcggcggaggcagcgccaacagcaacggcttcttccgaggtgttccgatggcggtcctgggcatggacgacgcgacgcgcgtgggcaagcggnccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtcatcgtctgaagttcgatgtcatggtgcgatgaaaagactgcaagtgcaagcatatccgtaggaaactaggaactagagttaaaactggggaataatgtaaatgagttcatgatcatcgttgtttggatgttttggaatgccatgtatgtccaatttggggcctccatgttatcaacattcctgaaacgtgggctttaagatgagcaaaaaaaaaaaaaaaaaaaaaaa

SEQ ID NO: 1140 - DNA, 1673 bp, Zea mays
ggggcgcacacggatagggggggacccaccagtcgcgggggaataattcgcggcggagaggggggagcgccccagagagggggggcccgactcgggggggggcggtggcaacaggggggggaaggggggaaacggaccccctggggctcctgaaaagatgaaaaaagggggcttaggaggagaggggcggcgcaatgcgcttccacaaacgggagggaggggacaaaggctctccgcggtgcggcaagagggcaaaaggcgcgtcccgccgccacccggtgtgcggtttgccggaaaccacaaaagggggcccccggggggtctccccaattgaaagtcgggccgagaggattagtccccacatagttgggggcaaatacgttttccggcggcggacccgggtggggaaccgtgatgggcccggggggtttagggggggcggacagggggggaggaggggaaatcgtcccccggggaaaggcgcgaaataaaaaaggtcggggtggggaggcccccagggggggggccggggaaaaagtggccgggttgccgggggccggtagtgtggtgtctgcccggggtttttttttttttttttttttttttttttttttttttttttttttttttttttttttttttttttttttttttttttttttttttcactttcactcacagctattacacatggcgaaaatgcatacagtaatttttttttggcacgagatttggcggtcggtccccgcgggaagattgctctgctagttccacatccaccaccagctgacctggccggcgtcctcgtcgtcgccgtccgcgtggtgggtgtgttcggagaggaacgcggcggcggcttcttcgtcggcgtagtagctgcatccctcgtcgctgccggcgccgtcgtcgtcgtccgactggatgcctccagcgccgtgggttactggacccatcgtcccgcagccgtggtactggtcctggacctcggcgccggggaagtacgactcgacgctgctatcgacggccgcgccgccgatcctgccgttgtacaacagcgcgtccgccgggtccaccaccgcgctcccgccgttgcccgtgctcatcagcctgtcctcggacttcacctgccgctcctcgaacgccgccgcctctgcctccggctccggctccggctccggttcctcgacgtcatcggccacggaagccctgacaacgcccaccgccggcaacgccgccgcggcgccgttggcgtcgccctccgtcgcctccttctctcgcagcttctcggtcaacgacaccacctgtgagcggaggcggtggttgtcctggagaagggcgtcgtggtccgcgcggagggcgtcgaaggaggccttgaggcggtcgaagtcgcgctccagctgcttggtcttccaccgggcgcgccggttctggaaccacacggccacctgccggggctgcaggcccagcttgcgcgccagctccgtcttgcgctccggctccagcttgttctcctcctcgaagctcctctccagcaggtgcacctgctccggcgtcaggcggcgcttcttctccggcagctgctcgtcgtagtactcctcctcgaggagctcgtcgggcgaggtgtagaagggcgttttacgccgcgccttcttcaaggccaagcatcgcccggg

SEQ ID NO: 1141 - DNA, 1045 bp, Glycine max
  misc_feature (103)..(103): n is a, c, g, or t
ctacctaagctcttttttcggctcgagctttgctgagggtgggcggctgtttaccttctggatttcgcatcattcctcttgaatctggaaaggaagcttccanccccaatcgcacccttgaccttgcatcttcccttgacgttggtcccagtggaaaccgagcttcatatgaatgtgctggaaattccagctgggggggatctgtgatgacaatagcatttgaatttgcatttgaaagccatatgcaagatcatgtagcagctatggcacgtcaatatgttcggagcattatatcatcggttcaaagggtaggattagcactttctccttctcatttgagttcacatgcagggcttaagtcaccattgggtactcctgaagcacaaacccttgctcattggatctgcaacagttataggtgctacttgggtgtggagctacttaaatctaataacgaggggaatgaatctttgctcaagtccttgtggcatcactcagatgcaatattgtgctgcactctaaaggcattgccagtgttcactttctcgaaccaggctgggcttgacatgctggagaccaccctagttgcattacaagatatacctttggagaaaatatttgatgatcatggacgaaaaattctcttttcagagtttccccagattatccaacagggttttgcatgtcttcaaggtggcatttgtctttcaagcatggggcgacctgtctcatatgaaagagttgttgcttggaaggtgctgaatgaagaagagaatgctcattgtatttgctttatgtttgtgaactggtcttttgtttgacatcttgttctgagtacacttgggcttattgtatccaagtgttagataaagttttactctaagactaaaaaaaaaaatgttggttggtgttttactgtatttgcactaaatacttggattgcactttaaatgactatttgtgttattattagcttatgtaacttgtttccttattcaacctccagctaatatttaatgcaatcttaagaagtgttgcccctttt

SEQ ID NO: 1142 - DNA, 1129 bp, Oryza sativa
gtaaaagatggctgcagtgcatgcagcagtgtaaaaaaaaaaaaaaaaaaaaaaaaaaaaaaaaaaaaaaaaaaaaaaaaaaaaaaaaaagggggggggggcatgtccagtcctgctttgttggcaaatgtaaacaccggtttttccttgaatgagcagcacaaaatagcatcttggtaatgccatagcatcttcaacaattgttctgcatctccatctgattgactaagtaactctacccctagatggtaatggtagctctggcaaacccatcgagcaagggttgctgcttcagggaaaccagagattatcctctgtccggcatttagaccagtttgagagggagagatagccattgacactctttgcacagcagaaacaatgctacggacatattggcgagccatagctgcaacactgtcttggagatgcaactcgtaagggaattgaaaagcgatcgtcagaacagatcgcaagttacaatcatctgcagatgcatctccggaggcttgagctgttgctgaacctacttcaagactagatgccaaatctaatgtcctaccagaggatgcaccatctgttttcatatcaagtggtataacacggaagccagaagaaatcaatggagtttcatctgggaaatcatcaatcggtgcaaagacaagctgaaaggaggatcccacagacttctcgtctattccagtgcagagctgaagcaggtggatatcccttgaaagaagagcttcatcatgagtaagaggttgaccctcaaggcgaacaacttcaagaatctcctcattctcaactgtgtgagcaagtggaatgatgatttggctcccagaaaatctcatgggtcgcaacccaggaagtgaacatgcacttgttttcagagttgaagccaaatatgcatcaatattgtaatcggcccattcagatctatgctccctcagaaatcgaaccagtactgctggaggaacactctgcagtaacattgatgccttagcacatataatacctccgggggctccaaaggcgatgccagcattgctgttactcctaattttcttagttgagttgcaagcaatcactacatcttcaacaccgtctccgcccattatagaccacccat

SEQ ID NO: 1143 - DNA, 1154 bp, Oryza sativa
gtggatcccccgggctgaggaatcggcacgaggctaaatttggtctgcatttcgaagaatctcgccaatgccaatgcagttttcgacgccctacaggatccgattttacattgctggaaggaacccaagtacccaaccgtcaggattgctccgatccccctacaactaaaaccacttggccactgccttgtacttgggtacttgatggaatgggagcgagattacatttacataagcgagaaatttcgcaaatactactagattctcaggtctagatctagtgcaaaacagtcttgaacaagcaaaaatgaatcttcacttcgcagtggatgtgggatggtcacacaaaggaccagttgacgaaacagaaggccaggcagtgaacattgctatcctcggcaagcactttccaagccacggcctgatcgaaagaaacatgccgacccattcctgacatgcacacgcctgatggcaggtagacatggccctgctccatcaatttgggaatgtttgagaacaatgcttcttttccaggctcatcaaagatcctgtccaatgtgaggtcctgtaaggcgacaagggaagtttctagcatgtccagtcctgctttgttggcaaatgtaaacaccggtttttccttgaatgagcagcacaaaatagcatcttggtaatgccatagcatcttcaacaattgttctgcatctccatctgattgactaagtaactctacccctagatggtaatggtagctctggcaaacccatcgagcaagggttgctgcttcagggaaaccagagattatcctctcccccgccccggggcccctctgagagggagagatagccattgacactctttgcacagcagaaacaatgctacggacatattggcgagccatagctgcaacactgtcttggagatgcaactcgtaagggaattgaaaagcgatcgtcagaacagatcgcaagttacaatcatctgcagatgcatctccggaggcttgagctgttgctgaacctacttcaagactagatgccaaatctaatgtcctaccagaggatgcaccatctgttttcatatcaagtggtataacacggaagccagaagaaatcaatggagtttcatctgggaaatcatcaatcagtgcagagctg

SEQ ID NO: 1144 - DNA, 666 bp, Oryza sativa
gcacgagggttggtattgtggccatttcacatggttgccgtggtgttgctgcccgtgcctgtggttgggtgaacctagaaccaacaaaagtggtagagatattgaaagatcgtccatcttggttccgtgattgtcgaaacctggaagtctttacaatgattccagcaggaaatggaggaacggttgaacttgtctacacacagttgtatgctccggcaactttagttcctgcacgagatttttggacgttacggtacacaaccacaatggaagatggcagtcttgtggtctgtgagagatctttaagtggttcagggggcggtccaagtgctgcctctgctcagcaatatgtgagagcggaaatgcttccaagtggatacctggttcgcccatgtgaacgtgggggatcaattgtgcacatagtggaccatctggatcttgaggcatggagtgttcctgaggtgcttcggccactctatgaatcttccagggtagtcgctcagaaaatgactactgcggcactccggcacatcagacaaattgctcaagaaacaagtggggaagtggtgtatgccttggggaggcaaccagcagtgctacggacttttagtcaaaggctgagcagaggctttaacgatgccattagtggtttcaatgatgatgggt

SEQ ID NO: 1145 - DNA, 712 bp, Oryza sativa
tgcaggaatcggcacgaggctagtgcgcccatgcgagggtggtggctccatcgtgcatattgtggaccatctggatcttgaggcttggagtgttccagaagtgcttcggccactctacgagtcatctagggtagttgctcagaaaatgactactgcagcactacggcacatcagacaaattgctcaagagacaagcggggaggttgtatacgctttggggaggcaacctgctgttttgcggacatttagtcagaggttgagtagaggcttcaatgatgctataagtggtttcaatgatgatggttggtctgtcatgggtggggatggcattgaagatgtgatcattgcttgcaatgcaaagaaggttaggaatactagcacttcggccaatgcttttgtaactccaggaggtgttatatgtgctaaggcatccatgctactgcagagttgtcccacctgcagctttggttcgatttttgagggaacatcgttctgaatgggcggattataacttcgatgcatattcagcttcatctctgaagacaagctcatgttcacttcctgggttgcggcctatgagattttctgggagccagatcattatgccacttgctcacacggtggagaatgaggagattttagaagttgtccctcttgaaagacaaagtggtcacacatgattgatgtacttaagtgttaagatattgaccct

SEQ ID NO: 1146 - DNA, 370 bp, Oryza sativa
aattgctgcgtgagtgccccatacttgctaacattgagcccaagcagatcaaggtctggttccagaacagaaggtgccgggataagcagcggaaggagtcttcacggcttcaggctgtcaacaggaaattgacggcaatgaacaagctacttatggaagagaatgagcgactccagaagcaggtctcccaattggttcatgagaatgctcacatgcgacagcagctgcagaatactccgctggcaaatgatacaagctgtgaatcaaatgtgactacccctcaaaaccctttaagggatgcaagtaacccctctggggctcctttcaattgcagaggagaccttgacagagttcctctcaaaggctactg

SEQ ID NO: 1147 - DNA, 348 bp, Zea mays
ggttttcttgaaagatcgtccatcttggtttcgtgattgtcggagtcttgaagtctatacagtgttaccagctggaaatggcggaaccattgaacttgtttacatgcagatgtatgctcctactactttagttcctgcacgtgacttttggacactgagatacacatccactatggaggacggctgtcttgtggtctgtgagagatccttaagtggttcaggagatggacaaagtgctgccacaacacaacaatttgtaagagctgagatgctttctagaggctatttaattcgccaatgtgagggtgggggctcgattgtgcgaatagtggaccatctggatcttga

SEQ ID NO: 1148 - DNA, 1320 bp, Oryza sativa
ctccttgcccccctctcgaggcccaggtgttcgtccgtgtcctcttctccactccacacacgcacacgcacaagccaagcagcaagcagcggcgccgatgagaggaggagtagctgggcccaccgccggcgagccgccggggacggaggcggaggcggaggaggtggaggagagctcagctggggacgacgaggagctggagctcgggctcagccttggctccaagaaacagcagcagcagcagcatgcgccgtgccgaatcctgacggccagggacctgcagccggcggcggcgctgtcaccggactcctccgtgtcgtcgtcatcccccgcggcggcggcggcggcgggggggaagagggctgagggccccaccgccaccacctcgcctgggacggttgcttccggccatccacacagctttggagtggtgggatggccaccgatccgacagttcaggatgaacagcctgttcaatcaggctaaagaaaacacatctgaaaccgacaccaagaagaccgccaccaatgaatctgatgtgcagaaggacaaggaggagggcgaaaagaaaggacgggttgctggatgggtgaaggtgaacatggatggagaggtcattggaaggaaggtggatctcaatgcgcaccgctcatacaagacccttgcattagcccttgaactcatgttcacgaagccgtccattggcctttgcgcttctcataatacaaagtcgctgaaactactagacaactctgccgaataccagctcacctacgaggacagggatggtgactggatgctcgttggagatgttccttgggaaatgtttgtcagctctgtgaagaggttgaggatcatgaggacatcagatgcgaatggtcttggtcagcgataccagggaattcacagaaccattgcttcaacaagaggcagatcctgagagcgtgtgacaaggaaaagagctataccgctggtgaagcttggagcgtgcttgatggttaattacttgtccagttaaaatagcagaaggctagtaagaaagagccacagggctcacccggttctgttatatttttgcctttgtggtgcctgtttttgtttgcactgtcgatctgcaagagcatatggtcgccttgctctgcttgcatgtacaagtatgtctttctagtagtttttatggtgtttgatgatgatccttgtgcctacctgattactactgactcttgcacagcctcacaaatctctatgaattagccctggagtttcattgattaatccacctccaaaattcctaatatgtgtgatggactagttctctcc

SEQ ID NO: 1149 - protein, 281 aa, Oryza sativa
MRGGVAGPTAGEPPGTEAEAEEVEESSAGDDEELELGLSLGSKKQQQQQHAPCRILTARDLQPAAALSPDSSVSSSSPAAAAAAGGKRAEGPTATTSPGTVASGHPHSSFGVVGWPPIRQFRMNSLFNQAKENTSETDTKKTATNESDVQKDKEEGEKKGRVAGWVKVNMDGEVIGRKVDLNAHRSYKTLALALELMFTKPSIGLCASHNTNSLKLLDNSAEYQLTYEDRDGDWMLVGDVPWESAIPGNSQNHCFNKRQILRACDKEKSYTAGEAWSVLDG

SEQ ID NO: 1150 - DNA, 1475 bp, Zea mays
ccttttttttttccttttttttttttttgaaacagcagagcagatacttctgccatatcaaacacaaggataaaaaccaacactttgggcgaccattcctcacaggtaaacagcgtggacagaagagctgggggcgatgatgctcgtatagcccataagaaaagctcaacgagggcaccacagggaagaagcaaaaaaaaaaacttctactatttccactagacacaatgaagttgcctaagtttagtcgttcgaattgaagaactaaacttagacataaaagttagccatgttgtggcgccttagacagtaaaccaaacagccccgtaatctcacaactatgccagcgatatgggctgctgttactgttacgtgatatcaaatacagttcaagcttcaccagcggtgttagcaccaaacgcacatcggtggtttcacgtcctgcctctcgtgcaagctgctgtgggtctgtgagacccttggaatcgtggaccgagacctttggcgtctgaggttctcatgatcttgagcctcttcactgaacctacaaacatctcccagggaacatctccaacaagcatccagtccccgtccctgtcctcataggtgagctgatactccgatgagctgtctaatagctttagagtctttgaactgctagaagtgcaaagaccaatggacggcttcatgaacatgagctcaagtgctgaggcaagggtcttgtaagagcgatgggcattgagatcgaccttccttccaatgatatctccttccatgttcaccttcacccaaccgacggtccggcctttcttgctctcctccttgtcttcctgcatgtcaggttcgacgatgggcttcttggcgccagcctccgatgcattctctttggcctggttaaataggctgttcatcctgaaagttcttatgggtggccatcccaccactccaaagctctgtgggtggccagacgcgaccgtccctggcgagttgggcgccgcatccgccttggccctcttgcttggcgccgcggtacctgcacctgccgcgggggaggaagaggacacggaggaatccggtgacagggacctcggctgcaggtcccgggccgtgaggatccggcacggcggcggatgctgctgctgctgttgcttggagccgaggcagagccccagctccagctcgtcgtcgtcctgctccaccaccgtctcctcgtcctcctcctcggcgccggagttctcctccacctcttccgcgtcggctggaggcggctcgtcggacatgaacgccgcagtgggccccgctcctcctcctctcatcgcggcgctgctctctgccttcctgttctgcgactgtgctgtgcgttctgggagagacacctcgagggagaggaaaggaggtgtcgctattatctgagcacagcagacagagagagagggaggagctctccggcccggccggcctcgaggtacccaatg

SEQ ID NO: 1151 - DNA, 1434 bp, Glycine max
  misc_feature (718)..(718): n is a, c, g, or t
ccctctcccccacacaacacaccacaaccttcttcttcttcttcttcaacttctggttcaaaacctcaacagtttgttgaattgcgcgttgaaatacgactcaatattctttcgcgagctctgttctcacttcaaaggttaggttcttcgacagtttctttgtttccactccgtcgcttgctgagaaggcgtgagcgagagttgtagaattacgcaacgagtgtcgcggatgagagatctgtggtgaggtctctggaaatgacatcattggaggtgacgatgaagggaaattgcttgaaccacaacgacggcggagccacggagcctcattccccgtccacggccaaagacgcagaagctgcacttttcagggagctatggcatgcttgtgcaggtcctctagtcacggctccgcgagaaagagagcgcgtgttttatgttccctcagggacatactgagcaggtggaggcgtcggcgaaccagggggcgggcccagcacttgccgggtttacgatctcccacccaagatcctttgtcgggtcatcaacgtgcagctgaaggccgagcccgacacggatgaggtgtttgctcaggtgactttgcttccggagccaaacgtgagtttcctctcctcgttagtgtgtgttttttagagagagacagagtaattgggtgaaaaagtggtgatgcttatgatttttttttaatgtgggtggnggatgatgatatagcaagatgagaatgccgtggagaaagagccaccaccacctccgccaccacggtttcatgttcattctttctgtaagactctgacggcgtccgatacgagtacccatggtgggttttctgtgctgagacgacatgctgatgaatgtcttcctcctctggatatgtcgaagcagccacccacactggaattggtggctaaggatcttcatgcaaatgaatggcgatttaaacatatcttccgaggtcaaccccgtagacacttgcttcagagtggttggagtgttttggccagctccaaaaggcttgtcgctggggatgcatttatatttcttagaggtgagaatggggaacttcgtgttggtgtccgacgagcaatgagacagcagggtaatgttccatcctcagttatctccagccacagcatgcatctcggtgtccttgcaactgcttggcatgccatctcgaccgggaccatcttcactgtttattacaagcccaggaccagtcctgctgaatttattgttccgtatgatcaatatatggagtctctcaaaaataattatagcatcgggatgcgggtcaaaatgaggtttgaaggtgaagaggctccagagcagaggtatgggcaaatgatcctgcagtgctttattattattaaatgttcgattctagtgggaaatatcccttgattggcttgtaaaata

SEQ ID NO: 1152 - DNA, 887 bp, Oryza sativa
gggggatgtgaagatctggtggggtgatggcgacggcggaggtcggcggcggcggcggtgagggggatgctgctgccgcggcggtggcgcgagcaggcggcggcggcggcggaggaggaggaggaggggaggacgcgctgttcacggagctgtggagcgcgtgcgcggggccgctggtgacggtgccgagggttggggagaaggtgttctacttcccgcaggggcacatcgagcaggtggaggcctcgaccaaccaggtaggcgagcagcggatgcagttgtacaatctcccatggaagatcctgtgtgaggttatgaacgttgagctgaaggccgagccagacaccgacgaggtttatgctcagctcactctgcttcctgaattgaagcaacaagaagataacggctctactgaggaggaggtgccttctgctccagcagctgggcatgttaggccacgggtgcactcattctgcaagacattgaccgcctcggacacgagcacacatggcggcttctcggtgctgcgacgccacgcggacgaatgcctcccaccactggatatgagccgtcagcctccaacacaagagctggtggccaaggatctgcacggtgtggaatggcgctttcgtcacatattcagaggtcaaccacgaagacaccttttgcagagtggctggagtgtgtttgttagtgccaaacggcttgttgctggggatgcctttatctttctcagaggtgagaacggggaactgcgtgttggagtcaggcgtgcaatgaggcagcaaactaatgttccatcttcagtgatatcaagccacagcatgcatcttggggttcttgccacagcatggcatgctgttaacacaggaaccatgttcactgtc

SEQ ID NO: 1153 - DNA, 560 bp, Oryza sativa
  misc_feature (78)..(78): n is a, c, g, or t
tagtggatccccgggctgcaggaatcggcagagggttggtctgttgtgtagcaacaagaagataacggctctactganggaggaggtgccttctgctccagcagctgggcatgttaggccacgggtgcactcattctgcaagacattgaccgcctcggacacgagcacacatggcggcttctcggtgctgcgacgccacgcggacgaatgcctcccaccactggatatgagccgtcagcctccaacacaagagctggtggccaaggatctgcacggtgtggaatggcgctttcgtcacatattcagaggtcaaccacgaagacaccttttgcagagtggctggagtgtgtttgttagtgccaaacggcttgttgctggggatgcctttatctttctcagaggtgagaacggggaactgcgtgttggagtcaggcgtgcaatgaggcagcaaactaatgttccatcttcagtgatatcaagccacagcatgcatcttggggttcttgccacagcatggcatgctgttaacacagggaccatgttcactgtctactacaagc

SEQ ID NO: 1154 - DNA, 800 bp, Glycine max
  misc_feature (19)..(19): n is a, c, g, or t
  misc_feature (126)..(126): n is a, c, g, or t
tggagactaagaccaagangaccctatgtggtcctcgctcattaattctctcatatcattcattcctttttatatcaactatttatatggtcatgttttccttatgtaacttctgagccttttttntcttctcataaccttcttctggatctctctggaagttactatggacacaagcaggtctgagggaaaaagggtcatgaggtacaaagaagaagatgatgataatgatgatgaagaagaagaagaggtggtgagtgagatgggttttgaagaagatggaaggaggaataagagagtaataagagatctctatggaaagagagggtccaaaggtggaggctcaataacaccttcttgccaagtggacaattgtgatgctgatctgagtgaagctaagcagtaccacagaagacacaaggtttgtgagtaccatgccaaggctccttccgtacacatggcagggctgcaacaaaggttttgccaacaatgtagcagattccatgtgctatcagaatttgatgactcaaagaggagttgtagaacgcggttggctgggcataatgagaggcgtcgcaaatatgcagttgactagctaccatggacaatgatttcttctatgggatggacattaataatcattgaggcaagcatgtgattaatgaaattaaatttcccattcaaatcttcataaatcattgttgctggtctctaaggatgctctctatcttctgtcaagattttcatatgcaaagatttttctgttagttaaaaaaaaaaaaaaaaaaaagggcggccgc

SEQ ID NO: 1155 - DNA, 1131 bp, Glycine max
attcggctcgagataatccagagagaggagagagaagtaaaaaggtggaggaagaagcgaaaagcgagtgagggcagtgttgcttaataaaagaaaacgaacggtggtgataggcttcagtctagatctcaatcgtctccaccttgctttcttctccagcgtccgattctctcaccgatctcgcgccaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcgacatatgatggttccaatgcaaggcccggagtaggtatcaagtttattattgaccctcttgttgtaacgtatgttttctacgccagttaccaagtgctcacggcatattgaatgtctttttatgttatgtgaatactgacaggagatgttggttcttgtgtccgtttttttttttaaattaaggtttgtatattatctttggattcgaattattatttgaaagttattattatattgtaaatcctagagccctgttgtctgaatccatcaggcggcttggtaaagaccgagattttaggactgattgtaagcataaatccgaatattcttttcctaatttctttgcgcaataatgtatgaaaaaggctcgagcttctttttaaaaaaaaaaaaaaaggaacaaaaaaaaaaaaggggggg

SEQ ID NO: 1156 - DNA, 993 bp, Glycine max
attcggctcgggaggaacgtgaaagtaaaacggacggtggcgatagaagcgtctctcatctccatcgtctcctcactcctctcttctccagcgttcattttttctcgcgcccaaatacaaaatcacatcacaacagggttccggcgaccatgtccgatgctccggcgagtccatgcggcggcggcggcggaggcagccacgagagcggcgagcacagtccccgctccaatttccgcgagcaggaccgcttcctccccatcgccaacatcagccgcatcatgaagaaagcgcttcctcccaacgggaaaatcgccaaggacgccaaggaaaccgtgcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaagggtggagatgcatctgctaagagagatgtttatcagagtcctaatggccaggttgctcatcaaggttctttctcacaaggtgttaattatacgaattcttagccccaggctcaacatatgatagttccgatgcaaggccaagagtagatattgatcctctccttcagtgtttgacatgtgtgatctaaatgccagtggaacttttatgtcaatatgtgcccttggtatattgaatgcattttatgttatgtaaacactacatgcggggatgttggttcttgtgaccagatattatttattaagacttacatttatctttggaaaagaatcattattcataagttatattgtaaattctggaacaatgcttgtctgattccatcaatcgtcctggtaacgattttatgtacctgattggaagcataaattggtatattctttcccttcgttgtctgtt

SEQ ID NO: 1157 - DNA, 1000 bp, Glycine max
taataaggttgtatatggtttggtgggatggctcgagagtctttagaaaagatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagcaccagcaccagggacacgtgtatggatctggatcagcatcttctgcaagaactagataacatgtgtcatctgtttaagcttaattgattttattatgaggatgatatgatataagatttatattcgtatatgtttggttttagaaatacaccagctccagcttgtaattgcttgaaacttccttgttgagagaatatagacattattgtggatggtgatgtggcatatgtggcatacacagaatttttgtattcttctttctctctatggatttttgtgtaagggcaggactatggctttgtttgctgatcgtatagctagtatggtgctatctaggttcggatttttttctttttcatgtataatgaaaaattaacggaggaaattactcttacgttactttgaaattaattaactaaatcccgcttctgcctttttttttttctcctttctgag

SEQ ID NO: 1158 - DNA, 620 bp, Glycine max
  misc_feature (560)..(560): n is a, c, g, or t
tgaagaagattcctggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattcgccactccctagactttntatattatattatttaattaaactctcttctccactcaacctttgcaagatcactgggtt

SEQ ID NO: 1159 - DNA, 1818 bp, Glycine max
tttttaaataataaaatgtttctttggaaatttcttaaaaagtatgaacataaatttaaattattattttatattaaatgcacttatgttaatttatttgtcttgcatacacatttaatgttatccttctttatatctatattaaactatatatataaagaaaagattttgaaatttgaataagataagagtgtccaggtcagaggcgagcacgtgccagataccaaagcaacggtccagatcatggagcactcaccaaatccaagggctccaattcgtccgtggacactcacacttatcgactaacaacggtccacaaatcgccacgtgtcctcaagataaagcgttattaacccttctgatccaacggatcctgctcattatctcccaaacaaacccctccgttccgtttcacctttccccttcccgccggagccgccgtcaccggtcgctggccaccgtatccgaccctcccaatacaccctttccgagtcccacacaaaattgcacgattctgtgatttcaattttcaggtctcgaggatttcgtttcagaagcgcttccatttgacgcagaaccaccgactcaaaccgattcgcgccgagttcgtgactcgaattttcaacttctcattcatattccaaatcgaatttgaaactccgaagaaaaattcaccgaacactgaatctcagtttccaaggagcttcttctacgaagagcgcttcaattccacgcagaaccaccaagtcaagccggttcgtgactcggattctcaattcctcgttcattcccgaacgaattttaaattccgaagaaaaccgcaccgaacactgaatttcagattctgaacaagtttcttccgcgaaacagcacagcacttcaatttcacgtggaacagagacaaagggattcgtggttcgaattctcaatcgattttcaaattccgaacagcgaacagtacttcaatttcacgtcgaactagtcaaagcgattcaaatcgatttcgcgaactcgtccgatattttccctgcactgacttagtgattcgtttcatctttctcagcgcgtcttcgatttttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcggagttcatcagcttccattcaccggggggcctcgccggtgagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatctggaactactactggatcagcatcttctgcaagaactagataacaggtttatgcatgtgttatctcatctgtttaagcttattaagggtggtctttttggatggtgattttgtttgattttagaaacaccccagctccagcttgtaattgttgcttgaaacttcgttgttgagagaatatagccattattgtggatggtgatgtgacatgcacagaatttttgtattcttctttcttccaatggatttatctcgggccc

SEQ ID NO: 1160 - DNA, 1872 bp, Glycine max
aacataaataataaaatatttctttgaacatttcttaaaaagtatgaacataaatttaaattattattttatatttaatgtatttacattaatttatttgtcttacatacacttgtaatgttctccttatatttattaaactataatatagtatatataaagaaaagattttgagaatttgaataaaataagagtgtccaagtcagaggcgagcacgtgccagataccaaagcaacggtccagatcatggagcactcaccaaatccaagggctcctatttgtccgtgcaaactcacacttatcgcccaacaacggtccacaaagcgccacgtgttctcaagataaagcgttattaacccttctgatccaacggatcctgctcattacctcccaaacaagcccttccgttccgtttcacctttcctcttcccgccggagccgccgtcacccgccgccggcaatcgtatcagaccctcccaatacaccgtctccgacttccacgcagaattgcacgattcattgatttcaattttcaagtcttgaggatttcgtttcaacagcgcttcaatttgacgcagaaaaactgagtcaaaccaattctcccagagttcgtgacttggattctcaatttatcgttcattccgaatagaatttgaaactccgaagaaaactgcaccgaacactgaatctcagttaccgaggagcttcttctacgaaccgtgcttaattccacacagaaacaccgagtcaaactggttcgtgctgtgttcgtggttcagattctcaatcgaaatttgaaattcagaagaaaaccgcaccgaacacagaatttcagaatctgaacaagtttcttccgttaacagcacttcaacttcacgtggaacaagaatcaaaccgtttcgtggttcggattctcaattcctcgtccattcgcaatcgattttcaaattccgaagaaaaccgctccgaacactgaatttcagactctgaacagcgaacagtacttcaagttcacgtggaacgagtcaaagcgattccaatcaatttcgcgaactcctccacggtgaactccgatattttcctgcactgacttagtgattcgtttcatatttctcagcttcgattatccgtttgtcgatggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagaccgtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccaggtagatgggcctatgttattattattattattattcttattcgtaagttaaaagaaatgtgagattcaaagtggtgattaagtgaattagtaacaaaaaagtgcgactcagttgattaaaaatatatataaattattataagtcttttaatatgtttttgattctcacacat

SEQ ID NO: 1161 - DNA, 521 bp, Glycine max
agactttagctttacacaacatattattgtaaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctggggttcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatc

SEQ ID NO: 1162 - DNA, 1156 bp, Glycine max
gaagttaggtaaaaatagtggaaatgagtatcttctttgttccatgtcttgcattgtctgcttagatttgtttttgtaaatcgattccaccaatcatcgctgtccttgtcgcgccaaatacaaaaaccaccacttctacctctctccttctgactctctcactctcaccgggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatcttatttatttccctttaatgcttgtacgcatggcatgggtggaaacaattgtctggtgatttaatatttaggttctcgtgtagaagggtgtcagaattttgttacggtactaatgtagatttttattaatacatgtcttatttagctttgtaatacctactcaagggagagatgtgtttagggttatgctagtgattcgccatgtagcttgtcagggtgagaagcacttgcttttagagttttctttagattattatataatatataatatttgcagacactgcatttgttagtttatttagtttaggccatacagtttgcttctctcttaatgatgtaaaaaatattcacttgtcattcatctagaaaattcgtaatagtgtaatagaatctttaaagacttgctaaaaaaaaaaaaaaaaagggcggccgcc

SEQ ID NO: 1163 - DNA, 939 bp, Glycine max
  misc_feature (596)..(596): n is a, c, g, or t
  misc_feature (762)..(762): n is a, c, g, or t
  misc_feature (767)..(767): n is a, c, g, or t
  misc_feature (769)..(769): n is a, c, g, or t
  misc_feature (775)..(775): n is a, c, g, or t
  misc_feature (786)..(786): n is a, c, g, or t
taatatagtgcggctcgagctctgctttctgtgttattgtctggcttttggagccgatccaaccaatcatcgctggcgccaaatacaaaatctcatcccttcccctttctcttactgactctctttgtcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcaggtgcaaccacaacantctggttatgccttcaatgcaaggccatgaatagtttagatgcttctacgcatcttatttatttcccttgaatgcttgtacgcatggcatgggtggaaccaattgtctggtaaaaaaatgggggggctctcgtccccccgggtgggggggttttgtttcggtactngtgtngntttttnttaaaacacgncttgtagcgggtgtttctcttctcaagggagagatgtgtttagggttatgctagtgattcgaaatgtagcttgtcagggtgagaagcacttgcttttagagttttctttagattattatataagagagaatatttgcagacaaaaagacttac

SEQ ID NO: 1164 - protein, 229 aa, Oryza sativa
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPQPPHHHHHQMVMGGKGKVEEVQSKGKIRDFLQLQASMLELIQGEN

SEQ ID NO: 1165 - protein, 241 aa, Oryza sativa
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYREGDTKGSRASELPVKKDVVLNGDPGSSLVNYGAQRADANANHLDLFFLLRKNPESTTANCMREDEAKPVTVKIIETVYVEADTADDFKSVVQRLTGKDAVAGDAPELNSAQRFGSGREASRHGDHKVRIYE

SEQ ID NO: 1166 - protein, 297 aa, Oryza sativa
MKSRKSYGHLLSPVGSPPLDNESGEAAAAAAAGGGGCGSSAGYVVYGGGGGGDSPAKEQDRFLPIANVSRIMKRSLPANAKISKESKETVQECVSEFISFVTGEASDKCQREKRKTINGDDLLWAMTTLGFEAYVGPLKSYLNRYREAEGEKADVLGGAGGAAAARHGEGGCCGGGGGGADGVVIDGHYPLAGGLSHSHHGHQQQDGGGDVGLMMGGGDAGVGYNAGAGSTTTAFYAPAATAASGNKAYCGGDGSRVMEFEGIGGEEESGGGGGGGERGFAGHLHGVQWFRLKRNTN

SEQ ID NO: 1167 - protein, 137 aa, Oryza sativa
MKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQDIFTGHVVRLV

SEQ ID NO: 1168 - protein, 285 aa, Oryza sativa
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQSNFHILVVLQSFAFPYMYQVAQIYCNKYEVSREQIWDTPQIMELSPWIPYTINRIWKETHGSQDIRIQGRPREAANSALDWQWPSKHSSLASNFYGTRVVGGHHEYQRSTKKDTTHVNFASGLGDLG

SEQ ID NO: 1169 - DNA, 693 bp, Oryza sativa
taattttttttttttgaatttgaaacccaactttgcataaacttgtgtcagcatcacacctgcttgcgtaatagagtttagaaaagtttctcttagatctctttacccctctgaatttagcatatgcaggacagccggaaacggccaaatatggttagacacaaccacacaacacacgactgaactagaacctacaacaaatttggacatcctggctaacacaagaacatttcaaaaagaacgacgactaacattcgtggtaacaaggtattggaactttggaagcatcctgcttacaacataacaggatgctggagcgttctttccctaaaaacgatggttctccttcctagatgccattagcgtgccaatcagtatcacactcctcgtcctacatgccttcaaacgatgatccaggatctccattaagtacaacatctttctttactggcagttcagaagctcttgaaccctttgtgtcaccctccgtctcccggtagagcctgaggtagagcttgagaggctcgacatagtcctcgaatccgagcgtgcccattgaccagatcaggtcgtccccattgatggtcttgcgcttctccttgaggcacttgtcgcttgcttcgctggtgatgaagctgatgaactcggagacgcactcctggacggactccttggagtccttggcgatcttgc

SEQ ID NO: 1170 - DNA, 523 bp, Zea mays
cccagcgtccgaggaaggctacgggcaccagggccacctgttgagccccgtgggcagcccgctgtcggacaacgagtccggcgccgcggcagcggccggcggcggcgggtgcgggagcagcgtggggtactgcggcggcggcggcggtgagtcgccggccaaggagcaagaccggttcctgccgatcgccaacgtgtcgcgcatcatgaagcgctccctgccggcgaacgccaagatctccaaggaggccaaggagacggtgcaggagtgcgtgtccgagttcatcagcttcgtcacgggggaggcctccgacaagtgccagcgcgagaagcgcaagaccatcaacggcgacgacctgctctgggccatgaccacgctcggcttcgaggcctacgtcgccccactcaagtcctacctcaaccgctaccgcgaggccgagggcgagaaggccgccgtgctaggcggcggcgcgcgccacggcgacggcggcggcgcggcggacgacgccggcccactcgccggg

SEQ ID NO: 1171 - DNA, 1199 bp, Zea mays
cccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacaggtaatctatcgtactgtcatttgttagtaaaacaatactgcagctattttccgtctcactaaacatggcagaaaatttcgatcattacattatgccactaataattttctctctgtacgcactcagtaccacaatggggaaacctaataaagggctaatacagcagcaatttatggtaatattattgctccctgaattttgttaactaaagattctgtatcatgctatatgtatgtttccttttttcttcttctttgttttgacaattgcttctttctctacggtgtttatccatcagctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaaaaaaaaaaaaaaaaaaaaaaag

SEQ ID NO: 1172 - DNA, 564 bp, Zea mays
gccttctcttctccagcgtccgatctctcccactcgccttcctcaccgcagctctcccggctcggtcgcttcgccacctccgtcctccccccgcgctcggtcgctcgccacctgctctcccctccctccacgttgctcgcgcccgcgcttatataagtgcacgaggaggagctcatggcggacgctccggcgagccctgggggcggaggcgggagccccacgcagagcgggagcccccagggccggcggaggtggaggcggtggcagccgtcagggagcaggacaggttcctgcccatcgccaacatcagtcgcatcatgaagaaggccatcccggctaacgggaagatcgccaaggacgctaaggagaccgtgcaggagtgcgtctcggagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagt

SEQ ID NO: 1173 - DNA, 1053 bp, Zea mays
cattgggtacctcgaggccggccggcatcgcacccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaataaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaagtcttttatcaggctactcgttttctggaacaggattcatgcttagctttccctcctgtctgaatgtgatggttgcctgaatcctaatttgcc

SEQ ID NO: 1174 - DNA, 1178 bp, Zea mays
gtcgacccacgcgtccgcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagttaacttcaaaatccagcgatggctccattaaaaaggatgcccttggtcatgtgggagcaagtagctcagctgtacaagggatgggtcaacaaggaacatacaaccaaggaatgggttatatgcaaccccagtaccataacggagatatctcgaactaatgaagacatggaccttttctgcgacagctgctcttccctgaggcgattttttggtctcagttatttactaagtaagacaccttgcggtgaccattaaagagtaaccaatcaccctcggtaggtccgtttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacaaaaaaaaaaaggaggaaaaaaaaagggcggccgc

SEQ ID NO: 1175 - DNA, 2109 bp, Zea mays
ccacgcgtccgcccacgcgtccgggcttgctgagctggagctgatggatctagggtttgggttgcggtgatggtcctgcagcgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctacagaagtacagagaggtgcgtacggtgtttgggaatttgggggtcaggtcgtgcaatcgccaatctgtcacctggccgatcgtacctctgattgaacttaaataatcctgttgggcatcagcacgctaataagtgataagtgagctatccacttcccttccaatgcttcggccacatatttatacttctttagttgaggacataaagagaccccctgttcctgtgtactactccagtaaatacagctagtaaacacattatttttataaggtgaaccaattcgaaagcacttttatccatttaatactgaacagtgatcgaaacctctatttgatgttcttacatgggattgagttagcactcgtgcttggtaagatattataactactcacagccctatgtggctgtgtctgttctatgatgaaaagtagatgtaatgcaaatggataagagcggaaagagctcctacagtagtgtaattagagcatgttgtagtgcaagcttttggttgtttacacaaaagatacatgaaaccattccactgtaggtcatatacaatcttgcttagggtcctgaacatatctggtgcacatggttcacatattaaattatcaccatccattctagatctaacgtctttagttgtccattctagatctaacatctttagttgctctgtataattgtatattttgcaaagaaccccttccaccactactctctaccacttctaccctgctccgagggtgttctctgcaaaaatatatagaacacccatagatgttagatataggatgaatgatggtgatctaatatgtacaccatgtgcaccaaactcagtgcaccagatatattctcgagtttatttagctgtatttttctatacgctcttcgtattggttgaataatctgtctaatgaggtttctcttttggtcttatgtctggtggatgacatcacggattgcagatggagggtgatagcaagttaactgctaaatctagcgatggctcgattaaaaaggatgctcttggtcatgtgggagcaagtagctcagctgcagaagggatgggccaacagggagcatacaaccaaggaatgggttatatgcaacctcagtaccataacggggatatctcaaactaatgaaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattatatgtatttgtatcgggaggcataaatattgtgtaatttgtgttaaagactagtgtaattgaactatgggaagagctgctttggttgtaaccatattttgatgcccgtatattaggcaaaaacagaaggctgtgggcgtgcacaacatatttactgttcaccgaaatacttgtattgatgtatttccgcatcaattatagtcatcgtcagcttgtaactacggcaatgaataaataaaaattcactgagtaaaaaaaaaaaaaaag

SEQ ID NO: 1176 - DNA, 1255 bp, Zea mays
aattcggcacgaggcaccctcccgggccgcccgcgcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatgaaggcatggaccttttctgcgacagctgctcttccccgaggcgggtttttgtgtcgcagttatttactaagtaagacaccttgcggtgaccattaaagagtaaccaatcaccctgggtaggtcaatttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatttggaggcataagtatcgtgtaatttgtgttatgactagtgtattgactattgaattatcagaagagctgctttagttgtaagatcacacaaaacagcctggaaagtataacaagattaaaactgaaccaaaaatgggcaataaataaattatcacatttacagtgaataaaaaaatccctgaacatggggcgttcattctaaagaatccaaatttacttgcactgcctggcaacttttttactcttttatgctgaaccctaagtttaat

SEQ ID NO: 1177 - DNA, 1173 bp, Zea mays
cattgggtacctcgaggccggccgggattccccatctcccttcattgctcgctcgctcgctcgttgctcttctccagcagcagctccttcaaatgcaaatctctttgctgccgacgcagagactcgccaaatttccctccctcctcctagccttctcgtcgctcctgttcttctcgcatccccagcccaggtggtgtcccctgtcgcgttgatgcatgctccctcggcggtggccttgagctgaggcggcggagcgatgccggactccgacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgtcgtcagggcttggccggcaagacagggcgtgagttgcgacgatacgttcagaatcagaatcgctgatactcctacgtagaattatacctacctaattgatgacaccgcaccgcacctcgttgtgctgcctgtccttgtacgtttactaattattgctgcctgtatgtaaatcaaaatctgaggctcccatttcgaaaaaaaaaaaaaaaaaagcggccggtgaactactcttcccgtttcgtttcatacgagaatcgaactcgttttcaattaaaaa

SEQ ID NO: 1178 - DNA, 1064 bp, Zea mays
ctcagtctcaaactccccgctctcccccgcccgtccagctcgtgctccgcctccgctgctctgtcctcttccctcctctgcgtttctcctcagagctgtttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtccgagttcatctccttcatcaccggcgaggcctccgacaagtgccagcgcgagaagcgcaagaccatcaacggcgacgacctgctctgggccatgaccacgctcggcttcgaggactacgtcgagccgctcaagctctacctgcacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggctcggctcccgccgccggcttcttgcttggtgtcggtaattagcgctggtggcctgcgctggttaagttaaccttcggtttttcccccttttcttttcgtggtaagtaatgttgtgctgaatggagacagtgatatggttaagatagctccataacctctcggtaattaatcctgtgatttgtactcccaagctgctgctaaactgagctatgacacaatacaaatgctgccattaac

SEQ ID NO: 1179 - DNA, 826 bp, Glycine max
  misc_feature (793)..(793): n is a, c, g, or t
caaaccaaacctctctttctcagtttctctctcttagggttttctcctcccccattgacccaccgtccatcgcaaaggaagtcgcgcccaatttccatggactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttgggttgatattatcccaagagatgagttgaaagaaggaaggacttggaataaccaaggctactattccattggtgaaatcttcagctgatatgccatattactatgtcccttcacagcatctgtggaggactctgggatgacatgggcaacccgtggtgtgacaacaacgttgatctcacagagctnactccatgggtatgcatggcctcaaaccagaca

SEQ ID NO: 1180 - DNA, 1669 bp, Glycine max
ttacggctgcgagaagacgacagaaggggcctccctttttaattgaaaccaaaccaaaccaaaccaaaccaaacctctctttctcagtttctctctcttagggttttctcctcccccattgacccaccgtccatcgcaaaggaagtcgcgcccaatttccatggtttgtagattaaatcttaaagcagtaagtcatcatggataaatcagagcagactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgaccatgcaattcaattaggtcggaaagtagcatgcaccttatgattattacaaatttacttaatgcctttaagtcagctgtagtttagtgttttgcattgaaaaatgccaaagattgtttgaggtttcttgcactcatttatgattgtatgagctcttatgctgagttacttttggttgtgtttatttgaggtactggtgtggtagttaaattagtttgtagctgtccataagtaaacagcgtagctgcttaattaggaggtctgaaatgatgaaatagtttgtattgttattgcagaaggtaggttttattcagtatttcattctactgcaatggctgaatttattgctcatccgcttagtactagttgatgttttttcctgtccctcgttacgtgttagagtgcgaagaagaattagtgtgccattcttcacctgtttttgcacactacagccccggaagaacaaattgttccgatcattttcaattttttttcccggtaacatgaaaagtggttgatgttaaatgctgtccctgtaaaaaaaaaaaaaaaagaattgacagcaggaaaaaaaaaataacgagctgttctttttcttgattcaaaaccacataaatatatccagattagttttatagttaataattgattttattcggaag

SEQ ID NO: 1181 - DNA, 956 bp, Glycine max
tcagaaatgcactctctctctttctctctccagaacacaactcaacacactcttcaatttcaaacgcacactcttcaacttcactgtccctccctttttaattgaaacccgagcaaacctcgctttctcagtttctctttcttagggttttctccaccgtccattgcaaagtcttgcgcccaatttccatggaactgtaaagagaggatagttagaagattaaatcttaaagcagtaagtcatcatggataaatcagagcagactcaacagcagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtcccttcacagcatcctgttgtaggaccacctggggatgatcatgggcaagcccattggcgctgagcaagcacac

SEQ ID NO: 1182 - DNA, 1262 bp, Glycine max
cacgcgtccgcctctctttctagtttctctctcttagggttttctcctcccccattgacccaccgtccatcgcaaaggaagtcgcgcccaatttccatggactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgacaatgcaattcaattaggtcggaaagtagcatgcaccttatgattattacaaatttacttaatgcctttaagtcagctgtagtttagtgttttgcattgaaaaatgccaaagattgtttgaggtttcttgcactcatttatgattgtatgagctcttatgctgagttacttttggttgtgtttatttgaggtactggtgtggtagttaaattagtttgtagctgtccataagtaaacagcgtagctgcttaattaggaggtctgaaatgatgaaatagtttgtattgttattcccaaaaaaaaaaaaaaaaaaaaaaaaaaaaaaaaaaaaaaaaaaaaaaaaaaaaaaaaaaaaaaaaaaaaaaaaaaa

SEQ ID NO: 1183 - DNA, 675 bp, Glycine max
ctctcttagggtttcctccccccccccggaccctccgtccatcgcaaaggaagtcgcgcccaatttccatggtaagtcatcatggataaatcagagcagactcagcagcaacatcagcatgggatgggcgttgccacaggtgctagccaaatggcctattcttctcactacccgactgctcccttggtggcttctggcacgcctgctgtagctggtccttccccaactcaggctccagctgccttctctagttctgctgaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttgggataaccaaggctactattgcattg

SEQ ID NO: 1184 - DNA, 1527 bp, Glycine max
ccacgcgtccgcttttgttctagcacttcgctgtctgaggttcgttccaaagaaaaacatcgtcaatcctcacgacagctctgctctgctctgcttcttttgttttcttatttttcttctgaaaccctaaattttgtctgctctaaactttgggatctttcacacttgaaaaaaactgcttcttgtgcccgacccagcacaattctcatactatagttcggcggcgcgaagacgactgctggggacattcggtccacagcttttgttctagcacttcgctgtctgaggttctggattctcagtgtttgcggacgcagcatcatcttttagggaagaatggatcatcaagggcatagccagaacccatctatgggggttgttggtagtggagctcaattagcatatggttctaacccatatcagccaggccaaataactgggccaccggggtctgttgtgacatcagttgggaccattcaatccaccggtcaacctgctggagctcagcttggacagcatcaacttgcttatcagcatattcatcagcaacaacagcaccagcttcagcaacagctccaacaattttggtcaagccagtaccaagaaattgagaaggttactgattttaagaaccacagtcttcccctggcaaggatcaagaagattatgaaggctgacgaggatgttaggatgatatcagctgaagcaccagtcatttttgcaagggcatgtgaaatgttcatattagagttaaccctgcgctcttggaatcacactgaagagaacaaaaggcgaacacttcagaaaaatgatattgctgctgctatcacaaggactgacatctttgatttcttggttgacattgtgcctcgtgaggacttgaaagatgaagtgcttgcatcaatcccaagaggaacaatgcctgttgcagggcctgctgatgcccttccatactgctacatgccgcctcagcatccgtcccaagttggagctgctggtgtcataatgggtaagcctgtgatggacccaaacatgtatgctcagcagtctcacccttacatggcaccacaaatgtggccacagccaccagaccaacgacagtcgtctccagaacattagctgatgtgtcgtggaaattaagataaccaggcactggaatcagttgtgaatgtcaaactgaatggttgggaaggtcgatactacatagcgagcagaagctgtagctgatagtttacatgcaatgcagactataaacatatgtagataatgtgctagggaaaacttaaccttatctttgatttagctggaaaaaatggtatttttcattttaattcacaggtcatcagatgataatatttatttactggtgcatagcaggatttttacttgagtttaaacttgtcatgcgcccaaaatatatcccatctttttcattcatcatgcttccttgttatacctacctatctgtggttcgctttgtgggaaaattgagttatcacatgatttgcgcacaagttgtgcaagaac

SEQ ID NO: 1185 - DNA, 426 bp, Glycine max
  misc_feature (328)..(328): n is a, c, g, or t
ggctcgaggaacgcagggttaactctaatatgaacatttcacatgcccttgcaaagatgactggtgcttcggctgatatcatcctaacatcctcgtcagccttcataatcttcttgatccttgccaggggaagactgtggttcttggaatcacactgaagagaacaaaaggcgaacacttcaaaaaaatgatattgctgctgcaatcacaaggactgacatctttgatttcttggttgacattgtgcctcgtgaggacttgaaagatgaagtgcttgcatcaatcccaagaggaacaatgcctgttgcagggcctgctgatgcccttncatattgctacatgccgcctcagcatgcgtccaaagttgagctgttggtgtattatggggtagcctgtgatggacccaacatgtatgctcagcagtct

SEQ ID NO: 1186 - DNA, 564 bp, Oryza sativa
  misc_feature (547)..(547): n is a, c, g, or t
cccacgcgtccgctccttcctaacctagggctccgatttcgccaggtgttgcccatcgcgaccgcgccaccgccgccgccgccgccaccgccaccgccgccgccaccgccaccgccacctgccgatcctacagcagttgcataggagtacatctttagaaatggacccacattcacacaagaaggcacatgaaggtctgattggtgacaaccctgacgcgtatgccgtgacgacataccaacctgtgctgatggtagaaccatcagccgctgctgccttccctccagctccccaggttgctccagcctatccagtgaacccaatgcagcttccagagcatcagcagcacgcaatccagcaagttcagcagctccagcagcagcagaaggagcagctccaggcgttctgggccgaccagatggccgaggttgaacagatgactgagttcaagctccccaacctcccgcttgcaaggatcaagaagatcatgaaggccgatgaggacgtcaagatgatcgcgggcgaggcaccggcgctcttcgccaangcctgcgagatgttcat

SEQ ID NO: 1187 - DNA, 1296 bp, Oryza sativa
tttttttttttttctctttcttggtgtctcctcatgccagcacttttgagtattggattagaaactgatgaaaggtaaggtacagttactacattagttgcaaatcacctaccaaatcacaatcttttttttttctactgctgccatagcagagcagaactaacattaggaaagcctaagacctaatcagattacccgtttcagccaacaatcatgggaatagttttgacaagagcactgagttttagaggccctaagttcacaggacaatgtatatcaatgtcacaacttcactgtatcatctttagctactttctggcagagagtgctgctcttcaggggcctcttcctgttgctcttgaggctgctgccacacatacgtcaccgggtgaccttgctgtccaccgtacatcattcctgatccaggcccctgctgcgctggcacgtagtaatatggatatgtgtctgctgcgccccccacattaggcggtaggccaaccctcggaagcccaagcccttcttctttcatttcatccctgggaactatgtccaccaagaagtcatagatatcagtcctggtgatggcagctgcaatgtcattcttctgcaaggtccggcgcttgttctcctccgtgtgcatccacgacctcaatgttaactctaatatgaatacctcgcatgcctttgcgaagacaacgggggcttctgccgagatcatccggacatcctcatcagccttcattatcttctttatccttgcgagtggcaagctgtggttcttgaagtcggttgtttgctcaatctcttccatttggttagcccagaactcacggagttgctgctgttgctgttgctgcagctgctgatgaaattgctgggcttgttggtagactagctggtgctgagcactgagttgagctggattagtggggaatggtgctgatggctgtgagccaggaggaacaacagcaggagctccaggaaccatggcttgaggtggatatgcagcagcaggaggaggatatgcttgtgacccaccagtggcaacacccatcacaggctgaggctgtgaggatggttccatgtcagctcttgtccgtccaaagccaaaggcccgagagacgacgcccggatctcccgcgccggcgggagcgggagcggcggcggcggagagcgctccctccggcgaagggccgcgccgcccacctccctctcgtggagccctcggcgtcggcggcggagagagagagagagagggagacgcggtcgccctcgggccgattcctgcagcccggg

SEQ ID NO: 1188 - protein, 259 aa, Oryza sativa
MEPSSQPQPVMGVATGGSQAYPPPAAAYPPQAMVPGAPAVVPPGSQPSAPFPTNPAQLSAQHQLVYQQAQQFHQQLQQQQQQQLREFWANQMEEIEQTTDFKNHSLPLARIKKIMKADEDVRMISAEAPVVFAKACEVFILELTLRSWMHTEENKRRTLQKNDIAAAITRTDIYDFLVDIVPRDEMKEEGLGLPRVGLPPNVGGAADTYPYYYVPAQQGPGSGMMYGGQQGHPVTYVWQQPQEQQEEAPEEQHSLPESS

SEQ ID NO: 1189 - protein, 530 aa, Oryza sativa
MLSSMFLFLLPLSLLSFSLLGNLWAGAATSAGEGWSSVGLRLMLLGGATPFFYINIETVIITNMNYYPEGSNPVYFAVLVKYEDLDGDVVQVDLMESKSAYGGAIGVWTPMRESWGSASAVTSARPFVTNNVIPAIWSRIAPSLPPSPLPRRPRSALAHCRASPASVSPSARASPTPPSPRSPPHRPSRSRHLLLSGIPAAALVVACPNLNDLDFSNDHYGSTSGMRRRRRWPSCVGFWGGFGDGDGDRYSITFSAYIVVLRTQEAYVQILQQLHRSTSLEMDPHSHKKAHEGLIGDNPDAYAVTTYQPVLMVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQAASMVSPYTSGGMGFSFDLYPNQHHLAYMWPPQEQQEQWPPQEQQEQKQKQDSDGGGQDE

SEQ ID NO: 1190 - protein, 250 aa, Oryza sativa
MEPSSQPQPAIGVVAGGSQVYPAYRPAATVPTAPAVIPAGSQPAPSFPANPDQLSAQHQLVYQQAQQFHQQLQQQQQRQLQQFWAERLVDIEQTTDFKNHSLPLARIKKIMKADEDVRMISAEAPVIFAKACEIFILELTLRSWMHTEENKRRTLQKNDIAAAITRTDMYDFLVDIVPRDDLKEEGVGLPRAGLPPLGVPADSYPYGYYVPQQQVPGAGIAYGGQQGHPGYLWQDPQEQQEEPPAEQQSD

SEQ ID NO: 1191 - DNA, 1671 bp, Zea mays
ttaagaacctagtaggcagacccggccggcgtagagagggggggaggtcgacgagacagagagagaaggccaagaggcttcctctccccattcctcccttccgtgccctagccgagccagccgcgaggaaggaggcatcccgccgtctcgcctggcgcccgcccgtcggccgaccttctgccgcagcttccaattctaaaaagatcatagatttttgtgcaagagcgagtggatatggaaccatcccctcagcctatgggtgtcgctgccggtgggtcacaagtgtatcctgcctctgcctatccgcctgcagcaacagtagctcctgcttctgttgtatctgctggtttacagtcagggcagccattcccagccaaccctggtcatatgagtgctcagcaccagattgtctaccaacaagctcaacaattccaccaacagctccagcagcagcaacagcagcagcttcagcagttctgggtcgaacgcatgactgaaattgaggcgacgactgatttcaagaaccacaacttgccacttgcgaggataaagaagatcatgaaggccgatgaagatgttcgcatgatctcagccgaagctcctgtggtcttcgcaaaagcttgtgagatattcatactggagctgacacttaggtcgtggatgcacactgaggagaacaagcgccgcaccttgcaaaagaatgacattgcagcagcgatcactaggactgacatttatgacttcttggtcgacattgttcccagggatgagatgaaggaggacggaattgggcttcctagggctggtctgccacccatgggagccccagctgatgcatatccatactactacatgccacagcagcaggtgcctggttctggaatggtttatggtgcccagcaagggcacccagtgacttatttgtggcaggagcctcagcaacagcaggagcaagctcctgaagagcagcaatctgcatgaaagtggctgagaatattgctcagaagctatcacctgattcagagttctcattttaggttgtccaaactgcaggttttcttagtaatatcgttggttatcaaactgaaacaggcgattctaagtagggtgtagcatcatggtagtttcatttctgcttgtgatgttagttgaaaggataatgattagtggctagtggattaaagttaccataccatttccttctattccgaaagtttgcctccatgaggcctctgatatgacgaaaaaataaaaaatgcttcaaaaaaaaaaaaaaaaggaaaaaaaaaaaaaaaaaaaaaaaaaaaaggggggaaaaaacccctaaaggaccccccccacccggaataaaaaaaaaaaaaaaaaacaaaaggaaaacaaaaattcctttaaagaaaaaataaaaaaaaaaaagaaaacatggaaaaaaaatttaaaaaaaaaaaaaaattaaaaaaaacaaaatacccaaaaaaaaaaaaaaaaaaaaaaaaaaaaaaaaaaaaaaaaaaaccaaaaaaaagaacaaaaccaaaaaaataaaaaaaaaccaaaaaaaaaaattatccaaagggaaaaaaaaagagagaaaaaaaaaaaaaaaaaaaacaaaaaaacccccccgaaaaaaaaaaaataaaaattaaagaaacaaaaagagaaaattaaatt

SEQ ID NO: 1192 - DNA, 1149 bp, Glycine max
cataacaagaccacactattattattatcaagctcgaagaatctcattccatccaagtttgatgccacgccatcattgaagctattttcttcgaggtccatgtcccataagaacccatatccattattatcatcacatttgggactaatttgagtaacggtgctagagttgttggtgtttgtttccctagagaactgaaggagacccatcaaggagttgttgttgttgttttggctttggtttggaatatgatgattgtgattgtgatgatgggttgccattgaggaagagaatggggcaagaaattggttatacccaattgatggtgtggtgttttggttggttggagatgacgaagccaaagttagggatggaactgtgctctcgtacatgatgagtttggcactgttgtctgctttgcccttgtgaaacactctacacaaaacccagtcctccttaggtggcaaatgtggcgtctccaagcgaaactcatgcatgatccaacccgttttgatgccatttggagccctgttcctgtagaacaccaatgtcttcctcatccctacaacctcacgcgtggcagggtcaaacaccgtacgatccttccccgttgctttccagtagccagatgtcgtcgcgcgattggttcgaaagccggttgcatatttacggtcacggaagctgaagaagtaccattcgtttgcattgagcttagccacctctgggagttgccatggctcgcacgtgtgcaagtcaatttccatcaaggtacccttcagaacttcctcattagtgatctttttgtaaaggtaatgaaggaccaactcctcatcactcgggtaaaaccgaaaccctgggggcagtgaagcaccaatgtctctaagacccatgaatttgctgattttgaaagcagagggaaaggtttgcaatatagttagagagagaaagagagagggaaatctaattaattgagatctttttgaaattttagatatggatagagaggtttaattagagggagatatatatggtagaggtggatttagaaatgtgaaaaaatcaatataattgaagctaggattgagaggttactctctgctggggatatttgaaatattaaggtatccccttctgtcgtcttctcgcagc

SEQ ID NO: 1193 - DNA, 1109 bp, Glycine max
gaattcccgggtcgacccacgcgtccgtgcatgcgcaataatattaatgcacgcagaggtggctaagctcaatgcgaatgagtggtacttcttcagtttccgggaccgcaaatatgctactgggtttcggaccaaccgggcaactacatcagggtattggaaagctacggggaaggatcgtaaggtggaggatccagccacgcaagaggttgtagggatgaggaaaacactggtgttctacaggaacagagctccaaatggcatcaaaacgggatggatcatgcatgagttccgcttggagaccccacatatgcctccaaaggaggactgggtgttgtgtagagtcttccacaaaagcaaagaagatgacaacagttccaaactcctacagtatgagacgacaccatcatccctaactttgttggcttcgtcatctcccaccaaccaagccatgcctcatggtgttgggtataataaccgacttgccacctctttctctaattcattcatgccaacccaccaatatcatcatcacttcaaccctacccaaaacgctaattctttgatggatctccttcacttctctcgcgaaaccaacaccaacaatactggctttcttactcaaattggtgccaaaggtgatgacgaatatggtttcttatgggacatggatctagaagaaaatagcctagatgatggcgtggcttcaaacttggacgcaataagattcgaggttgataataataatactaatacccccaatatggtattgctataattaaatgtgtaagatgtgttatgtgtgtacatatatacacatatatgttattcatagctcgtaaattgtcgtaagattcgtttatttgtggtgtatttatggtgcttcgctatgaggggcatgtcacatgatagattgggtttagttgttacaagtttgtgtggtatattgttcaagtagtagggtaatactattgtggtccattaggcttttcgtaatcaattactattatttacccattattattgggaactattcctttgtatacagtttgtgtatgtaattagtattggctaaaaaaaaaaaaaaaaaaaaaaaaaagggcggccgc

SEQ ID NO: 1194 - DNA, 611 bp, Glycine max
  misc_feature (122)..(122): n is a, c, g, or t
  misc_feature (124)..(125): n is a, c, g, or t
  misc_feature (177)..(177): n is a, c, g, or t
  misc_feature (183)..(183): n is a, c, g, or t
  misc_feature (189)..(189): n is a, c, g, or t
  misc_feature (201)..(201): n is a, c, g, or t
  misc_feature (208)..(208): n is a, c, g, or t
  misc_feature (210)..(210): n is a, c, g, or t
  misc_feature (213)..(214): n is a, c, g, or t
  misc_feature (219)..(220): n is a, c, g, or t
  misc_feature (224)..(224): n is a, c, g, or t
  misc_feature (228)..(228): n is a, c, g, or t
cccacgcgtccgctgaagggtaccttgatggaaattgacttgcacacgtgcgagccatggcaactcccagaggtggctaagctcaatgcaaacgaatggtacttcttcagcttccgtgaccntnnatatgcaaccggctttcgaaccaatcgcgcgacgacatctggctactggaanagcacnacgggngtaaaagggganaattttncnggnntttanncggngggnttttggttttttgaccctgccacgcgtgaggttgtagggatgaggaagacattggtgttctacaggaacagggctccaaatggcatcaaaacgggttggatcatgcatgagtttcgcttggagacgccacatttgccacctaaggaggactgggttttgcgtagagtgtttcacaagggcaaagcagacaacagtgccaaactcatcatgtacgagagcacagttccatccctaactttggcttcgtcatctccaaccaaccaaaacaccacaccatcaattgggtataaccaatttcttgccccattctctttctcaatggcaacccatcatcacaatcacaatcatcatattccaaaccaaagccaaaacaacaacaacaa

SEQ ID NO: 1195 - DNA, 1002 bp, Oryza sativa
cgcgcacgcgtcctctcccgcgtcctccgcctcctcccgcgcgctgcgtacgtgagagcgccatctcctgcttgcagcagctagcaagcagcaggcgcaacagtattactgcagatagagctctcgaccgattgatcgattgctcactgccatatacatgatacttacataccgacgtactacacacagagatagagatcggagggatagctattgctattgctagccatagtatagtagttccctttgctcctgctgctgctttgttgcttgcttccctacacttctctctctcagctgctagctgcgcatataattattccctcgccaagctatatatatttgcctcctgccttcttcccgagctcacacaatcgccaacctatacagatatatgtgctagctacttccaagttcctacctatcaatttctctcctcctcttcttctctgcatcaatctgcagcttaattcttagctatgtacatatagctagctaccacttccaaaatactccacaggcaccaggcacatatagatatagctagattgctatagacagagagatcatcaaagaaatttagcaggtgatagccacatggggttgagggacatcgagctgacgctgcctccggggttccggttctacccgagcgacgaggagcttgtctgccactaccttcataacaaggtggtgaaccagcatcgcttcgccggagttggaggaggagccgccgccgccgccgccgccgccggcggcggcaccatggtcgaggtggacctccacacccacgagccgtgggagctaccagatgtggcgaagctgagcacgaacgagtggtacttcttcagcttccgcgaccgcaagtacgcgacggggctccgcacgaaccgcgccaccaagtccggctactggaaggccaccggcaaggaccgcgtcatccacaaccccaagctgcacgccgccgcccaccgccgcgcctccatcgtcggcatgcgcaag

SEQ ID NO: 1196 - protein, 278 aa, Oryza sativa
MGLREIESTLPPGFRFYPSDEELVCHYLYKKVSNERASQGTLVEVDLHAREPWELPDVAKLTASEWYFFSFRDRKYATGSRTNRATKTGYWKATGKDREVRSPATRAVVGMRKTLVFYQGRAPNGVKSGWVMHEFRLDSPHSPPKEDWVLCRVFQKSKGDGEQDNPTSAASPAATFAGSSQAAVPGQAAYSSDDHTGSSMGFAPRQNEILDSSSHQLLNLAMLQCNSVLDHFPQEVNSSPMMGLAGSIGIGDEYGFFYDTGFEETASLGGMRFPQGWS

SEQ ID NO: 1197 - protein, 331 aa, Oryza sativa
MGLRDIELTLPPGFRFYPSDEELVCHYLHNKVVNQHRFAGVGGAAAAGGGTMVEVDLHTHEPWELPDVAKLSTNEWYFFSFRDRKYATGLRTNRATKSGYWKATGKDRVIHNPKLHAAAHRRASIVGMRKTLVFYRGRAPNGVKTNWVMHEFRMENPHTPPKEDWVLCRVFYKKKAETETESSYSMENEQEAVIAMARSAAAIKAGGCYSNSSSSHDPAAAGHHSPPPFPASLAACSSSHHYSSHPPPPPDHHHHHHMPVTGGGGGSLNEFIPTTSMALYSSIFDFSQHLDGGAVAASASAAGSRVDGGEQCGLMELGLEEHYNYNGLMPM

SEQ ID NO: 1198 - protein, 324 aa, Oryza sativa
MAGLREMESTLPPGFRFCPSDEELICFYLRNKVANHRVASGTLVDVDLHAREPWELPEVAKLTAEEWYFFSFRDRKYATGSRTNRATKTGYWKATGKDRIVHEGTTRAVVGMRKTLVFYLGRAPNGQKTTWVMHEFRLETPNSQPKEDWVLCRVFDKKKPSTIEAEGGGSSGSDLFIPGATDGSTDPSSPTTMAPLLGSSPDPTVVDRFDHRSAAVPPLMVLMQGGGDQMISGSGVHCSNNDNSGSSSALLNLTMLQYSFLEHRPTGDDMAVGAHFGTCQGGNNDATMALGMGFEEHGMGEIIEMEPAWRQGGSNCVYRDELYF

SEQ ID NO: 1199 - DNA, 486 bp, Oryza sativa
cttattcatccaaatagtattggtagcttgttgatcgaagaattaatccatggatggattgatcagtgatgatagtatgatgatgggtggtgaggtgagggcgatcgagtcgaggctgcctccgggtttcaggttccatcccagcgacgaggagctagtcggctactaccttcggaacaagcagcagcagcagcagcagcagacggcggccacctccatgctcgtcgaggttgacctccatgcctgcgagccatgggacctaccagaggtggcgaaggttggttcggatgagtggtatttcttcagctggagggagaggaagtacgcgacggggtggcgcatgaacagagcgagcaagcaagggtactggaaggccaccgggaaagacaagcccatccttcatccgacggtggccggcgccaggaagacgttggttttctactccggtcgcgcccccaacggccgcaagaccgcctgggtcatgca

SEQ ID NO: 1200 - DNA, 603 bp, Zea mays
aaaccatccggctacagcaagcaaccgtagcagtcgtagatgtgcagcgcgcgcagccaattccttcttactcccccgggccttccctctgtctctctcctcttctcttcagatcgacgtgctggttgcagagtgcaaactgcgtatataatatacagttcgttgttcttccagctccgcacataaagatagatagatatacagggaaaaagtgtagtagctggagcagaagctagctagcatggggctgcgggacatcgagctcacgctgccgccggggttccggttctaccccagcgacgaggagctggtgtgccactacctgcacggcaaggtggccaacgagcagctcgcaggcgccggcgcagccatgggtggaggtggatctgcacgcccacgagccgtgggagctccctgacgtggcgaagctgagcaccaacgactggtacttcttcagcttccgcgaccgcaagtacgcgacggggcagcgcgccaaccgcgccaccaggtcgggctactggaaggccaccggcaaggaccgcgccatccacgaccccaggtccgccatcgtcgtcggcatgcgcaagaccctcgtcttctacc

SEQ ID NO: 1201 - DNA, 1439 bp, Zea mays
ccacgcgtccgcggacgcgtgggcggacgcgtgggcggacgcgtgggtttaagagtgtgtcccttggcttgggtccagcagccttcagaggcaaaccgtcggccgccttccagctgcggcaggctggctgcaagagagttcatcgatctagctagctagctagcgtgtgtttagggtacctagctagctagcttcaacatatatatcttagttgcacacacagctcaaaagaaaggaaccatcgatcgatcggcagggagggatggggctgagggagatcgagtccacattgccgccggggttcaggttctatcccagcgacgaggagctggtgtgccactacctctacaagaaggtggccaacgagcgcgccgcgcaggggacgctggtggaggtcgacctgcacgcgcgagagccatgggagcttccagacgcggccaagctgacggcgagcgagtggtacttcttcagcttccgggaccgcaagtacgccacggggtcgcgcaccaaccgcgccaccaagacggggtactggaaggccaccggcaaggaccgcgaggtgcgcagcccggccacccgcgccgtcgtcgccatgaggaagacgctcgtcttctaccagggacgcgcacccaacggcgtcaagtcctgctgggtcatgcacgagttccgcctcgactcgccgcatacgccaccaaaggaggactgggtgctctgcagggtgttccagaagcggaaagacagcgagcaagacaacggcggcggctcctcctcgccgacgacctttgccggcgcgtcgtcgcagggggtcgttctagatctgccggacgaccagcgcccagcatgacgatgcccggcgcgtacgtagcagtggaccaccaccagccaggctcttccgccgtcgggttcgcactgccgccgcatgcgcaggacaacggcctcggcgatggcggcctggacgcgttgctgatgaacggagcgaccatgtggcagtacagctcatcggccctcgccgaccacttcccgccggaggaagtgaccgccgcgcccatgatggggctaggctccaggggaggaggtgacgggtgcagcttcttctacgacagcggcttcgacggcatggggttcccgcagggatggatgggctgaggaggcaaggcaccaactacaacgccatgggatgatggattgtgaaggaaacgattgaattgattccattagtggtagtattgtacagtaggtacgtagtgtgaggttaggtaattggaaattattagagtgcacctccccaatccaaaaaaaaaaacacaacggaatgaaaagtagatcgagcgcatgacgacaattgtatgtatctattcactcttactactatgcttgtacattaattaattagtataaacgaatccaagtacgtaccccccccaaaaaaaaaaaaaaag

SEQ ID NO: 1202 - DNA, 1350 bp, Zea mays
aaaaaaaaaaaaaaaaaaaaaaaaaaaaaaaaaaaaaaataaaaaaaaaaaccacacccccactttgtcccggcctcgcgtccggagagaatcatcgagtcggatagagtcctgggctccaggcgctgcgtactgaacgaagaggcgtgtctcttcgatcgacctccaggcttccagctagctagctagcgagcgatggcattgagggagatcgagtcgacgctgccaccggggttcaggttctacccgagcgacgaggagctggtgtgccactacctccacaagaaggtggccaacgagcgcatcgcgcaggggacgctcgtcgaggtggacctgcacgcccgcgagccgtgggagctcccagaggtggcgaagctgacggccaccgagtggtacttcttcagcttccgggaccgcaagtacgccacggggtcgcgcaccaaccgcgccaccaggacgggctactggaaggccacgggcaaggaccgcgaggtgcgcagcagcagcagcgccaccgccgccgtcgtcggcatgcgcaagacgctcgtcttctaccggggcagggcccccaacggcgtcaagtccggctgggtcatgcacgagttccgcctcgacaccccgcattcgccgccaagggaggactgggtgctgtgcagggtgttccagaagacgaaagccgccgacggcgacggcgatggcggcgcccaagacggcgactcctcgtccccgccggccgccttcaccggcccgtcacggccacgcgccgtgtcagagccgccggaccattccgcgccgccggcgggaggaggctactactacggcctcgcgttcgggccgcggcaggtggaggtggcgcagcagcagtgttacggcggcggcggcgccacggtcgccgaccaccaccacggcttcacgcgagacagcgggggcgctgcagggtttggcgcgacgtggggacgaggagtcgccggcggtgagtgcggggctggctacctcgacatggacggcgcctttgacgtcatgatggccggctgctttggcggtggagacatggatgagttccctcaagtgtggaggtgatcgattgggcaacgtcacggggttattaccatcctcttgaaagaggagaatacatattgttcttactggagacactgggtcagttaaatttattggttgtttaatacacatggggtttggctggtagattagaatgggtttgaaatgctgtgagctcgacaaggttcattgtgaacgtgaactatcaaatgtaaattaattgggaaatcctttcttttctatattatttagtgtatagagttaattgataaaaaaaaaaaaaaaaagggc

SEQ ID NO: 1203 - DNA, 1371 bp, Zea mays
caagatacatcagagtagctcattgcatagtttcagtgtgtaattatatatttgtctcctctagtgcagtactagagtctagtctagctagtttagattgagtctgcttgttcatctagcgcgtgttttggggtagctagctagctagacacgcgcacccggacaaacgcacgcagcagacaccaagcaggaatcatcggcggcaggcggagggatggggctgagggagattgagtcgacattgccgccggggttcaggttctatcccagcgacgaggagctggtatgccattacctctacaggaaggtggccaacgagcgctccgtgcagggaacgctggtggaggtcgacctgcacgagcgcgaaccatgggagcttccagcttcagggaccgcaagtacgcgaccgggccgcgcacgaaccgcgccaccaagacgggctactggaaggccaccggcaaggaccgcgaggtgcgcgacccggccgcccgccccgtcgtcgtcggcatgcggaagacgctcgtcttctaccagggccgtgcccccagcggcgtcaagtcatgctgggtcatgcacgagttccgcctcgactcgccgcgtacgacgacgacgccaccgaaggaggactgggtgctgtgcagggtgttccagaagcggaaagtcgacggcagcgagcaagacaacggcgtctccccctcgccgccggtctttgccggcgcatcgcagtcgcagggggtcgtcctgccgccgggccagcccagcgtggtggacgcgtacgtcgtagtagaccagccgggctcttcttccgtcggactcgcgccgccgcaggagaacctcggtagcggcctggacgcgttgctgacgaacggagcgatgtggcagtacacctcgtcggtcttcggtcacttgttgccgcaggaggcgaccagctccccgccggtgatggacctaggctccaggggaggaggaggaggagactacgggtgcagcttcttctacgacagcagcttcgaggacatggccaacatcgggttccgacaagggtggatgggctgatccaggaccaggaagcacacgtacgtgcgtgcagacttgcagtcatgcgatatggaatgtgcatttgtgaaggaagtgattgaattgattccattagtagtagcaccctctagtgttgtacagtaggtacgtatagtgtgagattggattattgggaattgttagagtgcacgggcctctcaaatccaaagaagtaacagcggaaagaaaagctagtagctagagcacacatgtatatttgcacaaggtagatggtttgatcaaccgcatgacacggcaattgtattatctctccacccctactaccatgtttgt

SEQ ID NO: 1204 - DNA, 658 bp, Glycine max
cggaacaagccaagaaataaatttatataggaatctgtatatgatgggaattaacttatatttatctttggcataaacattactgatgaaagcaattgttagattgaatcaatgacaaagaagagtccaaaagcaatgaacaaaatttgtctgtacagagtagcagaaacaaaatcccaatcccacctatatactaaaaaaaaacataaaatgaaaattaaactaactggtttgaattcataatcatattcgcgatataccagcaacaaattcaatttcaatcaatttaaaataaaattctgcaaacaaatctacgcggtttcatcatcttcccctgtaaacaaacgcgcgcctcttggcggttaccggcaacgggctttccacctcttgttcaccgcctaccttcttcttcccgaaatcaaaccccatcggcgaccagaactccgtcagcggcgccggaaggttcaggtcaaacccacggagcgtgtgggaggaggaggcagcgccgccgtcggaggtagtggcgccgctgctgttgtttccgttggcgttgctgttactgtggttgttcccgccgtcgtagtggcagcgcttgtggccacccagggcctgaccggtagggaaactcttgtgacagatggagggcggccgcgtacta

SEQ ID NO: 1205 - DNA, 1101 bp, Glycine max
ggccgaatcccggtcgagcgaggctccccacgcgtccgtacggctgcgagacgacagaaggggactcaaaattaaccacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaacaaagccttctcctcttaccaagcactcggaggacacaaggccagccaccggaagctcgccggagaaaaccacccgacctcctccgccgtgacgacgagttcggcgtcgaacggtggtggtaggacccacgagtgctccatctgccacaagacgttttcgacaggacaggccttgggaggacacaaacgttgtcactacgaaggcggtaacagcgccgtaaccgcctctgagggagtggggtccactcacacaggaagccaccgcgatttcgatctcaacctcccggcttttccggacttctcagcaaggttcttcgtcgatgacgaggttaccagtcctcatccatccaagaagtcccgtttcaatttgaccatacccaagattgaaatccctcaatactgatgatccatagatccaaaaaaattattcagtgtttttttcttctttcttttttaaagttatttgggattaatttgtccttgtacatatatagtacttgggccttattcgctagttttagcttttagattgtagtcattgtacttttgacagtggcaatgcaattcaattcaattcatttatttttatttgtaaaaaacgcgagactagttccctcgtgccgaattcggcacgaggc

SEQ ID NO: 1206 - DNA, 1178 bp, Glycine max
agcacaccgcgcttacttgctcaccacttgtcacgcaacttccctcatttcctcacgtctttataaaccctcctctcccccctcgcgccccattccgcgtcaactcgatcaactcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccaccggccgccacagccacagccacagccgacaccagatccttccaccaagctcagttacaaatgctccgtttgcgacaagagcttcccctcttaccaagcgctcggtggacacaaggccagtcaccggaaactcgccgccgccgccgaagaccaaccccccagcaccaccacttcctccgccgccgccaccagctccgcctccggaggtaaggcccatgagtgctccatttgccacaaatccttccccaccggacaggcccttggcggacacaaacgttgtcactacgaaggtaacggtaacggaaataacaacaacagtaacagcgttgtcaccgtcgcctcggaaggcgtggggtccacccacactgtcagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaatgaactcgttgaatttttagtttatttttcgactatatattttggagaattttgagagttactataatttgattttgtacatagtacttggaagttttgttggaccgtaccggacccagttctctggttgaggttgtactttcacaacagtggcagatttgcaattcaattcaatttatttgtttattttaattagtaaaaaaaaaaatcaaaattgaaattaaaaaagaaaaaaaaaaaactcgagac

SEQ ID NO: 1207 - DNA, 992 bp, Glycine max
ggactcgagccgagcccaaactcaagttcaccaaaagcaaccacaacaagcacttctcttatttcctatcacaccctattacagattcacaagcgcagacacttcaaatggctctggaagctcttcaatcacccagaactgccactccatcgtttagtccctttgaagaaaccaacctcagttacttggagacaccgtggaccaaaggaaagcgttctaagcgtagccgcatggagcagcaactgcaacactcttcatgcaccgaggaagagtacctcgctctctgtctcatcatgctcgctcacggcggcgccggcggtgtccccgccgccaagcctgctgtctccgacaacaattccgcgccgctacccgccgccaaactgagctacaaatgttcggtctgcaacaaagccttctcctcttaccaagcactcggtggacacaaggccagccaccggaagctcggcggcgagcaccactcgacctcctccgccgtgacaacgagttcggcgtcgaacggcggtgctaggacccacgagtgctccatctgccaaaagacgttcccaacaggacaggccttgggaggacacaaacgttgtcactacgaaggcggtaacagcgccgtaaccgcctctgagggagtggggtccactcacacaggaagccaccgcgatttcgatcctgaacctcccggcttttccggacttttcaacaaggttcttcgttgatgacgaggttaccagtcctcatccatccaagaaatcccgtctcaatttgaccatacccaagattgaaatccctcaatactgatgatccatagatccaaaaaatattcagtgtttttttcttctttcttttttaaagttatttgagattaatttgttcttgtacatatatagtacttggaccttattcgctagttttagcttttagattgtagtcattgtacttttgacagtggcaattcaattcaattcaattcatttatttat

SEQ ID NO: 1208 - DNA, 1010 bp, Glycine max
cccacgcgtcccaacccaacccaaaactcaagctaaattctcactctcacaacttcaatctctttctctctctctctctctctctctctctaccaaaaaaatggctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaagcgctcggtggacacaaggccagtcaccggaaactcgctgcctccggcggcgaagaccaacccaccaccacctcctccgccgccagctccgccaacaccgcctccggaggtaggacccacgagtgctccatctgccacaagtccttccccaccggacaggccctcggcggacacaaacgttgtcactacgaaggtaacagtaatggaaataacaacaacagtaacagctctgtcaccgccgcctcggaaggcgtggggtccacccacaccgtgagtcacggccaccaccgagacttcgatctcaacatcccggcttttccggatttttcgaccaaggtcggagaagacgaggttgagagccctcaccctgtcatgaagaagcctcgccccttcgtcattcccaagatcgaaatccctcaatatcaatgaactctatgaattttttatttttatttttttcgattattttggagaattttgagatttactataatttgattttgtacatagtcctacctggaagttttgttgaaccgtacgtaccggacccagttctctgatttaggttgtactttcacagtgacagatttgcaattcaattcaatttctttatttaatttataaaattatttgatct

SEQ ID NO: 1209 - DNA, 390 bp, Glycine max
gcgtggatcacgcgaccacccttcagaggaagagtaccgtggatcttgactcatcatgcgggctcgcggtggcaccaaccgccgggtcagcactccaccggcgcatccgactccagatgcttccaccaagctcagttacaaatgctccgtttgcaacaagaagcttgccctctgtaccaagcgctcggtggacacaaggccagtcaccatagactcgctgactccggcgaccaagaccaacccaccatgacctacttcggcggcagcttcatcaacaccgactccagaggtaggacccacgaatgctacatctgccacaagtcctttctcaccagacaggccctctgcggacacagacgacgtcactacgaaggtaacagtaatggaaat

SEQ ID NO: 1210 - DNA, 650 bp, Glycine max
ctcgatcaactcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccaccgccacagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaatgaactcattgaatttttagtttatttttcgactatatattttggagaattttgagagttactataatttgattttgtacatagtacttggaagttttgttggaccgtaccggacccagttctctggttgaggttgtactttcacaacagtggcagatttgcaattcaattcaatttatttgtttat

SEQ ID NO: 1211 - DNA, 614 bp, Oryza sativa
gcacgaggctccctgcagctacgtactgtacttgttagcaatcaatcccatcaaatcatccaccggtcgctgctgctgctacgtactatacagcttgattaattaggttttacgacgacggcaacggggacagatatgacggccgccctgcaagcgctgctcgacccgacggcgctgtccttgggcctgcccacgccggcgatcaacaaggaggagtacctcgccatctgcctcgccgcgctcgcctgcacgcgggcggggaaggccctggtgggagtgggaggccagcagcaggtgcaggcctgcaataagtggctgtgcccagcgcccgcggcgcctgaggagctccgcttccggtgcaccgtctgcgggaaggccttcgcctcgtaccaggcgctcggcggacacaagtccagccaccggaagccgccttccccgggagaccactacggcgccgccgccgcggcgcagcagctggcatccgctggtgactcgaaggaggactcggcgtcgtcagcggccgggagcactggcccgcaccggtgcaccatctgcaggaggagcttcgcgacggggcaggcgctcggcggccacaagcgctgcccctactggga

SEQ ID NO: 1212 - protein, 181 aa, Oryza sativa
MALAAAARGESTALALALAPPPPELHFRCSLCGKAFASYQALGGHKASHRKPSAAAAAPPAHRDVVVAAAPASSGRVAADADAASEADGRRRRHVCSLCRRGFATGQALGGHKRFHYLHGPSVSATVSSAATAASVGAAFDLNVAPIKEIAGEQRRCGEEADDDDEAESPSPAKKPRRRPG

SEQ ID NO: 1213 - protein, 226 aa, Oryza sativa
MGLNEKPLVPPLSPTPVDFRAHQVFPSKHHDFDTSKSRNISGSVAIGSDSEEEYLATSLLMLAHGIRDETKDIRGMGDVKGVGVDTLELVKPSQRAYECSVCGKVYWCYQALGGHMTCHRNLFAQVVAGDELSSDRTMVVKGHKCSICRLEFPSGQALGGHMRVHYVGGVEGGSVKEKNVVKTKVTGALKLVLKDFDLNVPVVATMVGDEAESSHSEAKARMMTLP

SEQ ID NO: 1214 - protein, 200 aa, Oryza sativa
MVTNMTHDDYVSLCLMALAQAGVGGQWPAQKQQIDMAPPAPERELLRFRCSVCGKAFPSHQALGGHKASHRKPQTTALPMHVIDAPPPPSAEDTASSSTTTTTSGGGRHRCSVCHRTFATGQALGGHKRCHYWDGLSVVSVTASASGSGSSSVRNFDLNLKPVPETVAAGVTRWGEEEEVQNPLPFKKRRLSSPSLELNL

SEQ ID NO: 1215 - protein, 220 aa, Oryza sativa
MTAALQALLDPTALSLGLPTPAINKEEYLAICLAALACTRAGKALVGVGGQQQVQACNKWLCPAPAAPEELRFRCTVCGKAFASYQALGGHKSSHRKPPSPGDHYGAAAAAQQLASAGDSKEDSASSAAGSTGPHRCTICRRSFATGQALGGHKRCHYWDGTSVSVSVSASASAASSAVRNFDLNLMPLPESTAAAGIKRWAEEEEVQSPLPVKKLRMSN

SEQ ID NO: 1216 - DNA, 864 bp, Zea mays
gcggccgccctttttttttttttttaacctcaattggtagatgcctatatggcctatggcttttatctcaagtatatatggctcgacaaaattaaatacacgtttattcaccgcgcaaacacaaaaactaaaatacggttaaaagaatgaagcaacgaaaacactctacaagcctcagatcgccaaaaggaactctaaatcgttaaactaagttcggtggaaggaccggaggacagccgccgcttcttgaccggcaaggggctctgcacctcttcctcctctcgccaccttgccgcgccggcggccggcaccaaattcagatcgaagcccctcaagctcgacgcggaccccgacgccgccgacgcggtgagcgacaccgagagcccgtcccagtaatggcacctcttgtgcccgccgagcgcctgccccgtggcgaagccccggtggcacaccgagcacctgtgcctcccctgcccggcgccgctgccgcccgccgacgaggtattcgtcgtcaccgacgacgacgacgacgccgcctgtacgagcgtcggcggcggcttccggtggctggccttgtgcccgcccagcgcctggtgcgacgcgaaggccttgccgcagacggagcaccggaagcggagctcgcactcttgcgtcgtcatcgtcgtcgtcgtcctggcactggcagccgcagcgtgccctcctcctcctcccgcggctgcgagcgccatgaggcacagggagacgtagtcgtcgtgggtgatggccatctatcggtcacggcgcgcgagcgaggcttgttgaaaagctaatgctgctagctggttaggtttccgctggtttagcaagtccgatcgatgagtcgac

SEQ ID NO: 1217 - DNA, 758 bp, Zea mays
gaattcggctcgagatcgccatctgcctcgccgcgctcgccgggacccgcaagttcgggctcggtcgggagaaggaccagcaccagcacaccaagtggtgcccgacgacgacgacaacccacgcgccatctgcgcagcaggagcttcggttccggtgcgcggtctgcgggaaggccttcgccacctaccaggcgctcggcggccacaagtccagccaccgcaagccgacgacgccggagcggtacgccgccgcccttgccgccgcggcgacgacgacagcggcccggggcgaccactccgacgagacgacggcgtcgtctctgtcggggtcggcggctagcggcgggccacaccggtgcagcatctgccggaggggcttcgccacgggccaggcgctcggcgggcacaagcgctgccactactgggacggcatgtccgtgtcgatctccgtgtcgtccgggatggcgtcgtcgtcgggcctcagtaccgtcaggaactttgacctcaacctggcgccactgccggagaatggcgacgccgggatgatgaagaggtgggccgaggaagaggaggtgcagagtccgttgccgatcaagaagcgcaggatgtcggactgactactcaccgatgccgtcgtgtctatcgtttcatgtaaaaatggatctacgccatcgttgtgtcgttaatttaatttcttttaattaggttctgtttttctggacataaattcgttcaattcattgattcgtcaaaaaaaa

SEQ ID NO: 1218 - DNA, 436 bp, Zea mays
tccgcgggaggaggcccgcaccgatgcacgatctgccggagggggttcgccacgggccaggcgctcggcgggcacaagcgctgccactactgggacggcgcgtcggcgtccgtctccctgtccgcgtccggtacggggtcgtcgggcgtcacactgaggaattttgacctcaacctgatgcccgtggcggagaacgcagggatgaagaggtgggtcgaggaggaggaggtgcagagtccactgccgatcaagaagcgcaggatcttggattagctctcgcgctactaccagcggttgagacctgtgtgcccacagcctcggttcgtgtaaaaaggaagattgattgtttcatcgattatttgattcgttctttacttctttcacactaataaaatatttgattgttgtatcaaaaacctacctccgcggacccatg

SEQ ID NO: 1219 - DNA, 418 bp, Zea mays
cggacgcgtgggattttcgaattttgagaaagttttttttccttataaccttggtatgtctatctagaacctgtcatgtttaggcaataactgttttgtggttcatcgactgcaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcaaaaccgtctcccagcaaagcagccgcattcccattctatcccgtgcctcggcggagaacatcctttccatgatcgaca

SEQ ID NO: 1220 - DNA, 2158 bp, Glycine max
  misc_feature (2054)..(2055): n is a, c, g, or t
  misc_feature (2057)..(2057): n is a, c, g, or t
  misc_feature (2118)..(2118): n is a, c, g, or t
  misc_feature (2130)..(2133): n is a, c, g, or t
  misc_feature (2150)..(2150): n is a, c, g, or t
  misc_feature (2154)..(2154): n is a, c, g, or t
cggtcgtttgggcagacacacgggcggacgcctgcgccacgcgtccgctctttccctcgttttttaagagagagaaagtagagagagagagaaacacaactgctttgccaaaccttaatttcagggcacttccaagctaacaggaccagttgttgttccctttttgtgttgtttgattcagcgatttctggttttcgttttttttctttctttgttacaaggagagttcgatgtctttaagttgaataacttgttgggacatatttgactcggtgcttttcttttggtgcttgcctcatgggaaacagtgaggatgagaaatctgttaaaactggaagtccttcttcttcacctgcaacaactgagcagaccaaccaacctaatattcacgtctatcctgattgggctgccatgcagtattatgggccaagagtcaacattccaccatacttcaactcagctgtggcttcaggtcatgctccacacccatacatgtggggaccaccacagcctatgatgccaccttatgggccaccttatgcagcattttattcgcatggaggggtttatactcaccctgcagttgctattgggccacactcacatggtcaaggagttccatcttcacctgctgctgggactccttcaagcatagaatcaccaaccaaattatctggaaatactgatcagggtttaatgaagaaattgaaagggtttgatgggcttgcaatgtcaataggcaattgcaatgctgagagtgctgagcgtggagctgaaaacaggctgtcacagagtgtggatactgagggttccagcgacggaagtgatggcaacactgcaggggctaatcaaacaaaaaggaaaagaagccgagagggaacaccgaccactgatggagaagggaaaactgagctacaaaatggtccggcttccaaagagactgcatcttccaaaaagattgtgtcagctaccccagctagtgttgcaggaacattagttggacctgtagtttcttcaggtatggccacaacactggagctgaggaacccttcgactgttcattctaaggcaaattccacaagtgccccacaaccttgtgcaattgtgcctaatgaaacttgcttacagaatgagcgtgagctgaaacgggagaggagaaaacaatctaaccgtgaatctgctagaaggtccaggctgaggaagcaggccgagactgaagaattggcacgaaaagttgatatgttaactgctgagaatgtgtccctgaagtcagaaataactcgactgactgaaggttctgagcagatgaggatggaaaattctgcattgagggaaaaactgataaatactcaactgggaccaagggaagagataactttgagcagcattgacagcaagagggctgcacctgtaagtacagaaaacttgttatcaagagttaacaattccggatctaatgatagaactgcagagaatgagaatgatatctgcgagaacaaaccaaattctggtgcaaagctgcatcaactactggatacaaatcctagagctaatgctgtagcagctggttgaaaccagtaactgcactggctaattatgtaattttggcatattacaagcccaaaattacagcttggtgctaacagttttcagagggatggatcagctgaattttacaatctaattccatctatatagaccagaactaattctttgcttgtgagtttcttagggcataaactctgtattttactagatttcacagaattgaatgacaactttaaaagtttgtaaattgaagagtattagggatttagtttagactttaagagaggcttgtcggccgctgtataattggttgtgtattaactatattggtgtgatctttctaatggtatcttagtcaaggcattctgacttttggttagttttggttttgtatactttaaagcaattcctcatgttgtggctgtggttgccttttaccatgtgtttgttaccacttagtgtgcatttggattgaattaattttagaaatgttaatctgaatgatnnanaaaaaaaaaaaaaaaaaaaaaaaaaaaaaaaaaaaaaaaaaaaaaaaaaaaaaaaaaaaanaaaaaaaaaaannnnaaaaaaaaaaaaaaaanaaanaaaa

SEQ ID NO: 1221 - DNA, 1715 bp, Glycine max
tcgcttcgggatgttttcttggttaccaagattatataggatcatgtgtagattttagatggcagaaatcttggtttatgaattttgtcttgtcccttgcaatattttcatgccgataataattaacaagctgacatggctcctgttaatgcagttgagacatttttcaagaagtagtaaagctccttctacaatattttttgacttggtgctttccttttggatcttacaatgggaaacagtgaggaagagaaatctgctaaaactggaagtccttcttcttcacctgcaacaactgagcagaccaaccaacctaatattcacgtctatcctgattgggctgccatgcaggggccacactcacatggtcaaggagttccatcttcacctgctgctgggactccttcaagcgtagaatcaccaaccaaattctctggaaatactaatcagggtttagtgaagaaattgaaagggtttgatgagcttgcaatgtcaataggcaattgcaatgctgagagtgctgagcgaggagctgaaaacaggctgtcacagagtgtggatactgagggttccagcgacggaagtgatggcaacactgcaggggctaatcaaacaaaaaggaaaagaagccgagaaggaacaccgatcactgatgcagaagggaaaactgagctacaaaatggtccggcttccaaagagactgcatcttccaaaaagattgtgtcagctaccccagctagtgttgcaggaacattagttggacctgtagtttcttcaggtatggccacagcactggagctgaggaacccttcgactgttcattctaaggcaaattccacaagtgccgcacaaccttgtgcagttgtgcgtaatgaaacttggttacagaatgagcgtgagctgaaacgggagaggagaaaacaatctaaccgtgaatctgctagaaggtccaggctgaggaagcaggccgagactgaagaattggcacgaaaagttgagatgttaactgctgagaatgtgtctctaaagtcagaaataactcgactgactgaaggttctgagcagatgaggatggaaaattctgcattgagggaaaaactgataaatactcaactgggaccaagggaagagataactttgagcagcattgacagcaagagggctgcacctgtaagtacagaaaacttgttatcaagagttaacaattccggagctaatgatagacctgcagagaatgagaatgatatctgcgagaccaaaccaaattctggtgcaaagctgcatcaactactggatacaaatcctagagctaatcctgtagcagctggttgaaaccagtaactgcactggctaattatgtaattttggcatattacaagcccaaaattccagcttggtgctaccagttttcagagggatggatcagctgaattttacaatctaatcccatctatatagaccagaactaattctttgcttgtgagtttcttagggcataaactctgtattttactagatttcccagaattgaatgccacctttaaaagtttgtaaattcaagagtattagggatttagtttagactttaagagaggcttgtcgccccctgtataattggttgtgtattaactatattggtgtgatcttcctaatggtatcttagtcaaggcattctgactttgggtcaaaaccaaaaaaaaaaaacaatatttaat

SEQ ID NO: 1222 - DNA, 1775 bp, Glycine max
cccccgcgtccgcccacgcgtccgccctcgcggacacttggagctgcgagcactagttttcccttttccccttgtttgtttttttaggataataattgaccaattgggtatcttgtcagttgagacatttttcaagaagtagcaaagctccttctacaatatttgacttggtgctttccttttggatcttacaatgggaaacagtgaggaagagaaatctaccaagactgaaaaaccttcttcacctgtaacagtggatcaagccaatcagaccaaccagaccaatattcatgtctatcctgattgggcagccatgcaggcatattatgggccaagagtcaccatgccaccatactacaactcagctgtggcttctggtcacgctcctcacccatacatgtggggaccaccacagcctatgatgccaccttatgggcctccttatgcagcaatttatccacatggaggggtttatactcaccctgcagttcctattgggccacatacacatagtcaaggagttccatcttcacccgccgctgggactcctttgagcatagagacaccacccaaatcatctggaaatactgatcagggtttaatgaagaaattgaaagagtttgatggacttgcaatgtcaattggcaatggccatgctgaaagtgcagagcgtggaggtgaaaacaggctctcacagagatggagaagggaaaactgagatacaaggcagtccaatttccaaagagactgcagcttctaataagatgttgggagttgtccctgccagtgttgcaggaacaatagttggacatgtagtttcttcaggtatgaccactgcactggagctgagaaatccttccagtgttcattctaaaacaagtgccccacaaccttgtccagtattgcctgcagaagcttgggtacagaatgagcgtgagctgaaacgggagaggcggaaacagtcaaatcgagaatctgctagaaggtccagactaaggaagccaggctgaaactgaagaactggcacgaaaagttgaatccttgaatgctgagaatgcaacactgaaatcagaaattaatcgactgactgaaagttctgaaaaaatgagggtggaaaagtttttgactcagggaaaacttaaaaatgctcaactgagacaaacacaagagataactttgaacataattgacagccagagggctacacctataagtacagaaaacttactatcgagagttaataataattccggttctaatgatagaactgtggaggatgagaatggtttttgcgaaaataaaccaaactctggtgcaaagctgcatcaactactggacacaagtcctagagctgatgctgtggcagctggttgatacagaaaaccagtaattgtactggctgatcagaggtagttttggcatattacaagcccaaaattactactaacaatttcctgagggatggatcagctgaattttagtatctaaatccatcaaaatcagaactaattcattgtttacttaggacaaaactctgtattctattagatttgacaaaaatggatgaccaagtttgtaaaatgaagagaactagagatttcagattggagggggtttgttgaaacgctacataattgcgtatgtattaacgattggtgtggagactttctaatgatatctacgcagttattctgccttattatttgtttggtttgtattttgtgctagctaaaaaaaaaaaaaaaaaaaaaaaaaaaaaaaaaaaaaaagggcgc

SEQ ID NO: 1223 - DNA, 1597 bp, Glycine max
agtagaaccattatcctcattgtcttatttcttccatgctccaaagtcaagtgattctgtagctacttcttccttgggacgacaccaagcttattttttatttaaaaatacttagtgtatttccattttcttttttgtggatgaagcaatgaactgatgaaagcttcttatattccctcttgtgaattattgtttatcctctcagaatataaatattagagtgtcattcctgtggtgcattgtattacctattctgtgttttgtgagttgttatcaatatgtacccctaatcaatgtcagactgaaattatgcactgaattgctactggatttggcaatcagttggggtaatatctaggatgagatgtgctttgtccctggattgctcaatctgtaaaaaaaacattgattcgatggtataaaactattaattttatccctttcaaattggttcacccagcaagttttcaagtgtgtttggtctctagtgtagtgaatagtgactgtattataatttaaaatgtctactatatcttcaggcatattatgggccaagagtcaccatgccaccatactacaactcagctgtggcttctggtcacgttcctcacccatacatgtggggaccaccacaggtagcccttctgtcgtcttctcgcagccgtgcagcaatttatccacatggaggggtttatactcaccctgcagttcctattgggccacttacacatagtcaaggagttccgtcttcacctgctgctgggactcctttgagcatagagacaccacccaaatcatctggaaatactgatcagggtttaatgaagaaattgaaagagtttgatggacttgcaatgtcaattggcaatggccatgctgaaagtgcagagcctggaggtgaaaacaggctctcacagagtgtggatactgagggttccagtgatggaagtgatggcaacacttcaggggctaatcaaacaagaaggaaaagaagccgtgagggaacaccaaccactgatggagaagggaaaactgagatgcaaggcagtccaatttccaaagagactgcagcttctaataagatgttggcagttgtcactgctggtgttgcaggaacaatagttggacctgtagtttcttcaggtatgaccaccacgctggagctgagaaatccttccagtgttcattctaaagcaagtgccccacaaccttgtccagtattgcctgcagaaacttggttacagaatgagcgtgagctgaaacgtgagaggcggaaacaatcaaatcgagaatctgctagaaggtccagactaaggaagcaggctgaaactgaagaactggcacggaaagttgaatccttgaatgctgagaatgcaacactgaaatcagaaataaatcgactgaccgaaagttctgaaaaaatgagggtggaaaatgctacattaaggggaaaacttaaaaatgctcaactgagacaaacacaagagataactttgaacataattgacagccagagggctacacctataagtacagaaaacttactatcgagagttaataataattcccggttctaatgatagaactgtggaggatg

SEQ ID NO: 1224 - DNA, 538 bp, Glycine max
  misc_feature (327)..(327): n is a, c, g, or t
cttctgttcattctaaggcaaattccacaagtgccgcacaaccttgtgcagttgtgcgtaatgaaacttggttacagaatgagcgtgagctgaaacgggagaggagaaaacaatctaaccgtgaatctgctagaaggtccaggctgaggaagcaggccgagactgaagaattggcacgaaaagttgagatgttaactgctgagaatgtgtctctgaagtcagaaataactcgactgactgaaggttctgagcagatgaggatggaaaattctgcattgagggaaaaactgataaatactcaactgggaccaagggaagagataactntgagcagcattgacagcaagagggctgcacctgtaagtacagaaaacttgttatcaagagttaacaattccggatctaatgatagaactgcagagaatgagaatgatatctgcgagaacaaaccaaattctggtgcaagctgcataactactggatcaaacctagagctatgttgagcactggtgaacagtactgactgctaatatgtatt

SEQ ID NO: 1225 - protein, 380 aa, Oryza sativa
MAHDEAVATQKIGKTTSPPKDQPTPCPFPDWSAVQAYYGPGVLPPTYFAPAIASGHAPPPYMWGPQPIMPPPFGTPYAAMYPHGGAYPHPLMPMMANPLSMEPAKSASSKEKGSNKKLKEVDGAAVSTGSGDSKKTMTSSGDYSAEGSSDVNDLKVGKTGRKRRLDDGAGAETSAAAKMENALPPSHILGSTAILPNHSFPAQVIRPSATNVANSRALGTPISPPPGVIVPSHTGVSTELLIKDERELKREKRKQSNRESARRSRLRKQAETEDLATQVESLTAENTSLRSEISRLSESSEKLRLENSALMGKLKDPAASTQAETSLQKTTTASSPRVVENFLSMIDNTNKTSVRHTEHAEPKLRQLLGSGPATDVVAAS

SEQ ID NO: 1226 - protein, 191 aa, Oryza sativa
MPLDFGLPDMDVGFGLFGVDAAAFGYDGVASDAAAGLSPVVGAGDGSGGGGDVLLYCDGGGGGGGGGEDGEEERRRRLRRKISNRESARRSRARRRQRVEELERAADELRAERRALASRLNATARRALAVRGANARHHAEAGVLRRRLGEAQRNAAVLIGLSRLLRSTANGAHGGAAPAQLSNGGVASLMT

SEQ ID NO: 1227 - DNA, 2359 bp, Zea mays
tttcaattctgcgggcaatgcgttgatttctcccgcctctctgcgcggattcatgcagcatccagctgcatccagttatttggcttagcctcgtcgtttatattagagtagttcgtgggcgatgattattattacggtggctaaattcgagttatgcacatattcatcacggagaccccgagagttggtgcatgatgcactgaatcccagctgcacatgtttaaaacagcgacacagttatatcccagtaggaggtattattttctattgatcttttgagtgcagcatcgtcgcgtcagcagcggcgaagctctatactggtcagacccattaggtgtattccattcccacctacagtcggtgaatcactcgtctgcatctcatcgaagctggtgatgcaagctttgcatgcatccttagcttattaactggtgaagtggtttctttcgccctgtaactctttgggtgtaacttatggagagcgattagcaaattattaccgttttagatagttctgcgtcaagattttaaaccatttttttctgtaagttttttgctgtctctgtcaccctttgcgtgaagagagctaggtgggccgtagaaaaggcttcagttcagatctcatttcagatagcacaggaccaatctggtctgcagtgttcaactggaatataagatttcgctgcataggtcaaaggtttgtacgagtgaaaaaggtatttatttttaagttcatttagtattattttggctggctgaattgtatatttctatgttattttactatactattgaaaaaatgagtaaattgtatgttgtgataatctgaacttttacatgacagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtctgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccatcctctccccgtgcctcggcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtggcctggggattccgcaggctcatgcggctcgagtgctcgccgtaaacgtcagcgttacggactcggactctgtactccagtttaggcactgattccaccgagggtaccggtaattttatctgctctcgcgccagagtgccgggctgcctgcgaccactcctgtgtacccagagttgtaacgtagtagggtgttgtgctgcatgccgaccttttgaaacttttcgagaccgtcatttggaccatttttttcgtcgcaataacacaatacagatcggagtttgtacaggaaaaaaaaaaaaaaacaaaaaaactcgaggggggg

SEQ ID NO: 1228 - DNA, 1646 bp, Zea mays
cctttgcgtgaagagagctaggtgggccgtagaaaaggcttcagttcagatctcatttcagatagcacaggaccaatctggtctgcagtgttcaactggaatataagatttcgctgcataggtcaaagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctgcgaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccatcctctccccgtgcctcggcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtggcctggggattccgcaggctcatgcggctcgagtgctccccgtaaacgtcagcgttacggactcggactctgtactccagtttaggcactgattccaccgagggtaccggtaattttatctgctctcgcgccagagtgccgggctgcctgcgaccactcctgtgtacccagagttgtaacgtagtagggtgttgtgctgcatgccgaccttttgaaacttttcgagaccgtcatttggaccatttcccccgtcgcaataacccaattcagatcggagtttgttccggaaatatgtaaaaaaaaaaaaaaaaaaaaagggcggccg

SEQ ID NO: 1229 - DNA, 1807 bp, Zea mays
cattgggtacctcgaggccggcccctcgcggcccccacgcgctcccgggctcccctgcctcgccgcctctctccctgtcgtacccacctgccccctcgcggtctctctctccttcctgattggatcaatctggcctcgcggctccgactgatccgtggcgcctcgctcccgagcggaaccaccacctgatttgacgagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccatttttgcacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggtgtgctgtgtgatacagttgtacaatgaagcagcatcctgaaacatgggagtggagtctggcttggattatttgtcctaacaacatatcttcaatcttatacttatgccctcccttggtgtaggctgagacagaggagttggctacacaagtggagtctcttgcagcagagaacacgtcccttagatctgaaatcggccggctaacagagagctcagagaagctcagactggagaattcagctctaatggtgaagctgaaggacaccgcagaaccgtctccgagcaaagcagccgcatccccgtcctctccccgtgcctccgcggagaacttcctttccatgatcgacagcgccaacgcgccgagcgtcagcaggcacacggagcacggcggtcccaggctccggcagctcctggactccagtccggcgacagacgtcgccgccgtaagctgacgatgaagctggtccggcaaatacgccacagcacatgcatgtggcctggggattccgcaggctcatgcggctcgagtgctcgccgtaaacgtcagcgttacggactcggactctgtactccagtttaggcactgattccagtgaagtaaccgagggtactcgtaattttatctgctctcgcgccagagtgccgggctgcctgcgaccactcctgtgtacccagagttgtaacgtagtagggtgttgtgctgcatgccgaccttttgaaactttggagaccgtcatttggaccatttttttcgtcgcaataacacaatacagatcggagtttgtac

SEQ ID NO: 1230 - DNA, 1019 bp, Glycine max
attcggctcgagacagaatcataggaaaggagacgtacgatacgatacgatacgatatggatagggtattctcagtggacgatatctccgatcatttctggccgccgcctccgatccccgtctccggcgccaacacctcctctcagatgagccgcagcgcctccgagtgggcctttcagcgcttcatccaggaagcttccgcctccgcaccctctcctccgtcttcttcctccgccgccgacgtcgtattcgtcgagatcgaagatcaacctaaacccgcccctccccctccgacaaacggcgccgttctccccaatgcccctggtcccgtcccccttgactccgacgaataccaggccttcctcaagagcaagctcaacctcgcatgcgccgccgtcgccatgactaggggatctttggctaaatctcaagacccgtcccctttttctgaaggtggatcacagccgactaatccttctctagttgaatctcagactacttctaaaggatctattccttctgaaaatgatccatctaagttacaagataaagataccaatgtaccagttgggattccttccatacctgccatgcaaaagaaacctgctgttgcaattaggccatctacaagtggatcatcaagagaacagtcagatgatgaggacattgagggagagacatctatgaatgacaacacggaccctgctgatgtaaaacgagtaaggaggatgctatccaatagggagtcagcccgacgctctagaagaagaaagcaggctcatttaactgacctagaaacacaggtttctcaattaagaggtgaaaattctaccttgttaaagcgccttactgatgttagccagaaatacagcgactctgctgttgacaacagagttctgagagccgatgttgaaacattaagagcaaaggtaaatccttgccttagtatataggccttaagtaaaacctgttacataggagacctactggactcttgctaagcagttccctaggtttgg

SEQ ID NO: 1231 - DNA, 1881 bp, Oryza sativa
gttgttacttacgcatattttgccgttagttaattattatccggtaaagaagattagtagtaatccaaaattttcccaaccccaacctcggaacaaaaaccgcgtagtatttgtcgtaaccaggagcatccgagtcattaatttacacccaaacacaaaaaattagcagcacgcagccgccttcccaacccccttcccaatcctctcctcttctccaagcggcaattcgcgcgaggttttctccgatcaaaccctcgaatccccccctcgcgaatccatcggagggtagccccgcgatccgcgtcggcgagagcggattccgattccgcgatggagcgggtgttctccgtggaggagatctccgacccattctgggtcccgcctccgccgccgcagtcggcggcggcggcccagcagcagggcggcggcggcgtggcttcgggaggtggtggtggtgtagcggggggcggcggcggcgggaacgcgatgaaccggtgcccgtcggagtggtacttcccgaagtttctggaggaggcggtgctcgatagccccgtcccgaaccctagcccgagggccgaagcgggagggatcaggggcgcaggaggggtggtgccggtcgatgttaagcagccgcagctctcggcggcggcggcggcggcggcgacgacgagcgcggtggtggaccccgtggagtacaacgcgatgctgacgcagaagctggagaaggacctcgccgcggtcgccatgtggagggcctctggcacagttccacctgagcgtcctggagctggttcatccttgctgaatgcagatgtttcacacataggcgctcctatttccatcggaggcaatgctactccagttcaaaacatgctaagtggccctccccgggctgcgggctcacagttggtacagaatgttgatgtccttgtaaagcaggccaccagctcttcatcaagggagcagtcagatgatgatgacatggagggagaagctgagaccactggaactgcaagacctgctgatcaaagattacaacgaaggaagcaatccaatcgggagtcagccaggcgctcaagaagcagaaaggcagctcacttgaatgagctggaggcacaggtatcgcaattaagagtcgagaactcctcgctgttaaggcgtcttgctgatgttaaccagaagtacaatgatgctgctgttgacaatagagtgctaaaagcagatgttgagaccttgagagcaaaggtgaagatggcagaggactcggtgaagcgggtgacaggcatgaacgcgttgtttcccgccgcttctgatatgtcatccctcagcatgccattcaacagctccccatctgaagcaacgtcagacgctgctgttcccatccaagatgacccgaacaattacttcgctactaacaacgacatcggaggtaacaacaactacatgcccgacataccttcttcggctcaggaggacgaggacttcgtcaatggcgctctggctgccggcaagattggccggacagcctcgctgcagcgggtggcgagcctggagcatctccagaagaggatgtgcggtgggccggcttcgtctgggtcgacgtcctgagaccgaaacccagagctgcttcggttctgaaagacactgcgagcaggaaatgatgattggacaggcgtagacattgctaatgctgtgaggttgatgattgttggtcgtcgtcgtcgtcattgtgcattctttgtaagggacacctcttagtaccctcttcttctaagggacttagtaccccttgtggatctcatcgtcctctcgtgccgctcgtgccgctcgtgccgaattcggcacgagctcgtgccgaattccagctgagcgccgtcgcta

SEQ ID NO: 1232 - protein, 284 aa, Oryza sativa
ASGTVPPERPGAGSSLLNADVSHIGAPNSIGGNATPVQNMLSGPSGGSGSQLVQNVDVLVKQPTSSSSREQSDDDDMEGEAETTGTARPADQRLQRRKQSNRESARRSRSRKAAHLNELEAQVSQLRVENSSLLRRLADVNQKYNDAAVDNRVLKADVETLRAKVKMAEDSVKRVTGMNALFPAASDMSSLSMPFNSSPSEATSDAAVPIQDDPNNYFATNNDIGGNNNYMPDIPSSAQEDEDFVNGALAAGKIGRTASLQRVASLEHLQKRMCGGPASSGSTS

SEQ ID NO: 1233 - DNA, 2411 bp, Glycine max
accttccctctctcctccctccccccccgcacatagaaaaacaagcacgcacgcacacgcatacacacacacactctctcttttccactccctcttttggccgccagaacaaacaaaacccacacttcactcccatccaattccaaacccacgttgttgttggtgcatggaatgaccgagtaccggatgaacctgtggaccgacgacaactcctccgtcatggaggccttcatgagctcctccgacctctcctccctctggcttgccacgccgcagtccgccacctccaccacaactccaggcacggcaaaagcccctcctcctcctcctcctcctccgccgccgccggcgcagtcccagtccctcctcaaccaggagactctccagcaacgcctccagactctcatcgaaggcgcctgcgagagctggacctacgcaatcttctggcaatcttcctacgactattcctccggcacctcccttctcggctggggagacggttactacaagggcgaggaggacaaagacaaagtcaaaaccaaagcccccaaaacgaggtcgtccgcagagcaggaccatcgtaagaaggtcctccgcgaacttaattccttaatttccggcccttccgcttcagctgacgacattgacgaagaagtcaccgacaccgagtggttcttcctggtgtcgatgactcagtccttcgtcaacggtagcgggctgccgggccaggctttttttaactcgagcccggtctgggtcgccgggcccgaaagactttccgaatcggcctgcgaacgggcccgccaggggcagctcttcgggctccagactcttgtctgtataccgtccgcaaacggcgtcgtcgagctcgcctccgcggaggtcatttttcagaaccccgatctgatgaacaaggtgcgtgatttgttcaacttcaacaacaacaacaacaacaacaaccctgaaacgtgttcctgggcgttgaattgcgttgccaccaccgatcaaggcgagaacgacccttcctcgctctggctcaaccctgaaatcaaagactcctccaccgtctcgccgccgaattccacggttaataagacgatgcatttcgaaacccctggttccagtaccctaaccgaaacccctagcgctgctgctgctgttcacgtccccaattctaaaagccagggattcttcccgagggaattgaacttttcgaattcattgaaacctgaatccggtgaaattctgagctttggggagagcaagaagagctcttacaatggggctttctttcccggtgttgttgcggttgaggagaacaacaacaataacaagaacaagaagaagaggtccccggtggtttctcggagcagcattgacgatggaatgctttccttcacttccctgccggctgcaaatataaaatcagttaacggtgcttgtgtcggtgccggtgattcggatcactcggatctggaagcttccgtggcgaaacaggtggtggagcccgagaaacggccccggaagagagggcgaaagccggctaacggaagagaggaaccactaaatcatgtggaagccgagagacagaggagagaaaagctgaaccaaagattctatgctctacgagctgtagttccaaatgtatccaagatggacaaggcatcgctgttgggggacgccatattgtacattaacgagttgaaatcgaagctcaacgtgctggattcagagaaaacggaattggagaagcaattggattcaaccaagaaggaactcgagctcgcaactaaaaaccctcctccaccgccaccgccgccaccaccaccaggaccgcctccatctaatagcgtagaaccaaagaagacaacaagcaagctcgctgatttggagttagaggtgaagatcattggttgggatgcaatggtaagaatccaatgcagcaagaagaaccaccctgcagccaggttgatggcagcattgaaagatcttgacttggaagtgcatcacgccagcgtgtctgtggtgaatgatttgatgatccaacaagccacggtgaacatgggaaacaagttttacacgcaggaacagcttctgtcggcactatcatccaaagttggcgatgaactacgatagttccttctgtactattattggtagcagtagctgtagctttctatgtaaattagtgttcttatttttggttagtcctttttggtagcttggactaaattaattttattgaggtaatttgatttgggaagctgaatgatcaaccaggggatagtaatatctctgatgaagtccaagtggattttttttgtgttaatattattatctgtttatattgtatatatatatatatatatgtttatgaattatcataaatgtgaactgatgttggtgaattt

SEQ ID NO: 1234 - DNA, 806 bp, Glycine max
ggtccccggtggtttctcggagcagcattgacgatggaatgctttccttcacttccctgccggctgcaaatataaaatcagttaacggtgcttgtgtcggtgccggtgattcggatcactcggatctggaagctgaaccaaagattctatgctctacgagctgtagttccaaatgtatccaagatggacaaggcatcgctgttgggggacgccatattgtacattaacgagttgaaatcgaagctcaacgtgctggattcagagaaaacggaattggagaagcaattggattcaaccaagaaggaactcgagctcgcaactaaaaaccctcctccaccgccaccgccgccaccaccaccaggaccgcctccatctaatagcgtagaaccaaagaagacaacaagcaagctcgcttgatttggagttagaggtgaagaatcattggttgggatgcaatggtaagaatccatggcagcaagaagaaccaccctgcagccaggttgatggcagcattgaaagatcttgacttggaagtgcatcacgccagcgtgtctgtggtgaatgatttgatgatccaacaagccacggtgaacatgggaaacaagttttacacgcaggaacagcttctgtcggcactatcatccaaagttggcgatgaactacgatagttccttctgtactattattggtagcagtagctgtagctttctatgtaaattagtgttcttatttttggttagtcctttttggtagcttggactaaattaattttattgaggtaatttgatttgggaagctgaatgatc

SEQ ID NO: 1235 - DNA, 1203 bp, Glycine max
ccggttcctgtcgaaatcctcgacgaccacaccatctccttcgccgacatcggcatcgttgccggagtccaagaaaccaaaaagcggagaataaaccaaacacaaacacaaaaacctcccaggaaaaacgacaactatgtcaactccgaacactccgattcggattgtcccacgttgccaaccgccaccaccccgacaacctcggagccgaagaaaagagggagaaaaccgattctcggacgcgagactccggtaaaccacgtggaggcagagagacaacgtagggagaagctcaatcatcgattctatgcgcttcgtgctgttgttccgaatgtttcgaggatggacaaggcttcgctgttgtcggacgctgtcgcctacatcagcgagctgaaggcgaagattgagtacttagagtcgcagcagccgagagacagtagtaaaaaagtgaagacagaaatgacggatactctagataaccatagcaccacgacaatatcgacagtggtggatcaaagcgggcctgaacctagattgggcccaagcccgcttggtctcgaggtcgatgtgaaaatcgtggggcccgatgccatggttagggtacaatcagaaaatgtgaaccaccctggggcgaggctaatgggtgctttgagagacctagaatttcaggttcatcacgctagcatgtcttgtgttaacgatctcatgcttcaagatgtggttgttaagcttcccaatggaatgaggagtgaagagggtcttaaatctgcgattctgatgaggttggatcagtgacactggtgaggttattagctgtaatgtaactgtgagatgttgttgctgttcatagtagtcggtttttggtgtacgttatagataatttgtatttatcttttttgtttttttggggggtctttgtcttgcgtggtgcttgatgacggtggggttggctccaacctgcaattatgtgagggaatctaagaagcctgtcgtttatgttttgtatatataataatccttttggattttgaagttgatcaagaactagactagaagaaaaagtggtcgccatcttgttttaacattcctcaaaatacaaatattataatccaaaccctataatctagtatcactagatttagattttgtatgaataaataatataattaagcatgtgtttactataattttattatataaaaa

SEQ ID NO: 1236 - DNA, 2463 bp, Glycine max
cccacgcgtccgcttactccccctccgcccaatctcaatcccagtgagtgctttctttctgtaactaaccccaatcatcaactcagtcagcgaatgaatctgtggacggacgagaactcctcggtgatggaggccttcatgccatcctccgatctctcctccatctggccccctcccgctcctccgcagccgcaatccacggcggtcttcaatcaggacaccctccagcaccgcctccaggccttaatcgagggcgcccgagagacctggacctacgccatcttctggcagtcctcttacgactattccggctccactctcctcggttggggcgacggttactacaaaggcgacgacgacaaagccaaggcaaaggccaagtccaaagccacctccgccgccgagcaggaccaccgcaaaaaggttctccgggaacttaactccctcatctccggctcctcctccgcttccgcctccgacgacgtcgacgaggaagtcaccgacaccgagtggttcttcctcgtctccatgacgcagtccttcgtcaacggcggaggactgcccggacaggccttcttcaactcgacccccgtttgggtcaccgggagtgaccgtctctctgcctcgccctgcgagagggcgaggcagggacatatgttcggcttgcaaaccttagtttgcataccgtccgcgaacggcgtcgttgaactgggttccaccgagttaattttccagaactcggatctgatgaacaaggtgaaggttctcttcaattttagcaacaacaacttcgacatgggttcttcttggcccgccaccagcgccgatcaaggcgaaaacgacccttcctcgctctggctcagcgatcccgaagttagggattccgttaacactgctgctgctaccccttcggtcatggttcctgcacagactcaggggatttcgatttcaaagaccatgcagttggagagttctattcaaacccctggttccagtactttaaccgaaacccctagttctattcacgcgattccgcagaaccagagcgtcttctccagagaattgaacttttctgagtatggtttcgacccaaagactgggaacaatcagaatcaccattctctgaagccggaatccggcgagattctcagcttcggcgagagcaagagaacctcctacggcggcgtcaatgggaattccaattccaattcccattttttctccggtcagtcgccgtttgttgctgctgcggatgagaacaccaacaaaaataacatcaacaacaatgggaagacaaagtcaccgaattcgcgcggtagcaacgacgacggaatgctttccttcacctccggcgtgattcttccggcctcgaatttgaagtccggtggcggcggcgattccgaccactcggatctggaggcttcggtggtgaaggacccggtggtggagccggagaagcggccgcggaagagagggcgtaagccggcgaacggaagagaggaaccattaaaccatgttgaagcagagagacagaggagggagaagctgaaccagaggttctacgcgcttcgtgctgtggttcccaacgtgtcaaagatggacaaagcgtcactcctgggcgacgccatatcttacatcacggagctgaagtccaagcttcagaccctcgaatcagataaagatggaatgcagaagcagctggaaggtgtgaagaaggagctcgagaaaacaaccgagaacgtttcttctaatcacgcgggtaatagtagtagttgtaacaacaacaacaagttgtcgaatcagaagttaattgacgtgttggagatggacgtgaagatacttgggtgggacgcgatgataaggatccattgcagcaagaagaaccaccccggggcgaggttgttgacggcattgatggagttggacttggacgtgcaccacgccaacgtaaatttggtcaacgatatgaccatgctacaagcaacggtgaagatgggaagtaggttttacacgcaggagcagcttcgtgcggctctggcggctaaggttggggatgcacgatgatgttggctctgcactttgcggcagcgtttgagattatgtgtgtgtttgtgtcgtgttattagctagctagctctttgtaagttgtgctgctctgggatattttaagccttcccggtagctgtttctgtaaaattataagctttttttctttattgggtagcttagtattgaattttgaggtaatcaaattgggaagctccatggagtagtagaactagctagggacacttttcatcaaatctgtgggtggagtggagatagcagcagctatatgtggaaataggggtaattttatctgttttagattgtgtatatattataataatatcataaatgtgaacagcatcatgcaagttctcaatattattattaaaaaaaaaaaaaaaactcgagccgaat

SEQ ID NO: 1237 - DNA, 960 bp, Glycine max
gtaagagagggcggaagccggcgaaccggagagaggaaccattaaaccatgttgaagcagagagacagaggagggagaagctgaaccagagattctacgcgcttcgtgctgtggttcccaacgtgtcaaagatggacaaagcgtcgcttctgggcgacgcgatatcttacatcaccgagctgaagtccaagcttcagaccctcgaatctgataaagatgtattgcataagcagcttgaaggagtgaagaaggaactcgagaaaacaaccgataacgtttcttctaatcacgcgtgtaataataacaataacaacaagttgtcgtcgaatcagccggcgttaattgacttggttgagatggacgtgaagatcattgggtgggacgcgatgataacgatcacatgcagcaagaagaaccaccccgcggcgacgttgatgacggcattgatggagttggacttggacgtgcactacgccaccgtaacgttggtcaacgatttgatgatccaacaagcaacggtgaagatgggaagtagattttacacgcaggagcagcttcgagcggcgctgtcggctaaggttggggatgtacgatgatgttggcactttgcggcagcgttgagattataagtgtgtgtttgtgtcatgttattagctagctatctctttctaagttgtgtgctgctctggggtattttaagccttcccggtagctgtttctgtaaaattttaagattttatttttctttattgggcagcttagtattgaattttgaggtaatcaagctgggaagctccatggagtagtagtataactagctagggacagttttcatcaaatctgtgggtggagtggaaataggggtaattttatctgtttaggtagtgtatatatttataataaatcataaatgtgatcatgcaagttctcaatattattatgcttcagctaaagggcggc

SEQ ID NO: 1238 - protein, 688 aa, Oryza sativa
MEAFMASADLPAFPWGAASTPPPPPPPPHHHHQQQQQQVLPPPAAAPAAAAFNQDTLQQRLQSIIEGSRETWTYAIFWQSSIDVSTGASLLGWGDGYYKGCDDDKRKQRSSTPAAAAEQEHRKRVLRELNSLIAGAGAAPDEAVEEEVTDTEWFFLVSMTQSFPNGLGLPGQALFAAQPTWIATGLSSAPCDRARQAYTFGLRTMVCLPLATGVLELGSTDVIFQTGDSIPRIRALFNLSAAAASSWPPHPDAASADPSVLWLADAPPMDMKDSISAADISVSKPPPPPPHQIQHFENGSTSTLTENPSPSVHAPTPSQPAAPPQRQQQQQQSSQAQQGPFRRELNFSDFASNGGAAAPPFFKPETGEILNFGNDSSSGRRNPSPAPPAATASLTTAPGSLFSQHTPTLTAAANDAKSNNQKRSMEATSRASNTNNHPAATANEGMLSFSSAPTTRPSTGTGAPAKSESDHSDLEASVREVESSRVVAPPPEAEKRPRKRGRKPANGREEPLNHVEAERQRREKLNQRFYALRAVVPNVSKMDKASLLGDAISYINELRGKLTALETDKETLQSQMESLKKERDARPPAPSGGGGDGGARCHAVEIEAKILGLEAMIRVQCHKRNHPAARLMTALRELDLDVYHASVSVVKDLMIQQVAVKMASRVYSQDQLNAALYTRIAEPGTAAR

SEQ ID NO: 1239 - DNA, 870 bp, Zea mays
cgcactccgcggggctccgcgggcacgacggcgggccgcgctgccacgcggtggagatcgacgccaagatcctggggctggaggccatgatccgcgtgcagtgccacaagcgcaaccacccgtcggcgcggctgatgacagcgctccgcgagctcgacctggacgtgtaccacgccagcgtgtccgtcgtcaaggacctcatgatccagcaggtcgccgtcaagatggccagccgcgtgtacacgcaggaccagctcagcgccgcgctctacagccgcctcgcggagcccgggtctgccatgggcaggtaatcaaggaggagagctgctcagctcgcctgtggctgccggaataggggacgacactgatactactgctactcaccaccggactgtcctgtcgtcgtggtcaccacggttacaacacgataggcagaaagattcaggagggagacgacgacgatgccgatgctgtataaactttagaaggatggatggatggatggatgatgataccgagcttctgctcctgttcatcatcatcttctcgtgtttttgctagtagcgtgttaattagcaggattaagcaaccaacaagcgtccaaccgttgttgttaattaagtacatgttgttgtgagctgtgatgatgatggatccaccgatgttagggttcgattggatcgaaaactgtgtatagtatatggatcggccgtcgtcctatccggtggaggtggacgatgccctgatcctgatgtatgtatttttacagcaggatttcgctttgcaatggagtcagcctttttgatccaaaaccaaaaaaaaaaaaaaaaaaaaaaaaaaaaagggggccgctcgcgatctagaactagc

SEQ ID NO: 1240 - DNA, 723 bp, Zea mays
tgcagtgccacaagcgcaaccacccgtcggcgcggctgatgacagcgctccgcgagctcgacctggacgtgtaccacgccagcgtgtccgtcgtcaaggacctcatgatccagcaggtcgccgtcaagatggccagccgcgtgtacacgcaggaccagctcagcgccgcgctctacagccgcctcgcggagcccgggtctgccatgggcaggtaatcaaggaggagagctgctcagctcgcctgtggctgccggattaggggacgacactgatactactcccgcgccccaccggactgtcctgtcgtcgtggtcaccacggttacaacacgataggcggaaagattcaggagggagggagacgacgacgatgccggtgctgtataaactttagaaggatggatggatggatgatgataccgagcttctgctgctgttcatcatcatcttcttgtgtttttgctagtagcgtgttaattagcaggattaagcaaccaacaagtgtccacccgttgttgttaattaagtacatgttgtgagcgaccaaccgatgttagcgttgggttggatccaaacctgtgtatagtatatggatcagccgtcgtcctatccggtggacgatgccctgatcctgatgtatgttttttacagcaggatctcgctttgcaatggagtcaggctttttgatcaaaaaaaaaaaaaaaaacccggggttttcggaccg

SEQ ID NO: 1241 - DNA, 510 bp, Zea mays
gaaagcgttttttgaagcccgcgaacgggcgcgaggagcgggtgaaccacgtggaggcggagcggcagcggcgggagaagctgaaccagcgcttctacgcgctgcgcgccgtggtgcccaacgtgtcgaagatggacaaggcgtcgctgctcggcgacgccatctcctacatcaacgagctccggggcaagctgacgtcgcagcagcccgccgccggaggcgaccacgtggagacggacccgtccatgctatggctcgccgacgcgccggtcatggacatcaaggattccttgtcgcacccgtcggccgagatctccgtctccaagcctccgccgcatccgccgcagatccattttgagaacgggagcacgagcacgctcacggagaaccccagccccttcgtgcacgcgccgccacccccgtcggcgcctgctgctccacagcagcggcagcaccagcaccagcaccagaatcaggcgcaccagggcccggtccgccgggagctcaaat

SEQ ID NO: 1242 - DNA, 1695 bp, Glycine max
  misc_feature (8)..(8): n is a, c, g, or t
aaggcaanttgtttttatcgggaactgaaataaaacccccataggattttctacaggggttatataatccgcataacaatggggagttatattctctgcatacattatacatacataattttatcaactcgagaagctagaaagagaaaaaaaaaaaaatctgctctcatgtcacgtaggccagaggctttttgagaacattacaaaatgctcaagggataatattgagattcctgcttttacgaaaccaaaattcagaaggcattactggcagtaaacttcaaaaatctgacttttcggtcttcgagttgccactgaccactttctcccttctgcagtctctggtgaaaagcttttcaagacatgttgcattgcatgcacgaacctagctacatatcattcacataagcatcatatacctacctaccaacaatgttggtctcactatttcttatgatcactcctgaatgatctcttccgccaatgcatggttgcgaagagttgctgttgtctttgggttcacatgcttgcgtgtcaaaagggaatgatagtctcgtgcctgattcgaattctttgacaacttgagaaccacctaatgtattggcatctgaatggataccacttgattgctggtgctgcaaaatgtcttcccctcgtattggctcagaagatcctcctttgtgttgaagaggtttcatatccgtttggattcggggttccagaccgaaagaagtttctgggttgtcaatgtatggaggatagggcacagatggctgatttgggagattgtgtttgttaggtagattggatgcatagtgcaagggattgttgtcttggtgcagaggcagagtagctgacatgtttaaagaggtaaacctgtttctttcacttaattccatacccatctgagacaactgcagaggctgcaagccttcaggaaagcacataggatgcaaactcaacccatttctcattgacagcatctgtacttgtagctgaagctgtttaaggtattcaatagcttcatcgagcattgaagccttatctgtcttgttagaatttggaattaggttttgcaaagccttcattttctcgttgatcctaccccttctccgcttctctgacaaattatgaacttctgcagctcttgatcttttagatgaactcctagaagaagcagcctttgttggaacttcttcggccggagcctcaacaccctcctcactctcacaatcatagtcatcattctcgttctcactcactccagcagaagaagaagacacatttgcagcagaagcaccatggcccttgaaggaactgcaagcggcagaacccgaggcaaaagaagcggtggaatcaacggccaagatcttcccatcttggagctgtgacgccgtgaaagaagggtggtgtgcatttacgttttgttgagcagcgttggaggtgcaggatccagcaggcatggagtgggaaggtgaagatgaacggagcagaatctgacgcagaaaaagtgagatttcgtcttgtgaggagaggttcttgtcaaagtggtacatgtcacccattctgtgtgtgtgtgtgtgtgtttgaagaatgcagagaactgaaaggggtttcggtttggttgtggtggttttgttttgttttcggacgcgtggtgagaagaggagagaaagaaagtagtaaatggtactg

SEQ ID NO: 1243 - DNA, 1373 bp, Glycine max
acggctgcgagaagacgacagaaggggcaccctatgtagaaaaaacgaaattcccaaaaaatagacagggacataacctaaagcagcatataaatatcacacatcaggtcagataatacacggccgatagcataacagagcacaccaacaccaacatcagcattctcattctctctctgctccctgtcggttttggctttgatctttcaagttcaatggctggtgacgtaggaagagccttgcctcctcctgattcagaagaattctcaaccttgttcagccaactcctccacaattctcccccactaggaatggaccccaatcattcacctcctgatttcaccccacacaacaccaccatcaacatcaacagcaacaacaacaacaacgctgggccttcctctccctcaaatttcaatttaaatttcaatttctctgacccccatcattacatccctgcctctgatgccaccaccttcaagcaacacaacatcaaccacaacaacaatcacacccctgatttcacttcttctcatgttgagaagagtgtggaggcatcgaaacctgtcccaccaccacgttcttcgtcaaagaggagtagagctgcagagttccataatttgtctgaaaagagaaggaggagtaggattaacgagaaaatgaaagccttacagaatttaattccaaattccaacaagacagacaaagcttcaatgctagatgaggccatagaatatttaaagcagctccagcttcaagtgcaaatgttaatgatgagaaatggtttgagcttgcatccaatgtctttgccaggaggactaagacctatgataatgcctcagactggattgaatcttgatgggagtaatggatttcagaattctacctgtgcaattgcctcatcttcaaatgatgaaagcttggtgcggcatgcctttagttttccaaagcaatgcagcatctcaaataagtctattggtgtaccctccgtgaaaaacatagcaacttcggatacctcatccacttttcatccctctattaaggatgcactctacggcaacatgccacaaccgtttatggatacaacaaagattggaaaaccctctccagacgtgtcttaaacagctcgatttcattgagggagaaaagaattttttagatggcaagtcgcctcgtaaaagggtagctttgttcaggcattataatctacatttaaatctgctgactatatgacactccattgggttgttcctggtgcagtttaatttgtagcagtttgacagagtctttgtgccattgttgacacttgcataaaaatgtacaagtattttataacttcatcaattgcaaaatgcagataatgaacattctgc

SEQ ID NO: 1244 - DNA, 930 bp, Glycine max
ctctctctctccaagttgtttttggtttgatctttcaagttcaatggctggtgacgtaggaagagccttgcctgctcctgattcagaagaagggtgagccttgttcagccaactcctccacaattctcccccactaggaatggaccccaatcattcacctcctgatttcaccccacacaacaacaccatcgacatcaacatcaacaacaacatcatcaacaacaacaacaacaacaaccctggtcctttctcttccttcaaatttaaatttctctgacccccatcattacatccctgcctctgatgccaccacctttaaacaacacacccctgatttcacttctttttctgttgagaagagtgtggaggcatcgaaacctgtcccaccaccacgttcttcttcgtcatagaggagtagagctgcagagttccataatttgtctgaaaagagaaggaggggtaggattaacgagaaaatgaaagccttgcagaatttaattccaaattccaacaagacagacaaagcttcaatgctagatgaggccatagaatatttaaagcagctccagcttcaagtgcaatacttgtgattgattctgcagatgttaatgatgagaaatggtttgagcttgcatccaatgtctttgccaggaggactaagacctatgataatgcctcagactggattgaatcttgatgggagtaatggatttcagaattctacctgtgcaattgcctcatcttcaaatgatgaaagcttggtgcggcatgcctttagttttccaaagcaatgcagcatctcaaataagtctattggtgtaccctccgtgaaaaacatagcaacttcggatacctcatccacttttcatccctctattaaggatgcactctacggcaacatgccacaaccgtttatggatacaacaaaga

SEQ ID NO: 1245 - protein, 315 aa, Oryza sativa
MGLDRCESEVGVRCPRLIRSDAGGDLAALGSSESEQPTRPARPRGKRSRAAEVHNLSEKRRRSRINEKMKALQSLIPNSSKTDKASMLDDAIEYLKQLQLQVQMLSMRNGLYLPPVNLSGAPEHLPIPQMSAALDQNSAKASDPSVVLQPVNQTSGALLPFELASQHKPLFLPGVPNATALEPRFLVESSRSNLQSLRFTEPAEMIYPDEMMLKHRLTSASESTIVPGTDEKSVRQNTYMMNADRFDRYALSKDQLQHIMPKNTESVLDMPHLQRILTKVLIVSDYKLTIQLPILDRLQTSDTKVRVEGRIKVNP

SEQ ID NO: 1246 - protein, 315 aa, Oryza sativa
MDEQRGRGGFDELVLLHQQQEQRRRREQQQEEEEEEEVRRQMFGAVVGGLAAFPAAAAALGQQQVDCGGELGGFCDSEAGGSSEPEAAAGARPRGGSGSKRSRAAEVHNLSEKRRRSKINEKMKALQSLIPNSNKTDKASMLDEAIEYLKQLQLQVQMLSMRNGVYLNPSYLSGALEPAQASQMFAALGGNNVTVVHPGTVMPPVNQSSGAHHLFDPLNSPPQNQPQSLILPSVPSTAIPEPPFHLESSQSHLRQFQLPGSSEFHKILFLHVLLSVKDGVSWRDNAKAPPIITSRKSARKRDELHQERIIHVEHQ

SEQ ID NO: 1247 - DNA, 670 bp, Oryza sativa
aactagtggatccccgggctgcaggcaatgaacctctccaccccaccccgcgacgcgacgcgacgagccgtacaccgaccgccccgcgccgctgctgccggagccggagagagaagctgaagccgaagcagaggcagccgcagcggcaaaactcaaaagacgtcgtcaaaagctctgccgcgcttgcagctttctcgggctcaaggaaaagccatcacaaaaccagagacacacagagagagagagagagagagagagagagagagactgaagaaaggtggcaactcctgcagcagctgcagcagcaagcgctagtgtttgtggtttgctggtgctgtggcgaggcgatgatggatgggcgaggaagccaggaggaggagcacctggatttgatcatgcgacaccacgccagcatggggctggatcgctgcgagagcgaggaggcgctggggtcgtcggagtcggagcagcccaccaggccggcgcggccgcgcggcaagaggagccgcgccgccgaggtgcacaacctctccgagaagaggaggaggagcagaatcaatgagaagatgaaggccctgcagagcctcattcccaactccagcaagacggacaaagcctccatgcttgacgatgccatcgagtacctgaagcagcttcagctccaggtcca

SEQ ID NO: 1248 - DNA, 908 bp, Zea mays
  misc_feature (6)..(6): n is a, c, g, or t
cggggnaaccgtcccgtctccaatcctaaatgcacccgccgtttgcgatgcgacggacgacgacgcggccggaggagagggaggcccgcgaccgaggcgaagcgcaggaccgccggcactgcagccgatcgaaaggcgctctcaaaagctctgcgctgcgctggcagctttgagctttctcgggccggagaaaagccgaaacaaacaaacggactggccgagtcgaggagagagagagggtgagagggagaagagaaggcggagagagaaagcgagctgaggagcgcaggcgctgtcgctggcgaggacatgctcgcggcagcgcggtatgggctcaaaccataggcgtgtcaggaacggtggagagcggcgaccactactcgccttcgtctcggtcctcgcgcgctcctgggctgcctcttggtgctagaaaccctcgcgtcgcgggtgcttggttgcgactgcaagcgccaagctgctgtgctgtgccgtgggtggcggcggcgggagtggaagtggaaccgcagccggtgctgtgatggacgcgcagcagcagctggatttggtcatgcgtcaccagagcatggccaccgtctgcgagagcgaggacgcgctggggtcgtcggagtcggatcccgcgaggccggcgcgcccgcgcggcaagaggagccgcgccgccgaggtgcacaacctctccgagaagaggaggaggagcaggatcaacgagaagatgaaggcgttgcagaccctcatacccaactcgagcaagacggacaaggcttccatgcttgatgatgccattgagtacctgaagcatcttcagctccaggtgcagatgttgtctatgaggaatggcctctatctgcccccaggaaacctggtctggagcacccgagactctggcaccc

SEQ ID NO: 1249 - DNA, 1362 bp, Glycine max
  misc_feature (1356)..(1357): n is a, c, g, or t
acgagagagtatagacattttgtattgatggcaaatcttgcagcagcattgagagatgtggcaagttttaggggctgtgatgtctcaaatggacaagctattacatcctctagtggattgcatggtactttgaacttctcatctaggccatcctcttgctccacccggatgccacagattgctgaaaatggaaatgaagatgtggaagcaaattgtgttgaaagtagaaacctgagaaatgacaatatcaacaccactaaatgttacatgcctagtttcaccactgacttctgggatggttctgcattcagtgcctccagaacagctagtaacagaggtgaaatctcattttccacttcaaaggctatggatattcaggatgaagattttggataccaaaaagttggtttgacccaccatttgagtctgcctggctcttccagtaggatggctacaatggagaagctttatcaaattcaaggatctgttccatgtaaaattcgtgccaagagaggttttgccactcacccgagaagtattgctgaaagggaaaggagaacacgaattagcgcaagaatcaagaaattgcaagaccttttcccaaaatcagacaagcaaacaagcactgcagatatgttggatttggcagttgagtacattaaagacttgcagaaacaagttaagattctcagagatactagggcattcggcaccagtacaagcaatcagaagcactgatttatatatccttgtagataacaaaaagaaggagcatttttttttcttttcatgtatttatcctttggtgtaccaaaatttttggtcagtgtgattatgtagagtagcgctgatatttgctagtatctaagaatttaggtccaggtccgtgtgagtctcttcagttttgtttttcattttccctcatttgttttttctttctttcctttgcttgatttaagtatcacaatgtaataaaaagtttagaaagagccaattgtaactgttcattttactcataagaggtttgatggcatcacaaaataaaattgagtctcaactgtcacacgctaaagattgagttctatatggaagaaattaccggtgcaataagtagttaagatctttgtattcgtgttgcaaatatagggggtgtcctgattaggagttcagaaaagaggggtggaattgccttgatgttgaaccaatgccaagctatgcacactccagtgcttatcatcatttcagaagggtgatgaagacattagatgtgagaggagaggtctagcttatattagatgtagcaaagaagagtgctgggaatttattttccaatacaccgaatttgttagaacaacnngatca

SEQ ID NO: 1250 - DNA, 1108 bp, Glycine max
  misc_feature (1065)..(1065): n is a, c, g, or t
ccacgcgtccggaaagaatcagagtgccaaaagctcccacgcgtccgttctcaggcaaagtagcttccctgctggccatttctctaacaacatctcctttcagaacgggtatgatactatgaaaggtgttggaaactatagtggggtcaatggcaatgatggtgaacttagtctatctatgaacagaatgaagaatcaaataagcttctcatcaataagtccttcttcttccttgggagtgctatcaccaacttccaaaataggcacggagggtattagggtaactagcactgaggatgggaggcagggagggagcaatggtgatgctcgatattttggccctggattctcctatgcttcttggaatgagccttcacaccacaaaagacagcgaagtagtaatgatgagttactttctgattctcaggatggagaactaggaaatcaagttcaaacactttcgcatcatttgagtttgccaagaacgtcgtcggatatgtttgctatggatagtttgcttcagttttcagattctgttccttgtaaaatcagagctaagagaggctttgctacacatcctcgaagcattgccgaaagggtgagaagaagtcggatcagtgaacgaataagaaaattgcaagagcttgttccaaacatggacaagcaaactagcacagcagagatgttggacttggctgtagactacataaaagatcttcagaaagaattcaagactctgaacgataaacgggctaaatgcaaatgtataaacatgcagaagtcagaagcagatcaagttgcttgagtttcttttgtacaggtaataaaaaggaactacgccaaacatgaataggacccgggttttatattttgacgtgctgaaaaatcaatagaacaaagttaatatgcagaatgccagcttttaactcttcatgccacattgtgtattttgagttaacgggagttccagccacacagacaataaatcataattttgtatacaaaaattctaatgaattaattttagcttatttttccccgtgctcctaaacttaaaaaaaaaanaaaaaaaagaaaaaaaaaaaaataaaaattataataaaaacac

SEQ ID NO: 1251 - DNA, 1883 bp, Glycine max
  misc_feature (1827)..(1828): n is a, c, g, or t
  misc_feature (1835)..(1835): n is a, c, g, or t
  misc_feature (1847)..(1847): n is a, c, g, or t
  misc_feature (1853)..(1854): n is a, c, g, or t
cggacgcgtgggtttctactctcacagctgtttattttcttcctcttctcaactgtgttcgtgtgtatgcatttgagttgaaagccagactcaaggagctgaaagacaaaagaagaaacttggatttgaatcagccaaaatttgagttacacgtaattgcaaagataagatgagtgttatgtatagtcctgttctcaattactcagatgtggagcatcagctaaggaaaaatcaagacatggattcaagtattggacatccacaacaacactgtcaccaacccaattctggactattgaggtattgttctgctccaagctcattgctggcaagcctcattgacaacaccattcatggctgtgtcaacgaggaatcgttcacaagtgagaatcatcatcatcatcagcagcagcagcagcagcattatcttccatctacaagttcagaaatggagaccatgttatccaaattgctaccatccaacaatggatggagcaattcagaagctttgcaagaatttggaggcaagccctgtgaagcaggaaataggggaatctattccacaagagccaccacaacagaatggttattcttatggtggctctcagttgatttaccaatctcagcaaattcaaggccttgccaaatggtggatcttccagtggcttctggcagtgcttttgatggctcttttggtgtggtgcactccatggcttcagaggactccattcaatctaaaatgggtatcaggaattgctccaatctctttaggcaaaagagttcccctgctgcatttttctccattgaaaatgatcttgcagcattgagagaagtaggaagctttaaagccgatgatgtttcaaatggactagttactgcatcaactggtgggttgcatagttctcatactttctcatctaggccatcttcatgcttgaaacggttgccacaaatagccgaaaatggaaatgaaagcctagaagaaaattgtgaccaaagtagaaacctagtaaatgacaatggtagctcaaaatgttacatacctagcttcaccaatgaattatgggaaagttctgcattcaatgccccaaaaacagagaatgaagatgaaatcatgttttccacttcaaatattttggaatctcaggaagcagatttcagctttcaaaatctgggtttgactcaccatttgagtctacctagctcttctactaagatgtcatccatagaaaagtttcttcagattcaaggttctgttccttgtaaaattcgagccaaaagaggctttgccactcacccaagaagtattgcagagagggtaagaagaacaagaattagtgaaagaatcaagaaactgcaagacctttttccaaaatcagaaaagcaaacaagcacagcagatatgttagatttggcagttgagtatattaaggacctgcagcaaaaagttaagatactctcagattgtaaggcaaagtgcaaatgtacaagtaatgagaagcattacactagaacttgtgcttgatttatttgcatgtagatagcaaaaggatggaagattttttagtgtgccaaagttagcaattgtaattagataaaataatgctgacatttgcctggagtgagtttaggaccaggtgaattttttttttttacttttttttttcattttttcccttaatttctttttcttcatagtttgatttaaggatcataaagacctagcatgtttagcatgagttttgtagctcttcattattacatataagaatttatgttgaaatttaaaaagaaaaaaaaagaaaaaaaagaaaaaaaaagggcggnnccgtctnctagagagaatnccaagnncttacggtacgcgggtgcagtgcgacgtc

SEQ ID NO: 1252 - DNA, 1503 bp, Glycine max
cttcgttaacagcttaaacagtgaagaagaagattcgctccaccacaagctctcaactgattcttcttcttctgctgcggttaaggaagatgttaaccaacaagaccagggtatcaacgaggaacacgtggcggtggctgcgctacagcagagtaataacaacatcaataattacaacaacaacaacaacaacaactactctgcttctcataatttctaccaaagctcctcctccaaacctcccttgccgaaccagaacccgaaccttccctcagctatggagcaaggatcgttttcaatgggactcaggcatagtggaaataattctaaccttaccaggcatagtagctctcccgcaggactattttcccaaattaacattgaaaatgtgtatgctggtgtgagaggcatggggagtttgggagctgttaacaacagtatcgaagatgcgaaattttctagttcgaggaggttgaagaatcaaccgaactattcttcgtcggggagaatgtcgtccattgctgaaattggggacaaagggtatagagaaagtagtccagacagtgaagcttttgctgatggtaacgattttatggccggtttccaagttggtcattgggatgatactgcaatgatgtctgacaacgttggtggtctcaaaagatttagtgaagaagattcaaaaccattttctggcttaaatgcggttgagactcagaatgaaacgggacagactcatgctcctttggcccatcagttgagtttgccaaatacttcagctgaaatggctgccattgagaagtttctgcagttttcagattctgttccgtgcaaaatccgtgccaaacggggctgtgccactcacccaagaagcattgcagagagggttagaagaactaaaattagtgagcgtatgaggaaacttcaggatcttgtcccaaacatggacaagcaaactaacacagctgatatgttggacttggctgtggattacatcaaagaccttcaaaagcaagttcagacactttcagattgtcatgcaaagtgtacgtgttcacacgagaagcaacaataacggaaaaaaagggagattggtcgacttagcttgtgtttctatatcccgttgaaattgaaaagcttgagttcaatgctccagaagcaaccaatcaattcttgctattgggaaaacgtgtgtttaggacttttcccatacacttagtctctgtacagattagtaataatttgattgcgaagctagaatctagattgatttttctctatttctgtacttacaaagatatatttaaattattgggccatttcagtatccaaaataatagattaaaaaaaaagtttatataaatttatcttgctgtagggtgccgctgttcaggtgccacttttttcaacggttgtgaaggcgggggagaataattgcttataaaagttgacttttgatgccgcatgtcatgtctgtataaaaagttgtgttgtgagtttaat

SEQ ID NO: 1253 - DNA, 1185 bp, Glycine max
gagctgtagggtagtacaattatgttgtcaacttagagataaaaaaaaaaagactaattattttgggggttactattaggcttcatgtttgtttagggcgtgaatgggtttatgtatgggttgccataatgatgttatgaaagcttaattggcagtgtatgctggtgtgagaggcatggggactttgggggctgttaataacagtatcgaagatgcaaaattttctagttcgagaaggttgaagaatcaaccgaactattcttcgtcggggagaatgtcgtccaatgctgaaattggggacaaagggaatcgagaaagtagtccagacaatgaagcttttgctgatggtaacgattttatcaccggtttccaagttggtcattgggatgatgctgcaatcatgtctgacaacgttggtggtctcaaaagatttagagaaaacgattcaaaaccattttctggcttaaatgcggctgagactcagaatgaaacaggacagactcatgctcctttggcccatcagttgagtttgccaaatacttcagctgaaatagctgccattgagaagtttctgcagttttcagattctgttccgtgcaaaatccgtgccaaacggggctgtgccactcacccaagaagcattgcagagagggttagaagaactaaaattagtgagcgtatgaggaaacttcaagatcttgtcccaaacatggacaagcaaactaacacagctgatatgttggacttggctgtggattacatcaaagaccttcaaaagcaagttcagacgctttcagattgtcatgcaaagtgtacgtgttcacacgagaagcaacaataacggcaaaaagggagattggtcgacttagtttgtgtttctataccccgttgaaattgaaaagcttgttgagttcaatgctccagaagcaaccaattcttgctattgggaaaacgtgtgtttaggacttttcccatacacttagtctctgtagtctgtacagattagtaataatttgatgatcgcctagctagaaatctagattgccttttctctatttctgtacttagaaaaatacatttaattgtttggcccttcgtgtatccaaaataaagataaatatatataaatttatgtagctgtagggtgccggtgtgcaagtgcaacttcttcaacggttgtggagg

SEQ ID NO: 1254 - DNA, 1693 bp, Oryza sativa
gcataaacatttgtatttttagatcatggaaatgacacaacaactaataagtttgttggaaaaacgaaaaggagacatacaaggtgatttacagcaaaaacaacagttttttttttttttttctcttttttggtgccaaagaggaggatacttttaataagagcaatgataataagaagcaatcccattggcgttgaaatggatgattttacatacaagccactgccttacatcaattaaaatacaacaattaatctactttgtcaccgcctactcttcaagtcattgacgctgtccataacacaaccgataaaggggagggcgaggcatggaggccacttgacatgtgaagtgcttttacaccctaatcttctgaagcaaaactttgggttcaccaatcacatcattacaacattagctcggagatctggttctccagcctcagcaatcgtgcttgcctgagcaagtgcagtttgcttggtcatgttttagcttctcaacttggccctgaagctccttgatgtaggttacagcaatatccaacatgtctgatgtattcgtttgcttgtccatgttcggcacgagatcctgcagcttcttcagcctcttgctaatcctcgttctcctctccctctcagcgatgctccgcgggtgcgtcgcgcagccgcgctttgcccgggccctgcaggcgacggagtctggctggagctgcaagaagtcatccatgccggccatctccagcgacgactgcttcgacaagccaaactgggagtcgatgttgctgaagctggagaccatgtcgtcgccgtggtcgccggcggcggcggcggccacgcgggccttcttgctgctgctcgggggcgagaacatgatggagttggtgtcgtcccaggagctcatggagaagttcctggaggagaggaaggaggaggactgcgcgccgtggccggcgccatcgctggagctgttgccgccgccgccggtgacgatgctctccccgatgtcggggatgaggccgcccatctccgatatctgcggcaggtcctgccgcgagaagctccactgcgagctcagcctcctgtgcgccatcgcgccggcgtcgccgccgccgccggagtagccgcccatccctctcgtcgcggccatgccattgccgtgcgggtcagccatgaggcgggagaggaggccggcgggggagctgctgtggcggaagagcgggacggcggcggaggaggcgtcgacgtggatctcgccggagccgccgtacgcgcgctcgagcgggtgccgcccgacatcggccgccgccgctgtggacgtcgtcgtcgtcgtccggcagctggactcgcaggaggtgagccccgacgactccgcggagaagtacctccccaccatctgctgctgctgcggcggcggcggcggcggaagctgatgctgatgctgatgatgatgcagctgatcgacaaccccaaccccgcggccccggatcaccgagtcggcgatcgacgccagcctcgtgcccggcgccgagccgtacctcgccagcccccccgccgccggcatcggcggcggcggcatccccccgtgcggcgccgtcatcctgttcatctccggcggcgcggcggcggcggtggtggtggtgggtggaggcggaggcggaggcggaggcggaggtggacttggttttgcaggttgc

SEQ ID NO: 1255 - DNA, 1121 bp, Oryza sativa
caggaacggcgcgaacgccgccgccgcggccgactcccccggcggcagcgggggcaggctgaaggggcagctcagcttctcgtcgcggcagggctcgctcatgtcgcagatctcggagatggacagcgaggagctcggtgggagcagccccgagggcgccggtggcggcggcggcggcggtggccggggttacctctccgggtacccgatgagctccgggtgggaggagtcgtcgctcatgtcggacacgaacatctccggcgtgaagcgccagcgcgactcgtcggagccgtcccagaacggcggcggcggcggcggcctggcgcaccagttcagcctgccgaagacctcgtcggagatggcggccatcgagaagttcctccagttccaggacgcggtgccctgcaagatccgcgccaagcgcggctgcgccacgcacccgcgcagcatcgccgagcgggtgaggaggacaaggatcagcgagcgaatcaggaagctgcaagaactcgtgccaaacatggacaagcaaaccaacactgctgacatgctggatttggctgttgactacatcaaggatcttcagaagcaggtcaagggattaaacgacagccgagctaactgcacctgctcagcgaagcatcagcagtactctggctagaaagctttgtacaagtcatggagacttcagaaaagaacacaagattgttttggagattaggcaggactgagacgatctctgaagatgtgtaatggttaatttcatttgtttgggggggtttaattagagaggcacatggaagaaaaggctcttgtgtgccaaagcactgtataagcaaagggcaatggagcagtggcatcatcaggattcaagtgataaaaagaaaaaggaaaaacaagggagaaaaagggtgggagatgggtgaaacaattgtatagttttcttgtaacttttgccatatatacccctgcatgccccatgtccagtgcattttcgatagaaatttattactgctagtagtttgtaggttagtagtctcatttaacaccatggctctcgccgacctgctcatctcactaataaatattattgcagtgcctttgccccttgcttttttgcggtc

SEQ ID NO: 1256 - DNA, 890 bp, Oryza sativa
gcccccctcctccgcctccgccgccgcgtcgccggagatggccgccatcgagaagttcctccagttccaggacgccgtcccctgcaagatccgcgccaagcgcggctgcgccacccacccccgcagcatcgccgagcgggtgaggaggacgcggatcagcgagcggatacggaagctgcaggagctcgtccccaacatggaaaagcaaaccaacactgctgacatgttggatcttgccgtggactacatcaaggagctccagaagcaggtcaaggtgttaaacgacaagccgttccagctgcacctgctcggcgagcaagcagaagcacttcgccggctaaatcaatcaagtcaatcaatcgccatgaccggtgcagcagtgcgcaacacacgaacggccgcaaaaggcatgcagcagaagcatctgcaccggcagtttttctaagcttcgtttccttctttgctgatgaattcgctggtctatctggtaaattgaacatgagggcattggattttggagcagtggcatgcattcttcagagttcacaaagatgatgggttggggtcccacatggtagtggtagactactgtagctgcaaagcttgattaattaattagcctgttcttttgataatgaaggagaggagagtaactcacaagtgtatagatggttgtctcatctctgtttgtcatagtacacaccaagtgcaagttgcagctgtgtctgcttgcaagaatgcatgcccatgtacattgcatccccctttgcttgaccaatgacacatccagacagcctccctatcctgtttcctctcgttgctacaccctgtttttgtgaagtacatgcatcgcaacaatgttcacgaataaaaaaaaaaaaaaaaaaaaa

SEQ ID NO: 1257 - protein, 372 aa, Oryza sativa
MPAAGGLARYGSAPGSLLASIADSVIRGRGVGVVDQLHHHQHQHQLPPPPPPQQQQMVGRYFSAESSGLTSCESSCRTTTTTSTAAAADVGRHPLERAYGGSGEIHVDASSAAVPLFRHSSSPAGLLSRLMADPHGNGMAATRGMGGYSGGGGDAGAMAHRRLSSQWSFSRQDLPQISEMGGLIPDIGESIVTGGGGNSSSDGAGHGAQSSSFLSSRNFSMSSWDDTNSIMFSPPSSSKKARVAAAAAGDHGDDMVSSFSNIDSQFGLSKQSSLEMAGMDDFLQLQPDSVACRARAKRGCATHPRSIAERERRTRISKRLKKLQDLVPNMDKQTNTSDMLDIAVTYIKELQGQVEKLKHDQANCTCSGKHDC

SEQ ID NO: 1258 - protein, 401 aa, Oryza sativa
MYGAPVSKDLSLQPAGVRTPPQMSSPGLLRYRSAPSTLLGEVCGDFVLPGGGGGGGQLQLQLQQQRPGSPDHAADTVLARFLAGHGGHDNKPPRPAAHFAPPEDSMASHQQQLMYQSHQQQQQMASAMEGLYRTVSSGGTESTAAAAGNSLLRQSSSPAGFLNHLTMDNGYGNMLRAGMGGGGGGGDPRLKGQLSFSSRQGSVMSQISEMGSEDEELAGGGGSPEAGSNGGGAARGGYGGGYAMGSSAWEEPSPPATSLLPDSSLPSKRPRDDLPRQLSLPAASKNSSKPPSSASAAASPEMAAIEKFLQFQDAVPCKIRAKRGCATHPRSIAERVRRTRISERIRKLQELVPNMEKQTNTADMLDLAVDYIKELQKQVKVLNDSRSSCTCSASKQKHFAG

SEQ ID NO: 1259 - DNA, 553 bp, Oryza sativa
acatctccggcgtgaagcgccagcgcgactcgtcggagccgtcccaggttcgattcacaaaattcccatcgattccgttgatagatgatttgtacaagaaactgacgacgacgatttgtggcggtggcgcagaacggcggcggcggcggcggcctggcgcaccagttcagcctgccgaagacctcgtcggagatggcggccatcgagaagttcctccagttccaggacgcggtgccctgcaagatccgcgccaagcgcggctgcgccacgcacccgcgcagcatcgccgagcgggtaaaaaacaacaacaaaattcctcttcaccctcctcaccgcaccgcacagcacaaattcgttaatatcaaacgagcagcagcagccagcaggtgactgatctgatccccgtgatgttgatctttgccataggtgaggaggacacaggatcagcgagcgaatcaggaagctgcaagaactcgtgccaaacatggacaaggtactgatgagtactacacctctctctctctctctctctctctctctcttccccaatagg

SEQ ID NO: 1260 - DNA, 986 bp, Zea mays
gcggccgcccttttttttttttttttttgagtcgaaacactatcgctcgcattgaacgcatccaagtttttctacaacttatctgcggcacatttacagctgctacaactagcaatagaggtaaattaaccactttataccgaaagtgtagtatacatatagcaaagctacaacgaaactatacagttgtttctcctatatatctccccaattttacccttctccctatcacttgaatgcttgaggatgatgccattgttccattcccctgtgctcatataaagctacacactgtctggtagataagcctcaaatgctacagttcaaacccacaaaaaaaatgagagctgtcttacatctttttctatcccaagtgaagatgctttcgagttctgcaggtcatgtatagcgtgcatcagggcttcagcaagagtgctgctggctcttgcttgctgggcaggtgcaattagcttgggtctcctttaacaccttcaatgaacagaccacagaacagaaagggactctcaaagtctgttttagagtgtctatttcagataagtttaacagaacgctgtatgtgactttctcctttcagttgaagggcaacaagtaagtatagtttggttttagaccttactgcttagggctggttgtctttctaaataaggccatgtttggaacctctagagctcattagttggctcagcccagctaacaatttgttagccggctaactattagacctaggttccaaacagggcctgacaagtgctcatctgcagagaacttactggattgcttaccttaacctgcttctggagttccttgatgtagtcgacagccaaatctagcatgtcagatgtgttggtttgcttgtccatgttcggaacgagttcttgcagctttcggattcgctcactgatctttgttctcctcacctgagccccacgcgtccgcggacgcgtgcggtcgacccgggttttcaa

SEQ ID NO: 1261 - DNA, 1103 bp, Zea mays
caaaaaaaaaaaaggaaaaaaaaccaaaagaacgggggcttaggcgccgtccaatgtaaggggccacctggggggaaacccccccaccccccgcggtttattgccccggtaaagggggggtcccttttcccattagggtggggcacttttttgaaagggggatcgggggggccttttttttaatttccccacctggcaaaagggggatttgccccaagggcattattttgggtaacccaggggttttccccgctccaagttttttaaccaccgccccggaattttaatttgggggcccctaaaaaaaatttttattttgccagccccgggaagtaaaatttggttccttaaaaaggccccccccttttttttttttttttttttttttttttttttttttttttttttttttttttttttttttttttttttttttttttttttttttttttttttttttttttttttttttataaccatttgatgaaattttataaaatagggccgctgttggaaggatgttttatggttttgagccctatatttaaaataggaccatgtttagagcctctcttggagatgctctaacataggtaaattacccactttctactgaaagggtagtgcgtgtgtgtatatatagaaaagctacagccaaactatacagttgtttctcctatatatatatctctccccacttttttttacccttctcccaatcacttgaatgcttggtgatgccattgctccatccctcttcgctcatacaaaagctacagtgcctggtagataaagcctctcaactgctgcagttcaaaacctcatgaaacaacatgcatgagagctgtcttacatctttttctttcccgagtggacatgctttcgaggtcatgtacagtgagcattacggtttcagcaggagtgctgctggttcttgcttgctgagcaggtgcaattatcttggctctcctttagcaccttaacctgcttctggagatccttgatgtagtcgacagccaaatccagcatgtcagatgtgttggtttgcttgtccatatttggaacgagttcttgcagctttcggattcgctcactgatctttg

SEQ ID NO: 1262 - DNA, 903 bp, Zea mays
agcgacgccgcgcagtcctcctcctacctctccaggaccttctccgtcggctcctgggacgacaccaactccatcatgttctcgtccgcccccagcaagaagcccaaggtggaccccgccgacgacatggtcgccagcttcagcaccattgacccgcaggtcagcgcgcgccgctttccgtgcctagcctgcctagctccggccttaatttgccgctccccggcgtcaactatcatcgacggcgtggttccatgctgacgggagtgagctgtttttttttttttggcttgctatatgtatgtccactgtccagttcggcctgtccaactcgtccctggagctgcccggcatggacgactacctgcagctgcagcaggactccgtcgcctgcagagtgcgtgcgaggcgtggctgcgcgactcacccacggagcattgccgagagggtcagttcatctactcgatccttcggtccttcccaaacgattcgctaaaaaaaagcacggcgcaatatatggtgccacactctgccagctttgatgctagctggatgtcagcacagaaaccaatttcgttttccttgttcgctggcgtacgttcaggaaagaaggacgaggatcagcaagaggctgaagaagctgcaagacctcgtgcccaacatggacaagcaaacgaatacgtcggacatgttggaccttgctgtggagtacatcaaagagctcaaggaccaagttgagaagctaaaacacgaccaagcaaactgctgttgcctaggcaacaagagctgctgctgatgctggagaagcagacggaggagggtttttacgccgtaacaatgtgactgttaaaccagagctgttgcttcaggagaccaggccgcgggcagaagtgcgtgacatgtgga

SEQ ID NO: 1263 - DNA, 868 bp, Zea mays
gaattttcggggcgacccacccgtccggtttgtccagttcggcctgtccaactcatccctggagctgcctttcatggacgactacctgcagctgcagcaggggtccgtttcctgcagagtgcgtgcgaggcgtggctgcgcgactcacccgcggagcattgccgagagggaaagaaggacgaggatcagcaagaggctgaagaagctgcaagaccttgtgcccaacatggacaagcaaacgaatacgttggacatgttggaccttgctgtggattacatcaaagagctcaaggaccaagtcgaggtacgtacgtatcgcttggtgtgcaaacaaaaataacactatctcttaccatgctaaaaataatactatctcttacctaggcaaaaataatactatctcttaccatgctaaaaaacatggatccttgcagaagctaaaacacgaccaagcaaactgctgttgcctaggcaacaagagctgctgctgatgctggagaagcagacggaggagggtttttacgccgtaacaatgtaacatgtggagcggcttccatgactcagcttcctcttttcttggttgttccacggactagcgacccggccggtgccaacggcttgaagactaggagataacaagtaggacgatgttgtaatttagctaccacgacgcggtggctctggcttgcgtgtaaagaagtcctccctttcaacgcgactgggattgttgttgctggtaaaattgttgtaggaatatcatctgcgctccatttttctttgggcgcctcttttttttagtgtgtgtcactggattttgacaagaccgtaactcagaaaccgagcactgaccgagcgttcatgccacccc

SEQ ID NO: 1264 - DNA, 1158 bp, Glycine max
ctttctctctcttctgttttcctttttctcgagaaaattgtgttagggtttctgtgattgagcctgcaaacacttccttgagggcacaaaagattccattgtttgcttctttcagattaatttttttgtcagttcagatcttcaagaagaagaatccagagaagctatatatacatcatcgttgttctttgccaagacaaagaagaaaaatggtgagggggaaaactcagatgaagcgcatagaaaatgagacgagtaggcaagtaacgttctccaagagaaggaacgggttgctcaagaaggcctttgagctttcggtgctgtgtgatgctgaagtcgcactcatcatcttctctaccagagggaggctttatgagttctccagttcaagaggtgcctaagaaacttttaattcgttgtctattggagatgctccagtataaacaaaacagttgaacgctatcaaaggaagatcgaggacctgggtgtcagcaacaaaggaatccatgaaaatacacagcatctgaaggaagttgatatgagcatggcaaagaagatcgagcatctagaagattcaagaagaaagcttttgggagatgaattggataaatgcagtattgacgagttacaacagctagagaaccagctcgaacgcagcctggacaaaattagggcaacaaagaatcaattgttcaggaagcgaatcgagaagctaaaagaagaggaaaagtgcttactcgaagtaaataaacgcttacgtgagcagtaccggattgaacgacaacgttgtttgagtgatcaggatgtcgaattcgccacaaaaaaggagggagaagaggtggagacggagttattcataggaagacctgagagaagaatgccgttaaagttgaaacctacaacatatagtgctcatgcatacatagcgtaatctaaagattaaaaattactaatgcccatacaaacgctgctagcttccttgcagactgttatattcatgtcttattaagatatgtaattcttgttgtaccccaaatcacaacggcggttgtgaacgcctacttaaataatttatgtacaacagtcattatttcaaaactgttcgttagagtactatatatatcagtttggaatttttttaaaaaaaaaaaaaaaagg

SEQ ID NO: 1265 - DNA, 683 bp, Glycine max
  misc_feature (644)..(644): n is a, c, g, or t
ctctttctctctcttctgttttcctttttctcgagaaaattgtgttagggtttctgtgattgagcctgcaaacacttccttgagggcacaaaagattccattgtttgcttctttcagattaatttttttgtcagttcagatcttcaagaagaagaatccagagaagctatatatacatcatcgttgttctttgccaagacaaagaagaaaaatggtgagggggaaaactcagatgaagcgcatagaaaatgagacgagtaggcaagtaacgttctccaagagaaggaacgggttgctcaagaaggcctttgagctttcggtgctgtgtgatgctgaagtcgcactcatcatcttctctaccagagggaggctttatgagttctccagttcaagatgctccagtataaacaaaacagttgaacgctatcaaaggaagatcgaggacctgggtgtcagcaacaaaggaatccatgaaaatacacagcatctgaaggaagttgatatgagcatggcaaagaagatcgagcatctagaagattcaagaagaaagcttttgggagatgaattggataaatgcagtattgacgagttacaacagctagagaaccagctcgaacgcagcctggacaaaattagggcaacanagaatcaattgttcaggaagcgaatcgagaagctaaaag

SEQ ID NO: 1266 - DNA, 1777 bp, Oryza sativa
  misc_feature (53)..(53): n is a, c, g, or t
tcggcacgagggcgaggaggtgggacgagagacgacggcgatccacggccaantggcgattgccggtctcggtcggtcgcactcgcgctcgcgcgcgggcgcctcgtgggtcgcgggtttcccaggacgggaagtcgctcgcgcggtcgccttctttatttggctaccgccgccccccggccccccgcattccgcacgaggctcgtctcgtctcgtctctccactcccccacctcccatccgctactgctagtactactactacccggcctctcgccttctcgcgcggccgcgatttccgttcgcaaatccgcacccacggcggcgcgaggtcgccgtcgtcgtcgagccatttcgggggggtagtttataagggcttgcgcgaggagggggaggagtagcgggtagcggcggctcgagtcgagtcgagtcgccgtcgtcgtcggcggcggcggtcgagagagatcgggatcgatggtgcgggggaggacggagctgaagcggattgagaacccgacgagccggcaggtgaccttctccaagcgccggaatggcctcctcaagaaggcgttcgagctctccgtcctctgcgacgccgaggtcgccctcatcgtcttctccccccgcggccgcctctacgagttcgccagcgcccccagcctacagaaaaccatcgaccgctataaagcatacacaaaggatcatgtcaacaataagacaattcaacaagatatccagcaagtcaaagatgatactttaggtttggccaagaaacttgaagctcttgatgagtccagacggaaaatattgggagaaaatttagaaggatgctctattgaagaactgcgtggtctagaaatgaaacttgagaagagcctccacaacataagactaaagaagaccgagcttctggagcggcagatagccaagctgaaagagaaggagcggactttgcttaaagacaacgaaaatttacgcggaaagcatcgcaaccttgaggctgcggcgctggtggctaaccacatgacgacgacgacggcgccggcggcgtggccgcgggacgtgcctatgacgagcagcacagccggcgccgccgacgccatggacgtggagactgatctgtacattggattgcccggcactgagcgctcctccaaccggtcggagacaggttgaagaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaaacggaaacaaagaattaacaaagctgtagcagaccagatcggcaaattgaaatgccaggtaatccagtatatatttcgcttccgttattcagggtggtggtgattgggcctctgacgtgtgggtgcttgggacggaggatttcttgggggttgttttttccccgagccaaatcaatctgctcgtgcccttgagatttcagttccgcccataagaactcccacgcacatttagcattcggagagtaattttgttaggttaaaagtatggtaagttataggtggtatgttatgtttttctttttcttttctcaatgttatctggtacctaagtttgtcaagaaaatcatagtggacacagtcaagtatttggggc

SEQ ID NO: 1267 - DNA, 448 bp, Oryza sativa
gcagaattggccataaaaatgcattcttttgcacaagcacaggagaagaaaaaaagatggaatttttactccccccctgcagcattctctctagtctcttcttgggatttgattcatcctagtttagctagctattgctgcatgtatgcacacaccttcctttctttatcttttccgatgggtgcccaaatcgagtaaaattctactccatgcatgcaactttcctgaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcagcgccatcgccggtgacgtcgctggccccgccgccggcgacggc

SEQ ID NO: 1268 - protein, 186 aa, Oryza sativa
MGLTWTPHISVPRHHPLFTIFSPFLLLSLSQSCLCRPPAGGEEAGGELLLRDRELRGRTRRRGRRVPPHLLNSHHSFYDGLYVGGVADARIRPALRTLKQNMSLLLSVLIDRVQPVAQPLVAGVGDGKGAAQRELLEHNGLLGGEEGDRSGSRAGNRWPRQETLALLKIRSEMDVAFREAVLKGPL

SEQ ID NO: 1269 - DNA, 381 bp, Oryza sativa
gcggtggcgccggagatgtcgtcattcttgctctgcgggaggaggcggcggggggcggatctccatggcggaggccgcgtcgcccatcagcagccggccgccgccggcgcagcagcagttcgacgagctcggcgtaggcggcggaggcggaggcggaggtgggtttgacgccgaggcgctggcggcggcggcggtcggcgaggagggagccagcggcggcgcggtggggaaccggtggccgcggcaggagacgctggcgctgctcaagatccggtcggacatggacgccgcgttccgggacgccaccctcaagggcccgctctgggaggaggtctccaggaagctggggaggagggttacccgaggagcgcgaagagtgca

SEQ ID NO: 1270 - DNA, 469 bp, Oryza sativa
  misc_feature (405)..(405): n is a, c, g, or t
ttgtttgcggcggcggcggtcggcgaggagggagccagctgttgcgcggtggggaaccggtggccgcggcaggagacgctggcgctgctcaagatccggtcggacatggacgccgcgttccgggacgccaccctcaagggcccgctctgggaggaggtctccaggaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcggcgccatcgccggtgacgtcgctggccccgccgccggcgacggctgtgggggtgtccggcggngtgcgcgcccccgacgagccgtcgtccgcggtggtgatggggaacgtgatgagcttttcgacgt

SEQ ID NO: 1271 - DNA, 660 bp, Zea mays
gactagttctagatcgcggcggccgctcgcgatctagaactagcccacgcgtccgcggacgcgtgggcggcgcacagcaggtggagatgccgccgccattctcgccggctggcggcgccgggcagcggatctcgctggcggaggcgccgtcgcccatcagcagccggccgccggcatcgacgccggcgaagcagtacgacgagctcggcgcgtccggcgccggcgccgtgggcttcgacgccgagggcctggccgccgcagcagctggcgaggagggcgccagcggcggctcggcgggcaaccggtggccgcggcaggagacgctggagctgctcaagatccggtccgacatggacgccgccttccgggacgccaccctcaagggtcccctctgggagcaggtctccagtcccaccactacgctgccaagaacggaggcaccgggaacgggaacggcggcggcgcatcagagcacggctccagaggcatgcaaacgcaggcgagcaacggcagcgttggagccagcaggttcgtcggcgaaggcggcggcgcggcctcggcggcgaagaagccagaggacattatgaaggagatgatggagcagaggcaggcgccgcagcagcagcagcagcagacgcaggcggtgggtcagtggctata

SEQ ID NO: 1272 - DNA, 649 bp, Zea mays
  misc_feature (545)..(545): n is a, c, g, or t
aattcggcacgaggagcctccttcccttctccactcttatccctctctgagtggtaacacacctggcgacgtgcacgagtgcgcgtgtgcgggagcagtagctgtactgtaagcatgcagcagcagcagcacgggggaggcggcggagcaagcggtggaggcccagcgcagcagttctgcgcacagcaggtggagatgccgctgccattctcgccggtcggcggcgctgggcagcggatctcgctggcggaggcaccgtcgcccatcagcagcgccgggcgcggcgcccggcgccggctcagcagtatgacgagctcggcccgtccggcgccggcgcagtgggctttgacgccgagggcctggccgccgccgcagctggtgaggatggcgccagcggcggctcggcgggcaaccggtggccgcggcaggagacgctggagctgctcaagatccggtcggacatggacaccgccttccgggacgccaccctcaaggcccccctctgggagcaggtctccaggaagctggctgagaaagggtacaanccggagcgccaagaagtgcaaggagaagttcgagaacgtgcacaagtactacaagcgcacaaaggagagccgcgccggccggaacgacggcaagacgtaccgat

SEQ ID NO: 1273 - DNA, 750 bp, Zea mays
cattgggtacctcgaggccggccgggaagactatcagaaggtgaaggagagcaacaagaagcggcccgaggactccaagacctgcccatacttccaccagctcgaggccatctacaacagaaagcacctccgcagtctcacaaccgcggcgggtcgtcgggcgcgtccagcaaccggtggccgcgggaggagacgcaggcgctcatcaggatccggtcggagatggacgcaaccttccgcgacgcgacgctcaaaggccccctctgggaggacgtctccgggaagctcgccgacctgggctacaagaggagcgccaagaagtgcaaggagaagttcgagaacgtgcacaagtactacaagcgcacaaaggaaggccgcgccggcaggcaggacggcaagagctaccgcttcttcgacgagctggaggccttgcacgcagccgcgccgcagccgccgccgccgctcctgccgccgcccagcaccgccccgcagttgcacgccctcgccgcgccagtatccccgccgccccagcagcagttgccggcatccagcgccgccccgccgttgcacgccttccccgcgccagtatccgcgccgccgccgctcctcgtcccgcctacccagatcagctgaacccgagcaggcaagagatagaggggaagaacatcaacgatgacaagagggacaacggtggatcaggtggaggcacgcaggtgccgaccagcaatggcgagacagcgacgacgacga

SEQ ID NO: 1274 - DNA, 2438 bp, Glycine max
ttgaattcccgggtcgacccagcgtccgcccacgcgtccgggtggatcaaataattcgggggacgatgagaggggtagaatcgaagaaggtgaacgtagcttcggcggtaaccggtggccgcgacaagagactttggccttgttaaggatacgctccgatatggacgtggcgtttcgagatgcaagtgtcaagggtcccttgtgggaagaagtatccaggaagatggcagagcttgggtatcacagaagctccaagaagtgcaaagagaaattcgagaacgtgtacaagtaccacaagagaaccaaagaaggccgaagtgggaaacaagatggcaaaacctatcgtttctttgatcaactacaagcccttgagaaccactctccaacaccccattctcccaacccttcaccaaaacccccacaatcagcaccatcaagagtagtagcatcatcggtgtcactaccaattgcaacaacaacaacagtgtcactaccaattccaacaccaacaacagtgccaatgcagcctatattgtccaacaacgctatactcactagtagtgtccccaatatcactgttccatcaacaacaccactccctataaccattcctcaacccattctcacctccccatcaataaacctcacaatcccttcttaccctccaacaaaccctaccaatttcccaccaccaccaaaccctaccctaccatcctctttccccaccgacaccttctccaattccagctcctcctccacctcctccgaggaaacattggaagggagacgcaagaggaagcgcaagtggaaagatttcttcgagagactaatgaaagaagtgatcgagaagcaagaggagctacaaaagaagttcctggaagccatagagaaacgcgaggacgacagaatagcaagagaagaagcatggagagtacaagagatgaaaagaatcaatagggaaagagaaatcttagcacaagaaagatccatagccgcagccaaagacgcagccgttatgtcattccttcaaaaaatagccgaacaacaaaacctcggtcaagtatcgaccaacatcaacctcgtacaacaaccacaacctcaattacaaccgcagccaccactacaacaacaagtgacacaacctagtattgcagcagcacaacctcccgtacaacagccaccgcccgtggttgttacacagcccgtggtgctgccagtggtgtcacaagtgacgaatatggagatagtgaaagccgataataatagtaacaacaataataacggcgagaatttcttggcaccaagttcttctcggtggccaaaagtggaggttcaggcattgataaagcttcggacgagcatggatgagaagtatcaagagaatggaccaaagggtcctctctgggaggagatctcagcctcaatgaagaagctcgggtacaaccgaaacgcgaaaaggtgcaaagagaaatgggagaacatcaacaagtacttcaagaaagtgaaggaaagcaacaagcggagaccggaagattccaagacgtgcccttatttccaccagctggacgcgctgtacaggcagaagcacaggggcgaagagagccccgcggcggtggaggcgaagccggagagcgcggtggcgccgttgatggtgcagccggagcagcaatggccacctcagcagcagcagcaggatagggacatcacaatggaagacatggagaacgaagatgatgaatatgaagaagagagggaaggagaggaagaattagaggatgatgaagatgaagaggatgaagaaggtggtggtggtggtgggaactatgagatagtggcaaacaaaacaagtggtggtggtggtgcttctgctgcttcagtgggggcttcaacggagtagtagtgtgaagaaaccaggtttagcgtgggggtgggtcagagagagtgcaggggttgtcggaggtggccattgtggtggagaaattaagaatttgaatattcacgtacggtgaagttacacatggcaatggttatggtatcgacctgtggtggaaagatgaggtttgctttggttggttggtactttgttgtagcatatagtcagtaagattatatgtttcttttttctgttttataaaaaaagttgtttattttttgggagaataaataaaagtccgatcagagagggaatttaagatagagaccaataaagaagaagaggggccttaattaaggttgtatttttttttttttttatcttcatcttgttttttatgttcgttcctggtgctgtaaatgggaggagagattaattcgggttttgtccttttcttatctctttaagttttgacatcttgttactcttcaaatgactgacattgacttctctttcaaaaaaaaaaaaaaaaaaaaaaaaaaaaaaaaaaaaaaaaagggcggcc

SEQ ID NO: 1275 - DNA, 1338 bp, Glycine max
cggcttgagcgaacaacaaaacctcggtcaagcgttgaccaacatcaacctcgtacaaccacaaccacaactacaaccacaaccaccggtacaacaacaagtgacaccacctaatatagtaccagctcctatgcaacaaccactgcctgtgattgttacacagcctgtggtgttgccagtggtatcacaagtgaccaatatggagataatgaaagccgataataataacaacaataacaataataacaactgcgaaaatttcttgccaccgagttcttctcggtggccgaaagtggaggttcaggcattgataaagcttcgaacgagcatggatgagaagtatcaagagaatggaccaaagggtcccctctgggaggagatctcagcctcaatgaagaagctggggtacaaccgaaacgcgaaaaggtgcaaggagaaatgggagaacatcaacaagtacttcaagaaagtgaaggaaagcaacaagcggagaccggaagattccaagacgtgcccttatttccaccagctggacgcgctgtacaggcaagaagcacaggggcgaagagagccccgcggcggtggaggcgaagccggagagcgcggtggcgccgttgatggtgcagccggagcagcaatggccacctcagcagcagcagcaggatagggacatcacaatggaagacatggagaacgaagatgatgaatatgaagaagagagggaaggagaggaagaattagaggatgatgaagatgaagaggatgaagaaggtggtggtggtggtgggaactatgagatagtggcaaacaaaacaagtggtggtggtggtgcttctgctgcttcagtgggggcttcaacggagtagtagtgtgaagaaaccaggtttagcgtgggggtgggtcagagagagtgcaggggttgtcggaggtggccattgtggtggagaaattaagaatttgaatattcacgtacggtgaagttacacatggcaatggttatggtatcgacctgtggtggaaggaggatgatgaggtttggttggtactttgttgtagcatataatcagtaagattagatttttttttttcttttctgttttataacagtttgtttattttttgggagaataaataaagtccgatgagagagggaatttaagatacagaccaataaagaagagagggaccttaattaaggttgtattttttcttttcttttatcttcatcttatttttttttaatgttcgttcttggtgctgtaaatgggaggagagattaattcgggtttaaaaaaaaaaaaaaaaaaaaaaaaaaaaaaaaaaaaaaaaaaaaaaaag

SEQ ID NO: 1276 - DNA, 869 bp, Glycine max
  misc_feature (784)..(784): n is a, c, g, or t
  misc_feature (833)..(833): n is a, c, g, or t
cggctcgagcggctcgagcggctcgagcggctcgagaaaaaatttgaaagaattcaccaccctttttgctctgtttatatttttaatttttctcctgctctcagctgctgtaagtaattgttgcggtgctgttttggcaaagagggagagagagagagacccaaaagagactatgctcggggactcagctctgttgggaggaggaggaggagaaggtggtgcctccgccgatgtagtggcggcgaccgccacgcatgatgcgacaacgacgacgacgaccggaggaggcggtggcggatcaaataattcgggggacgatgagaggggtagaatcgaagaaggtgaacgtagcttcggcggtaaccggtggccgcgacaagagactttggctttgttaaggatacgctccgacatggacgtggcgtttcgagatgcaagtgttaaaggtcccttgtgggaagaagtatccaggaaaatggcagagcttgggtatcacagaagctccaagaagtgcaaagaaaaattcgagaacgtgtacaagtaccacaagagaaccaaagaaggtcgaagtgggaaacaagatggaaaaacatatcgtttctttgatcaactacaagcccttgagaaccactctccaacaccccattcccccaacccttcatcaaaaccactacaatcagcaccatcaagagtagtagcaacaacaactgcatcatcaatgtcactaccaattccaacaccaacaacaacagtgccaatgcagccaatattgtccaacactatnacccacaagtagtgtccccaatatcactgttccatcaacaacaatactncctataaccatacctcaacccattctcaccacccca

SEQ ID NO: 1277 - DNA, 1546 bp, Glycine max
ggctcgagaaacttgtcagtaacaataatggtttggtagaagtagtagtcgcccttgaaacaggacaaacgatacgaactttccccaactcaaaacaacacacagactccagttactgaaattgccctgtttcatttttctcccctaaatttcaccgacgctgtcttttttctcttttgccctcacccttttgagagcatcatagctgtaacttgggcgttaccgatgctggaaatctcaacttcacaggaaaccccgctagagaacgcggacggcggctccgcggcggtctcggacgggtcgaaagccgagcacggcgaggacgatgaccggaatcccgccgcgaaccggtggccgacagaggagacaatggctttgctcaagacaaggtccgtaatggacgttgcttttcaaagaacgcacaccctcaaagccccctctctgggaaacaagcctcaaggaaattatcggagctaggatataatagaagtgctaagaagtgcaaggagaaattcgagaacgtttacaagtaccataggagaaccaaagaaggtcgttttggaaaatcaaacggtgcaaaaacttatcgatttttcgagcagttggaagccttagacggaaaccactcacttcctcctccgacaacaaccgacgacaccgacaacaacaacaacgttggtgatgatgttgttatcctgaacgcggttccgtgttcggttagtgcggcggcgcacgagcactcgagttcgacgacgtcgtcttcggggaagatgaagaggaagctgacgcggtttctggaggggctgatgagggaagtgatagagaagcaagagacgctgcagaggaagttcgtggaagtgttggataagtgtgaaaaagatcgaatggcgagggaggaagcgtggaagaaggaggaactcgaaaggatcaagaaagaacgcgagcttctggctcaggaaagatcaattgctgctgccaaagacgaagctgttcttgcttttcttagaaagtttgcagaagcagaagacacggtgcagttactcgagaaaattcaggttcaaaacgacaaacagaaaaacatgaaacaaaatggcggtaatgataatgctaatggaggtggtggtgtcgcagttgtcactgatatggataaacaagaatgtggaaataatggtgttagtgttgggaattttgtgcacatgagtagttcgcggtggccgaaggatgaagtggaggctttgataaggttaaggactgagtttgatgtgcaggcacaagggaataataataatagtaataatgggtctaaagggcctctttgggaggagatatctttggctatgaagagcaccggttatcgcccgaagtgcaaaccggtgtaaagagaaatgggagaacataaacaagtacttcaagaggatcccggcggtcgtcttctcgaaacctcaggattccaagacgtgtccttattatcaccaccttgaggctttgtacagtaagaagcctaagaaggtggtggatcatgggaacgagttgaagcctgaggagc

SEQ ID NO: 1278 - DNA, 2165 bp, Glycine max
  misc_feature (2147)..(2148): n is a, c, g, or t
  misc_feature (2161)..(2163): n is a, c, g, or t
ggctcgaggctgtaattgcatagggacacaacatctctatagctatatgcagctaggagactcaagtgtgttggagatctcctcccatacccagcctgagatggcggtgacggcagcagtgttgccaccagaagaagtagcccatgatggcagcgacaacagtggtggtggtggtggtggtgagatgattgggatggacttggatgcaaattcaggtgaaggaaatgaaggtaataataagatgagctttggagggaaccggtggccccgccaagaaactttggctctcttgaagataaggtcggatatggatacagtttttcgagattcaagtcttaaaggtccactttgggaagaagtttcaaggaaattggcagagcttggatatcaaaggagtgcaaagaagtgcaaggaaaaatttgagaacgtgtacaagtacaacaagagaaccaaagagaacaaaagtggcaaatcacatggaaaagcctataaattctttgatcaattacaagccctcgagaaccaattcacagtctcttacccgccaaaaccacaacctacttctactttgactacaacaaacacattgacaagtgatcatggtaacaaagttatctcttatgtcacaccttttccttccacaaaccctactctcattccaccttctccacaaaccaacaccaccaccaccaccaccacaacaacaacatccactaccgaccctagagactcatcaccaccacaaaccaacaacaacaataatagtgtcacacactctttgccaaacatgaacacctctttctctaccaccactgcctccacctcatcctccacagcatcagatgaagacttggaagagaggtataggaggaagagaaagtggaaggactacttcaggaggctcactaggaaggtcttgttgaagcaagaggagatgcaaaagaagttcttggaagccatggaccaaagggagagggaaagggtggcacaacaagacaattggaggatgcaagaaatggcaaggatcaatagggagcatgagattcttgttcaagagagatcaacagcagcagccaaagatgctacagtcattgcattattgcaaaagatgtatggccaacaaaaccccacacaacaagttgaagtagagccaccaccacaacagaagcaaacaattccccaatcgctgcctccaatattaatgccaaacaataatttcgaggtcaagaaaataaataatggtcacagtgttactagtactactactggtactgttgctactgctactactactactacttcgccggtgaattcttcttcttctcggtggccgaaggcggaagttcatgctttgataaggataaggacaagtctagaaaccaagtatcaagagaatggaccaaaagctccattgtgggaagatatctcaattgcaatgcaaaggctagggtacaaccggagtgcaaagagatgcaaggaaaaatgggagaacatcaacaagtacttcaagagagtgagggagagtagcaaagaaaggcgtgaagatagcaagacatgtccctatttccacgagcttgaagctctatacaaagaaaagagcaaatcgtccaagaacccctttggcatcttccagaatatgaagcctaatgagatgatgctgatgatgacggagccactgatggtgcaaccggagcaacaatggaggcccccacctcaatcattggaagagggtgtagggatggagaatgcaagtgaagaatatcatgaaaatgaagaaaatggtggtgacgatgatgataatattgaagaagatggagatagtgtggaagatgcaggaccaaacccgtgtgagattgcgacaaataattaaacgtgcttcagtggacaccgttgaagtagacaagataaggaattttctgaatggagaaaaatttacgtgtgtgcttaatttacttttacttatttcggaaaaaaatagtcctttattttttttatcattttattaaacttcaaaatgtgattatttcttaaggaaaacaattgttgggtatagtatagtcaatcaggttttatttttcttatggggtcgtaagttgtaacacctgcaaaaaaaaaaaattgtcataaattgttgacattaaagacanngcacaaacacctnnnct

SEQ ID NO: 1279 - DNA, 1676 bp, Glycine max
gacaatagggagagacgacaagtggctcaacaagaggcttggaggatccaagaaatggcaaggatcaatagagaacacgaacttcttgtccaagaaagatcaactgccgcagccaaaaatgctgcagttattgcttttttgcaacagttatctggtcagcaccaaaattccacaacacaagccaatttccctcaacaaccacctccacaaaaagttacaatagtacaaccaccaccacaacaagctccacaaccacaagctccattggtgttgtcaaatagtgacaacatggagattcagaaaatgaataatggtcacagtgttgttactgctactgttactgctactgctactcctactcctactactactttcgttgctgctgctactgctattactactactccttcttcattgagttctttatcttcttctaggtggccaaagacagaagttcatgctttgataagactgaggacaagtcttgaaaccaagtaccaagaaaatggaccaaaggctccattgtgggaggatatatcagcaggaatgctgaggctcgggtacaacaggagtgccaagagatgcaaagagaaatgggagaacatcaacaagtacttcaagaaggtcaaggagagcaacaagcaaaggcgcgaggatagtaagacatgtccctattttaatgaacttgaagctttatacaaagaaaagagcaagactcagaacccctttggcgcttcgttccacaacatgaagccacatgagatgatggagccattgatggtgcaacccgagcagcaatggagacctccctctcagtacgaacaaggtgcagcgaaggagaacaataataatgaaagaaaagaaagagccggggaggaagaagatgaagaagaagaagaagaagaagaagaggatgaaaatgaagagggagatctagagagtgtggaagatgaaggaggtaaccgttatgagattgcgacaaataaactttcttcagtggacaccgttgaatgagacaagataaggaagtttctgattggatggagagttttaattttaattttaattttaattttaattttaatatatatttttttcttcttctgggggatggatttttaattattatgtaagttgattttaatttttccaaaattggggttaggagatgtcactgaaagggcatgatgatggcacaaacaccggcactataaaattcaattctttaataatgaatgacccatctaaaagcatggtggtgcagaagcagaagcagaagcagaagcacaaggtacctatctgacacactttctgatcatgggccagcttaaaagcagatcattggagctgtgggtcacattccggccgccatgaactgggatcagagatcgttaattaacactaagaaacaacagttcacatgggccagcaaagcagaagcatagctatagtgggtgtacatgtttttgcgctcataaatttatgtgtaaagtgtaaattgaagatgagagagagagagagagaaaaaaagaatacgaggtcccatagcagtttaatgaaatgaaataaaataaaaaagtcacatgcatgatgcaactcttgtaattttcctttactttcattatatatcacggaacccactgtgtggtactgctttcaaaaaaaaaaaaaaaaag

SEQ ID NO: 1280 - DNA, 1830 bp, Glycine max
attcggctcgaggaagtttcaaggaaattggcagagcttggatatcaaaggagtgcaaagaagtgcaaggaaaaatttgagaacgtgtacaagtacaacaagagaaccaaagagaacaaaagtggcaaatcacatggaaaagcctataaattctttgatcaattacaagccctcgagaaccaattcacagtctcttacccgccaaaaccacaacctacttctactttgactacaacaaacacattgacaagtgatcatggtaacaaagttatctcttatgtcacaccttttccttccacaaaccctactctcattccaccttctccacaaaccaacaccaacaccactaccaccacaacaacaacatccactaccgaccctagagactcatcaccaccacaaaccaacaacaacaacaatagtgtcccacattctttgccaaacatgaacgctcctttcttaaccaccaccacctccacctcttcctccacagcatcagatgaagacttggaagagaggtataggaggaagagaaagtggaaggactacttcaggaggctcactaggaaggtcttgttgaagcaagaggagatgcaaaagaagttcttggaagccatggaccaaagggagagggaaagggtggcacaacaagacaattggaggatgcaagaaatggcaaggatcaatagggaacatgagattcttgttcaagagagatcaacagcatcagccaaagatgctgcagtcattgcattattgcaaaagatgtacggccagcaaaaccccacacaacatgttgaagtagagccaccacagcaacagaagcaaacaatgccacaatcacagcctccaatattaatgccaaacaataattttgaggtcaagaaaatgaataatggtcacagtgctacaagtactactactactactacttctccggtgagttcttcttcttcttctcggtggccaaaggccgaagttcatgatttgataaggttggcgccaggtcttgaaatcaagtatcaagagaatggaccaaaggcttccattgttgggaagatatgtcaattgcaatgcaaaggcttgggtccaaccggagtgcaaagagatgcaaggaaaaatgggagaacatcaacaagttcttcaagaaagttagggagagtagcaaagaaaggcgtgaagatagcaagacatgtccctatttccacgagcttgaagctctatacaaagaaaagggaaaatctcagaacccctttggcatgtttcagaatatgacgccaaatgagacgatgatgatggagccatttgatggtgcatccggagcaacaatggaggcctccacctcaatcattggaagagggtatagggaaggataatgccagtgaagaatataatcaagaaaaagaagaagaagtagaagaaaatggtggtgatgatgatgataatattgaagaagatggagatagtgtggaagatgcaggaccaaacccgtgtgagattgcgacaaataattaaacgtgcttcagtggacaccgttgaagtagacaagataaggaattttctgaatggagaaaaatttacgtgtgtgcttaatttacttttacttatttcggaaaaaaatagtcctttattttttttatcattttattaaacttcaaaatgtgattatttcttaaggaaaacaattgttgggtatagtatagtcattcaatttttatttttcggatggggttgtaacatgctactgaaaaaaattgtcatagattgatgacattaaagacgaaaaaatttaaaatttcgaactattaaaaagcggcgctctagaggatc

SEQ ID NO: 1281 - DNA, 2149 bp, Glycine max
attcggctcgagcaaaatttcgatatgtgatgtggttttctgacagtcattttgatacatacatggtgtgttttccaaataagttaccaaatcaaattggttcttcaaaagcaacattttcttcctcccttatttcggttacccactcttggttgggaatgaatgaaggaagctggcagagcttggctacaacagaaatgccaagaaatgcaaagagaagtttgagaacgtttacaagtaccacaagagaaccaaagaaggacgaagtgggaaatcagaaggcaaaacttatcgcttctttgatcaattacaagcccttgaaaacaaccctgcaattcatggaaagcaatctccaacacctccaaagccgccaccacaaacaacagcactatcagcaacaccagtgtcaatagtggtaacaacaactacaactacaccatcatcaataataatgccacttccattgccaccagtgtctaataacaacaacaacaccactgttccatccacaacatcacttcctatgcctcaaagcattctcaacataacaccaccatcaacactgaacatcacaatcccttcttttccaccatcaaaccctacaacatacttcccaacacaaacaccaaaccctactagcaacaacaacaacaaccctccaagcaccatcaccccaccttccttccccaatttccccgccgatctcttgtcgaattcgagttcttcatcgacttcttcggaggaaacaccgacgacggaggccagagggcgcaagaggaagaggaagtggaaggacttctttgagaggctcatgaaggaggtgatagagaagcaggaggagctgcaaaggaggttcttggaggccatagagaagagagaacaagagcgtgtggtgagagaggaagcgtggagaatgcaagagatgcaaaggatcaacagggaaagggagattctagcacaagagaggtccattgccgcagcaaaagatgctgctgttatgacatttttgcaaaagatagccgaacatcagcaacaagaaactatcaatcttgaaccagcattgaataacaacagcatcactgttgttccacagcaaccagtgccacaagcaacaccaacatcaactccaacaccacaacaagcacaaacaacaacagttcctgaggccccacaagtgcagccattggtcccacaactacaacaacaacaacaaatagtggtgagtaatgtggaaatcaacaaagctgataataacggtgagaatttgatgatggaagcaagctcttcaaggtggccaaaaatggaggtacaggcactgataaacctaagaacaagcctggaaacaaagtaccagagaaagtggaccaaaagggccactgtgggaggagatctcagcgttgatgaggaaaatggggtacaaccggaacgccaaaaggtgcaaagagaagtgggagaacatcaacaagtacttcaagaaggtcaaggaaagcaacaagaagaggcctgaagattcaaagacatgtccctattttcaccagttggaggctctatacagggagaagaacaagggagaggggcagatgaagccggagagcatgatggcgccgctcatggtgcagccggagcaacaatggcctcctcaaacaacgcttgtggtaccgccagaagtaaccatgggagacacccagaatgaccccatggaccggcagtaccatgaggagaatgaggatgacgaggacgacaaggaaattggagatgaagacgaggatgaggacgacgaaggaggtgataattatgagatagttgcgagcaaaccagccacagctgatgcttccggagagtgagaggaaaaaatattgaccaaaaagggcatcaattaaagaatgatggatcaatttgaattcacatattgtcggaaaaatggtggtgttgggatgaaatttggtattgatggtggatggtgatgtgattgtattgaagattttgaaaatgcacgtacttcagaatgacacatgggtataggggtagccagtagggtgggggaatctgggttggaagtacttggtacaatagcagcatatagtcagtaagattatatgttttttttgttttgaaagaagaaataattaattattttttgagctcaaaa

SEQ ID NO: 1282 - DNA, 277 bp, Oryza sativa
acgcccacgcgttcgcgctgatgctgatgcggacattgctgaaggataagtagcaggatccaccgctgaggggcccgctgtaggaggaggaaatcgcgcgcatggaagtcgccgtctaccagctgcacgcgtaaaggtgcaaggagaagagggagaacatccacacgtacttccgcaagggcaaggaaagcggcaagaatcggacggagcacgccaagacgtgccgctactgtgacgagctcaaccgcctctacttccgatacgtctactgcagctg

SEQ ID NO: 1283 - DNA, 985 bp, Oryza sativa
cgccgcaggccaccaagtcgccattgccggcgacgccgcagacgcaaagcagcatggacattgtcatgacggccgccgaggcgcacgacgcgggggtccgccgggccggcggcggcggggggcagccgtcgtcgtcgcggtggcccaaggcggaggtgcacgcgctgatccagctgcggagcaacctggacaaccggtaccaggaggccgggccgaagggccccgctgtgggaggagatctccgccggcatgcggcggctgggctacagccggagctccaagaggtgcaaggagaagtgggagaacatcaacaagtacttcaagaaggtcaaggagagcaacaagaagcgccccgaggactccaagacctgcccctacttccaccagctcgacgccctctaccgcaacaaggcggctctcaactcctcctcctcctccgccgccgccgccgcaccgggccctcccgccgccggagcacgcggagccggcggtgacagtcgccgcgccgatctcgcagacaccgccgccgccgccgccacagcccgtgacgacgaccaagaacggcaacggcaccagcagtacaaacggcgcgaacggcgaaggaggaggaggcggctccgggggcatgcaaatgcaggcgagcaacggcagcgtcgtcgccggcaacaagttcttcaccggcgcggcggcgaagaagccagaggacattatgaaggagatgatggagcagaggccgcagcagccggcggcggcgaacaacgccttcaaccgaacggacggcggcggtggcggcggcggcgtggacagcgacaacatggacgaggacgacgaggatgactacgacgacgatgacgacgacgacgacgacgacgtcgacggcaacaagatgcagtacgagatccagttccagcatcagcaccaccaccagcagccgccgcagcaccgccaccagcagagcgtcgtcagaccgaacgccgccgcctcc

SEQ ID NO: 1284 - DNA, 1260 bp, Oryza sativa
  misc_feature (824)..(824): n is a, c, g, or t
cccgggctgcaggacggagctcgaagcggtgcaaggagaagtgggagaacatcaacaagtacttcaagaaggtgaaggagagcaacaagaagcggcccgaggactccaagacatgcccgtacttccaccagctcgacgtcatctaccgcaggaagcacctcaccggcggtggcggcggcggcgcttccgcggccaatgtcgccgccacggcaatcgagcaccagaacccgaaccggcacgagatagaggggaagaacataaacgacaacgacaagaggaagaacggcggaggcggcggcgcgcaggtgcccaccagcaatggcgacacggcaccgaccacggccacgttcgacgtcgatagcggcatgaagaagccagaagacattgtgagggacccgcgcgtcccgccgccccgggagttcacaacggacgagaccgccagtgacgacatgggcgatgactacaccgacgacggcgtaggaaggcgaggtacgacgccaaaaatccagtacaggatacagttccagaggccgaacccgggcggcgccaacaccgcacactccgccggcagacaaccccggcggtccgcggtgccaacctcgactccgacgagcaccttcctcgccatggttcaataggcgcgcgaacgatgcatcaccaagtacgtacttgttcaaagaaaaaaaatcaaagcatcgccatcaccatcgcatcctctcactacaccaccaccatacacctaacaccatgcatgcatcagccatcagcaaccactctccttcgagttgggatctctcctgcaatgcatgtgcggtaagtgccanatgacatgtgggcccggaataggtgggacccacatgccagtgacaccagtacagcagtggatttgcatccctctccttcaccttgtaattctcccgtgccattccattatttattgatttctctgtgtaataagagccctccctgatctcaccttaacccgaggaagcagagggggtggtagagaaaatgagtccgggtaactttatctctataggtcacctcgtcgtggtaaaggaagaattgtacatcgatgtaacagtccctgatgtctctgttttttttttctctctctctttttctccttcccctccggcgacggcggtatacaagtttgtatacgggtatacaacaattacatacatttccagcaatttggagcagaaaaaaaaaaaaaaaaaaaaaaaaaaaaaactcgagactagttctccctcgtgc

SEQ ID NO: 1285 - DNA, 747 bp, Oryza sativa
atcgccgccgtgccaccgccgccgctgcagcccacgccggtggcttccgctgcaccaccaccaccgattcaggttcagccgcaccacataatgccgatgacgccgcagccccagctgcaaccaccgcagccgcagagcaaggaggccaacaccgtcgtccgggcggcgccgccgccgcaagagcagcacgacacggcggcgtccggcggcggcggcggcgcgtcgtcgtcgaggtggccgaaggcggaggtgcacgcgctgatccagctgcgcacagagctggagacgaggtaccaggactcggggcccaaggggcctctctgggaggacatctcggcggggatgcggcggctggggtacagccggagctccaagagatgcaaggagaagtgggagaacatcaacaagtacttcaagaaggtgaaggagagcaacaagaagcgccccgaggactccaagacatgcccctactaccaccagctcgacgcgctctaccgcaccaaggcggccaacgccgccgccgccgcctcagcctcgccggctccggcgaccaccaccgtgcttgccccggtgccgatctcccagacgccgccgcacgtcgaccacggcggcagcaacggcaatgggaatgggtgggcgagtgccaacaacggcggcggcggcagcagctccggaggcatgcaaacgaaagctagcaacaatggcacggcgaccgccggcgggctgcccgtcgtttcggtcgccggc

SEQ ID NO: 1286 - DNA, 741 bp, Zea mays
cctctgggagcaggtctccaggaagctggctgagaaggggtacaaccgcagcgccaagaagtgtaaggagaagttcgagaacgtgcacaagtactacaagcgcaccaaggagagccgagccggccggaacgacggcaagacgtatcgattcttcacgcagctggaggccctgcacggcaccggggcggctcccgcgtcggtggcggcgtcgcaggtgccccctgcgatctctggcggggtgtccggggcagcggggccgttagccgtgcgcttgcctgccgagccaccgcctgcggtgtcgggcggcgtggggatgccgatgacgaccgtgggctacccgagcttctcgacgtccaacacggaggactacacggacgaggacgactccgacgacgagggcacagaggagctggtgggtggcggcgggaacgagcgcgggaagaggaagagggtgtcagagggcggcgcctcggtcgccggcggaggcagcgggaagatgatgaggttcttcgagggcctgatgaagcaggtgatggagcggcaggaggcgatgcaacagaggttcttggaggccatcgagaagcgtgagcaggaccgcatgatccgcgaggaggcgtggcggcggcaggagatgacccgcctcgcgcgcgtagcaggagatcctggcgcaggagcccgccatggccgcctcacgcgacgcttgcgtcctctcctttatacagaagatcaccggacagacca

SEQ ID NO: 1287 - DNA, 1853 bp, Zea mays
  misc_feature (28)..(28): n is a, c, g, or t
gcgttctggtcgcccgcctcaaccgcgnagcggggcggcgcgctcaggagcgcgccgccgcgggctgcaggacgccgccatcatcgccttcctccagcgcatcagcgggcagtccgtgcagccccctaccgccgttgttgtcccaatgccggcaccggtgtcagtccataccacgccgccggagcagccggggcgccagcagcagcaaccgccgccgccgtcgccccaggcgacaccgcagtcgaagccaatctcagccgcgccgctccagcagcaaccgccacagcagcaaccgaaggatacgtcgcagcaggacgccggcacgccgcgcagcttgcccccggcgtctggccagtcactcgagctggtgcccttcgccgccacggagcatcacgtcgattccgggctaggaggaggggatggaggtgcggcgtcgtcatcgcggtggcccaagacggaggtgcacgcgctcatccagctgcgcatggacctggacatgcgctaccaggagacaggtcccaagggtcctctctgggaggatatttcgtccgggatgcggcggctgggatacaaccggagctccaagcggtgcaaggagaagtgggagaacatcaacaagtactacaagaaggtgaaggagagcaacaagaagcggcccgaggactccaagacctgcccatacttccaccagctcgaggccatctacaacagaaagcacctcagcagcctcacaaccgcggccacatcgtccaccgccgccgccgccgccgctcctcgtcccgcctacccagatcagctgaacccgagcaggcaagagatagaggggaagaacatcaacgatgacaagaggaacaacggtggatcaggtggaggcacgcaggtgccgaccagcaatggcgagacagcgacgacgacgacgacgacgcccgtcgcgttcgacgccgacaccggcatgaagaagccagaagacatcgtcagggagttgaacgagcacccgcgtcgggagttcacgacggaggacgagacggacagcgacgacatgggcgacgagtacaccgacgacggcgaggaaggcgaagacgacggcaaaatgcagtacaggatacagttccagaggccgaacccgggcggcaccaacaccgcgccagcaccggcagcagcgacgacggctgcgccagcggtgccgacttcggctccgaccagcaccttcctcgccatggttcaataggggcgcgggcggcacccctctcaaaccgtacgtacgtatatgcgtccaaaccaaaaacctgcgcgcatcaccgtcacctcctcctttactttaccagtccaccaagcatgcaccatcagtccatcacactgttctcttgttcatcctgtaatcccccgtgccattccattatttattgatttgtttcgtgtataataagatccccaccgttgcggaggatgcagagtgaggctgcggtggtagagcaaaaaggaagagtccagtccctcagtaataacttatttataggtcatcgtcgatcgcgttaaacgagaactgtacatcgatgtaacagtcagtccatgatgtttttcctcccttttttttttagttactcccttcccgggacggcagtatacaagtttgtataagggtatacaagaattacagacagttcaagcaacctggagcttgcggaggtgagaaggtgtttttgccgttgggaatctacatattttttttttgtcgatgcctttcttttaacagtggatataattaaatcctgttacttgttacagtgtacattaatcgtgttgttattccagtactctgccctttgtggcaaatatacatgagcagttttacc

SEQ ID NO: 1288 - DNA, 1324 bp, Zea mays
gccgccacagcagaagccgccaatgccgcaacagcaaagcatggacattgtcatggtgccggccgagacgacgccgcacgccgacatcccggtgcacgaggggtccagtggcggcgcggcgtcctcccggtggcccaaggcggaggttcacgcgctgatacagctgcggagcaaccttgacacccggtaccaggaggttgggcccaaggggcccctctgggaggagatctccgccggcatgaggcggatgggttacaaccggaacgcgaagcggtgcaaggaaaagtgggagaacatcaacaagtacttcaagaaggtgaaggagagcaacaacagccggatcgtctttcctgggcacggtccagtgatcgatccgtctgcgcgcacccaggcattatcccccggtgactctcatcctcctccacttctccatggcttcttttctttctctcgctcgcatgtgacatttgtgtctacccacctgtcgcctccatgcatgctcgtccatatctctagttctctacacctctaaaccaaaaatcacaagaactatctccctcagctcctccatgctccggcaattctccattcctcatatatgcacctagcaacacctcgatccatgtcgtgtcgtcgtcgctgctgcatgcctacccccctttttttgattcgttgctgtgttaattatagtggtcgcctctttagatgttacagtaaaaaaatattggcggtgatgcggttatttattgatttgttctggtaattaataagaaccctcaagctttggggtgttcacggagaggttgagttgatgcggtgaaaacagcacgtgaaagggtaatgagagatcgatcgcgcggttaaggagacaaggtgacaagaaaggcagatgacgcagtgggtgtttgcactgttactgcggtaaattttgtgcatgcggctactactctacagtgggctagtttgttgcaagggagctgcggaaaaaaatggaaaagaagagcttgctcgtcatgtgccatgaagaacagtcagtttgatgcatgcgggatttttatatttatccttgttttcccctctttttcatttttcaccatttcttttatgttctgcaacaagtaaactgtccattaagtattacctaagttttttctttctttctttctttctcaaactgctgttaccgaaatttacagtgtatacttgagaaatgttatatgttaaaattcttgctgttaattatatatagtattgcaattgcgcgcccgtgggattttttcaaaaaaaaaaaaaagggcggccgccaccgcggtggagtctccag

SEQ ID NO: 1289 - DNA, 716 bp, Zea mays
tctggccggcagccgcaccgccccgcagttgcacgccctcgccgcgccagtatccccgacgccccagcagcagttgccggcatccagcgccgccccgccgttgcacgccttccccgcgccagtatccgcgccgccgccgttgagttcaataccactgctgacagggccgatgcagccagcgcccatatcatcggcggccccagccccggcaccggtggatctgctcggggcccaccagccccataacctgcaaggcttcagcttctcttccatgtcggacgcgggggccgtcgacgagcccccggccgacgacacgacggcggagacaggcggaaaccaggaccgcctcggcaagcggaagcgcggcgacggcggcggcagcggcagcaacaagatgatgtctttcttcgaggggctcatgcagcaggtcgtcgacaggcaggaggaaatgcagcggccgttcctggagaccatggagaagcgggaggcggagcgcacggctcgggaggaggcgtggcgcaggcaggaggtcgcccgcctcaaccgcgagcaggagcagctcgctcaggagcgcgccgccgccgcctccagggacgccgccatcatcgcctttctccagcgcatcagcgggcagtccgtgcagccccctaccgcctttgttgtcccaatgccggcaccggtgtcagtccataccacgcctccgaaacaaccttatc

SEQ ID NO: 1290 - DNA, 998 bp, Glycine max
ataggccaagtgatcataggagggtgagaaaaagctggagaacaaaagtggaggagatagtggattcccacatgaggaagatcatacagactcaagatgcttggatggagagaatgttgagtgttgttgagcaaagagagcaagagatggcatctagggaggaagaaaggaagagaaaagagtcaatgtggtttgaccaacaggtgcatgaactgtgggccaaagagaaagcatgggttgaggcaagagatgctgcattgatagaggttgtgaggaaacacattgggatagggataggacttgaagcattgccattggtcgaagaagaatcaccgaataagaataagagccagggaagtattgatgccaatgagtttccctctgagggtgttgatcctggtagaagtagtagtagtaggtggacagaaatggagatttcaaatttgatgcagctaaggactagttttgagcaaagattcagagaaaataataatgggtacatggagaatggggtttgggatgaaatagcagcaaaaatggcttgtttggggtttgataggagtgcaagtgagtgcaagcaaatatgggaagagatcagcatctctctcagaaggacagtggatgagtgtgatgatggtgcaaaaagaaggccttggtatttgggactttagctgacggatgatgatctttgacacattcttgttctaaccgaaggcatcgatcagagagattaagtatatatgacactttgcttttgatgagttctgagcgtggaaggaaacttgtgggagaaacaagctagggcttgagagggttattaactaggatgtaacaagtttggatcattagcgaatcacaaggtattctaggccacgtgtttaactatatatttaattaatataacgtatgaggactcattcttgagtgtaagcattgactttgttgtttattattaattttatccatgcatgcatcagatgctagagtcatcagttatt

SEQ ID NO: 1291 - DNA, 1730 bp, Glycine max
gaaggatcatgtcctcgagccgaatcggctcgaggagtgggaaaaagtgcagggagaagtttgagaacctgtacaaatattacaagaagacaaaggaaggaaaagctggaagacaagatgggaagcattacaggttctttcgtcaacttgaagccttatatggtgaaaacagtaaccaagcctcggtgccagaaaccaattttggcagtggtagccttcgtttccacacaagcactcgagccgattcggctcgagaaacaaatcaagaaatgtttcagtctcagaagcattgtgacagcctaagcctcaccaacttcactgatttggacacttcatcatcggatgacaatgatcaaaatagcactggcagggaactcaacaaggacaatgactccatggagaagaggagaaagagggtgagtggaagaagctggaaggtgaagataaaggacttcattgactcacagatgaggaagctggtggagaagcaagaggagtggttggataaactcacaaagacactggaacagaaggaaaaagagagagtgttaagagaagaagagtggaggagacaagaatctgtaaggttggagagggaacacaaattttgggctaaagagagagcatggattgaagcaagggatgctgctttaatggaggctttgcacaaattaacacgaaatgagataatgaagagtactcattctcacgagggtctaatggtaactggaattcagaaccacagtgaaaaccagaatgaagatgggagtgaaatactaaatagcactactgccagaggtgctgaaagctggacagaatctgagattgcaaggcttcaacagttgagagctgagatggagacaaggtatatgcaaagtgggtgttcagaagaggttatgtgggaggaaatagctaccaaaatggcttgttttggttacgaaaggagtgctgtggtcttcaaagagaaatgggagagtataagcagcaactatgcaaggagtgccaaggatggaagcaagaagcgcaaggaagactcaagaagttgtttttacttcgataacagtgaccaatcttctctgtataaccaaggaggtgcctattgtgatatcaacgatcaaaggcacaagactgggaggctgcaaacaaatgatggctcttcaccttccaattcaaatgttggaaatgcagttgcgggtgataactgctttcccttcttgatgactgagggtggaaatttgtgggagaactatagcttaaaggttaataaagcatgccaaaaccagtgatgagagtgaaaaaaagtttgacacttgtaagaggcaagaaaatttcacagccttttatcagatgatctcacattatgtaagcaagagctaactgatgagggtcgtttatgtatagagactgatgatgataaggtgatcaatcttattatatttatgggaatcaaagtgaaaaataatgtgttcaagtcacgtacgtaagtttaatgagggagactagacattggcaaaatttcacaggtgagtatgacactaattcaggtgagtttctcttgtagcagatttcttttatgcgtgcaaaatggaatttgcaattttatattacttcacatgttgcatcttcaatgatgtttatatatcattagttgttaaccctcaaaaaaaaaaaaaaaaaaaaaaaaaaaaaaaaaaaaaaaaaaaaaaaaaaaaaaaaaaaaaaaaaaaaaa

SEQ ID NO: 1292 - DNA, 1221 bp, Glycine max
gaattcggctcgagggtaactggaattcagaaccacagtgaaaaccagaatgaagatgggagtgaaatactaaatagcactactgccagaggtgctgaaagctggacagaatctgagattgcaaggcttcaacagttgagagctgagatggagacaaggtatatgcaaagtgggtgttcagaagaggttatgtgggaggaaatagctaccaaaatggcttgttttggttacgaaaggagtgctgtggtcttcaaagagaaatgggagagtataagtaactatgcaaggagtgtcaaggatggaagcaagaagcgcaaggaagactcaagaagttgtttttacttcgataacagtgaccaatcttctctgtataaccaaggaggtgcctattgtgatatcaacgatcaaaggcacaagactgggaggctgcaaacaaatgatggctcttcaccttccaattcaaatgttggaaatacagttgcgcttgataactgctttcccttcttgatgactgagagtggaaatttgtgggagaactatagcttaaaggttaataaagcaagccaaaaccagtgatgagagtgaaattatatggttgacacttgtaagaggcaagaaaatttcgcagccttttatctcagatgatctcacattatgtaagcaagagctaactgatgagggtcgtttatgtatagagactgatgatgataaggtgctcaatcttattatatttatggaatcaaggtgaaaaataatgtgttcaagtcacgtacgtaagtttaatgagggagactacacattggcaaatatcactgaattgttggggtgtgagtatgacactaattcaggtgaatttctccattagctgatttcttttatgcgtgcaaatggaatttgcagttatattacttcacatgtcgcatcttccgataatgttcatatcattcattagttggtcaccgtctttctcctagtttccaccttccacacctatcttgccttttttttaattaattttttgggatatttatactgtgctggccttttgtgtttgtgtactgaaaggtagcaatttactttggtatttatttattggtcaatagttttatgaaccgggagaaagtgatgtattgatggatattgttgaagcatcggacattgttacaagcataaaaaaggccagattttctttaaaaaaaaaaaaaaaaagggcggccgccg

SEQ ID NO: 1293 - DNA, 516 bp, Glycine max
ctcgagccgtatcgcctcgaggagtgggaaaaagtgcagggagaagtttgagaacctgtgcgaatattacaagacgacaaaggaaggaaaagctggaagacaagatgggaagcattacaggttctttcgtcaacttgaagccttatatggtgaaaacagtaaccaagcctcggtgccagaaaccaattttggcagtggtagccttcgtttccacacaagcagccacaataataacccttctcaaacaaatcaagaaatgtttcagtctcagaagcattgtgacagcctaagcctcaccaactccactgatttggacacttcatcatcggacgacaatgatcagaatagcactggcagggaactcaacaaggacaatgactccatggagaagaggagaaagagggtgagtggaagaagttggaaggtgaagataaaggacttcattgactcacagatgaggaagctggtggagaagcaagaggagtggttggataaactcacaaagacactggaaca

SEQ ID NO: 1294 - DNA, 976 bp, Glycine max
acgtaagctcggaattcggctcgaggaagtagaggtcttaagagtttgagaactgagaagagatgggtggtgttgcatggacagaagaagaagatcacttgctcaagaaatgcatacaacaatatggagaaggaaagtggcatcgtgttcctttactggctggtttaaacaggtgccggaagagttgtaggctaagatggctgaactatctccgtcctaacatcaagagaggaaattttgcggaggaagaagtggaaatgataatcaaactccataaattactaggcaacagatggtcgttgattgcaggaaggctaccaggaaggactgccaatgatgtgaaaaactattggaactgtcatctgagcaaaaaactaaatgtaatagaagctgaagatagaccaataacaagagatgttcaagtcattaggccccagcctaggaacattgttggttcaagctcagtgaaaagaaggggtcaaaatgagtctccaactgacaaaggagttcaacaagagagtagcatgtcctcactgacgtttgatactgctgatggacagaaccatatgcttgattcacagcaagacaacaacatatatgcatgcctggaccaacagggcattgttagtgagttgtcaatggattttcagttcgaaggatttggagcaatgatgaatggggagggtagtagcagccaatgggattggggtgatttgctcttagacatggacttgtacaagtgaattaattttcttcttagttattgctcctgttgatgtggggatggcaatgttggtctcataccttggctacgtatcaatatcgaagttaagtgtttcgatggaaatggtagctaagttggttgtgtatcatgggtatgtcataatcataattaagatctagtgggtttcatcttttgacccctgtagatggtccatctcactaccatgagccatttataaaatcatcttcagtc

SEQ ID NO: 1295 - DNA, 486 bp, Glycine max
acgagggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccatagcctccttggcaacaagtaagcatatctataactataactattcttcatactcctatctttctcatcatcacattcctcaatcataggtggtctctaattgctggaagattgccgggtagaacggacaatgagataaagaattactggaatactcacataagaaggaagcttctgagcagaggaattgaccctgccactcacaggcctctcaacgatgacaaggtattggaacgctg

SEQ ID NO: 1296 - DNA, 1337 bp, Glycine max
ggccactctctctctttaacctgcctcaccaactcgcatctagaagcaattatagggtctttctctcttctctctctatgttctgtcccctctactttggagtcaaaagcctataaaaccacacccaaacttcctcttgagctcgagccgaatcggctcgaggctagccaatcctaattcctattctcctatcctttttactacataactctaaagtaagtaagaaaaatagagcaatttcacaacacaactcttataattgtgagttaagtatgggaaggtccccttgctgtgagaaagctcacacaaacaaaggtgcatggactaaagaagaagatgacagactcatatcttatattcgagctcacggagaaggctgctggcgttcactccccaaagccgccggtcttctccggtgcggcaagagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcttctgctgcaactgttacaactaatatatcttttggcaaacaacaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgttaatttttgaattttctctcctattttttcttttttttcttctcttatttgtataaataattagtcgctgatatgcataatatatagtaccggtacagttgaacatttttgcccaattttcccttttgttgttactcttcactttcttttcttccggcaattgatggtagtcataaagaaaaaaaaaaaaaaaaaaaaaaaaaaaaaaaaaaaaaaaaaaaaaaaaaaaaaaaaaaaaaaaaaaaaaaaaaaaaaaatgg

SEQ ID NO: 1297 - DNA, 1265 bp, Glycine max
caacagccactctctctctttaacctgcctcaccaactcgcatctagaagcaattatagggtctttctctcttctctctctatgttctgtcccctctactttggagtcaaaagcctataaaaccacacccaaacttccgctcgagcccgcgccgtatcggctcgcggctagccaatcctaattcctattctcctatcctttttactacataactctaaagtaagtaagaaaaatagagcaatttcacaacacaacacaactcttagaattgtgtgagttattaattgagtatgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgtttatttttgaattttctctcctattttttcttttttttcttctcttatttgtataaataattagtcgctgatatgcataatttttagtaacggtacagttgaacatttttgccccccaaaaaaaaaaaaaaaaaaaaaaaaaaaaaaaaaaaaaaaaaaaaaaaaag

SEQ ID NO: 1298 - DNA, 923 bp, Glycine max
gtggtgggcataggatgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctccttggcaacaagtggtctctaattgctggtagattgcccggtagaactgacaatgagatcaagaattactggaatactcacatacgcaggaagcttctgagcagaggtattgaccctgccactcacaggcctctcaacgattcttctcatcaagaacctgctgctgtctctgcccctcctaaacatcaagagtcctttcaccatgaacgctgccctgacttgaaccttgagctaaccattagtcctccccatcatcctcaacctgatcatccgcacttgaagacccttgtgacaaactcaaacctttgctttccctgcagtctgggtttgcataatagcaaagattgtagctgtgccctccacactagtactgccaacgctactgctactggctatgatttcttggccttgaaaaccaccgtcgttttggattacagaaccttgcacatgaaatgaaatcatattactgaaatctctctctttctttctttctttcttttcttctctaatataatttcttacttacttacttacttacttacttacttgttaatggttgcaaatgataaaaaagttccagccagtacagttgaacaaaaaaaaaaaaaaaaaaaaaaaaaaaaaaaaaaaaaaaaaaaaaaaaaaaagggcggccgc

SEQ ID NO: 1299 - DNA, 887 bp, Glycine max
gtgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcattcgccccctcgaagaagaccaactcatcatcaaactccatagcctccttggcaacaagtggtctctaattgctggaagattgccgggtagaacggacaatgagataaagaattactggaatactcacataagaaggaagcttctgagcagaggtattgaccctgccactcacaggcctctcaacgatgacaaggtattggaacgctgccctgacttgaaccttgagctaaccattagtcctccccgtcaacctcaatctgatcagcatcacttgaagcccgttgggagaaactcaaacctttgctttgcctgcagtttgggtttgcaaaatagcaaagatcattgtagctgtgcgctcaacactgccaacgctgcttctggccatgatttcttggccttgaaaaccagcgttttggaaatgaaatgagtcaaattcattttggaatctttcttccctaattaattagttgttaatggatgcaaatgattgcctgcccaatttcctcgtggagccctttctattattcctatgttcatgtacatgtgcgtaagactacaaactttcttgtttatacgattggttctttccaaatagaatacaactatatatttttgttatttctataacaaaagttcaattcatcacttcgatcgatggtagagagaattaccacaatcatt

SEQ ID NO: 1300 - DNA, 858 bp, Glycine max
attcggctcgagcatatacattttttagccttttgttagccccaaacacccacacgggcacacccctgcaggtacaaaagggggagttcacaacaaaaagaaaacaatgagaaaaccttgttgtgacaaggaaaacatcaataaaggtgcttggtccaagcaagaagaccaaaagctcattgactacatccaagtccatggtgaaggctgttggcgttccattcctaaagctgctgggctgcatcgttgtggcaaaagctgtaggatgagatggttaaactacttacgaccaggcatcaaacgtggaatctttgctgaagatgaggaagacctcatcatcaaactccatgccctccttggtaacaggtggtcactcattgctggaaggttgcctgggaggacagacaatgaggtgaagaactattggaattctcacatccgaagaaaactaataaagatgggaattgatccaaatagccataagccacaccaaagctttcctcgtcctcatgtttcttctgctgatcatcagggtgcatcaacatctgagtccatcaacaacaacaaagtccctttcttcaattcccgtggttcagctgccactgatcatcataagatttcgttcactaaagaagaaacatcaattatttcatcaccccctttgaatcttgatcttacaatttctttaccttcgcctgtggaagaaaacaaaaattctgatcatgagtccgccaagacatgtgacgtggatatagatctcaactgttagtacttttagttgttggcaagagtattaattaccagcagtagtacttcatgtttgttacaaattaattttggagaaataatcagtttttc

SEQ ID NO: 1301 - DNA, 1256 bp, Glycine max
ccacgcgtccgctccattcgcgaaaggctcgcagcaaaaccacgccatcgatcgccgccaccagtccagcatcctccgatcgactacgtactcccacccactccggcagcagcgaggcctctctgtctgtgcgcggcgtggctgtcgtcgatctctgcctggcgggcggccggcatggggaggtccccgtgctgcgagcaggcgcaccaacaagggcgcgtggaccaaggaggaggaccagcgcctcgtcgcctacatcaaggcccacggcgagggctgctggagatcgctaccaaaagccgcaggtctgctgcgctgcgggaagagctgccggctgcggtggatcaactacctgcgcccggacctcaagcgcggcaacttcaccgaggaggaggatgacctcatcatcaagttccacgagctcttcggcaacaagtggtcgctcatcgccgggaggctgccgggcaggacggacaacgagatcaagaactactggaacacgcacatcaagcgcaagctcctcgcccgcggcatggacccgcagacgcaccgcccgctcgccagcgcgaccgcggggcagcagcattaccagctgcaggagccgcagaagcgagcggccggcggcggtccagcaggccatccgcaccaggaccacttggaggtcgtcgtcatctcgaactcgccggacgaggcctacagccgtagcagcgacgacgagccgcggtccgccacgccgccgcggcgccacctcgacatcgacctcaacctgtccatcagcctagcggcctaccagccgccggaggaaaccggcatcatcaagcagccactggtgatgaagcaggagcaggaaacggcggcgggcggcaccaatgccgcggcggtgtgcctgtgcctcaacagcctcgggtaccggccgggcgtcgagtgcgtctgcggcgacggcagctcctcctcctcctcctcgcactcccactcccactcccaccaatgggctctgaattttttacaggcggcggcgccctgctacagaggccaatagtgtagtaagagcgatcagtgacatcattaaaatgggagcgttattacgatcgagactgagggtgagggaggggggcagagctgagcagggatagtagttaactacagctagtagtagtagtagtacgtaaaagacacacatgcttaggctttaacaagtctctgaaacacgcatcatgggttatgagttgtgctctaaaaaaaaaaaaaaaaaaaag

SEQ ID NO: 1302 - DNA, 1177 bp, Oryza sativa
ccgggctgcaggcgacgacgacgactcgccgccggccgagaccaacagcgatggggaggtcaccgtgctgcgagaaggagcacaccaacaagggcgcgtggaccaaggaggaggacgagcgcctcgtcgcctacatccgcgcccacggcgagggctgctggcgctcgctccccaaggccgccggcctcctccgctgcggcaagagctgccgcctccgctggatcaactaccggcgccccgacctcaagcgcggcaacttcaccgccgacgaggacgacctcatcatcaagctccacagcctcctcggcaacaagtaactacgcttctcttttcttgccttctgcctcacctcgcctctcttccatccatcgattgctcatcgattttcatcatccctcgcgtccgctctgatcgcggcgaggctgccggggaggacggacaacgagatcaagaactactggaacacgcacatccgccggaagcttctcggcagggggatcgaccccgtcacgcaccgccccgtcaacgccgccgccgccaccatctccttccatccccagccgccgccaacgacgaaggaggagcagctcatactcagcaagccgcccaagtgccccgacctcaacctggacctctgcatcagcccgccgtcgtgccaggaagaagacgatgactatgaggcgaagccggcgatgatcgtgagggcgccggagctgcagcgccgccgcggcggcctctgcttcggctgcagcctcggcctccagaaggagtgcaagtgcagcggcggcggcgccggcgccggcgccggcaacaacttcctcggcctcagggctggcatgctcgacttcagaagcctccccatgaaatgaaatgatcctgcaaaccaatccatgatcgttacactttctcttctcttttgggttcttgatttcttagctagctttggttactgcttagtgttagtccttcttaattaggatcagatagaggaatacttcctttggggagatgatcagtgatcttgttgatcacttcctccattttgtgtaaatactgttccactcatacttagttcagttgatgatatggttatttaggttgttggatgtaaatttgttctcggtctgaaaatctatggtatttgtcatgccttgccgagaaaaaaaaaaaaaaaaaa

SEQ ID NO: 1303 - DNA, 496 bp, Oryza sativa
cttccactgaaacaacccaccgaggcagcagaagaaaggaaagaatcaagaaagcttcatcgtcttcatggggaggtcaccgtgctgcgagaaggcacacaccaacaagggagcatggaccaaggaggaagatgaccggctcattgcctacatcaaggcgcacggcgaaggttgctggcgatcgctgcccaaggccgccggcctcctccgctgtggcaagagctgccgcctccggtggatcaactacctccggcctgacctcaagcgcggcaacttcaccgaggaggaggatgagctgatcatcaagcttcacagccttttaggcaacaaatggtctctgatagccgggaggttgccaggaagaacggacaacgagatcaagaactactggaacacgcacatcaggaggaagctgctgagccgtggcatcgacccggtgacacaccggccgatcaacgacagcgcgtccaacatcaccatatcattcgaggcggcc

SEQ ID NO: 1304 - DNA, 1070 bp, Oryza sativa
cgccatggcgccaccatgcatataaactcgagctccctctcctcctcttcttcctcctctccactctccaccatcgtcttcgtcgtcgtcttcctcagctcggagcgatggggaggtcgccgtgctgcgagaaggcgcacacgaacaagggcgcgtggaccaaggaggaggaccagcgcctcatcgcccacatcaaccagcacggcgagggctgctggaggtcgctccccaaggccgccgggttgctgcgttgcgggaagagctgccgcctccggtggatcaactacctccgccccgacctcaagcgcggcaacttcaccgacgaggaagacgagctcatcatcaagctccacgagctcctcggcaacaagtggtcgctgatcgccgggaggctgccggggaggacggacaacgagatcaagaactactggaacacccacatcaagcgcaagctcctcgcccgcggcctcgacccgttacgcaccgcccgctcaatgccgccgccgccgtcgccggccaccaccacctcgcgccggcggctccagctgctcgcccgacgcaacaagcggccacagcagctgcagcgacggcgacgagtaccgcggcggcatcgacctcaacctgtccataagcccgccgtcgtcgtcgtcccagccgtcttccccgccgccgccgccgcacgaagcagaggcgagacgcgccggagcgccggcgagctacacctaccaccaccactactcggagacgagggagaagatatgcctgtgcttgaaccacctcgggctgcacggcggcgacgagtgcagctgcggcggctcgtcggcctcttcctcctcctcgccgccgccggcgacggcgagctcgcgagcgttcacattcgccaatgcatcgtcgtcaacagtgtaaaacacagagaaattcagcgattttcagactaagagaattaatgagaggtagagcacatgcatgctgaattaattgaattaactcaatccaagcttgagctaggcatctagctaactttgtgatttgatcatgcatcagctagcaaaatcatcataatcatcatc

SEQ ID NO: 1305 - DNA, 1200 bp, Oryza sativa
gcacgaggaaaaagctcccacaaagcatcacctgcaaccagcccccgctcatctccatcttcctcctccctccctcgctcctgtgcttcttctcttcatcaacaagagagctttccctcgatctgtgtgtgtatatatatagagagagagggactgatctgggtgtagcgagctaggtagcctagctagcatggggaggtccccatgctgcgagaaggcgcacacgaacaagggagcctggacgaaggaggaggaccagcggctcatcgcctacatcaaggccaacggcgagggatgctggaggtcgctccccaaggccgcagggttgctgcggtgcgggaaaagctgccggctgcgatggatcaactacctgagaccggacctcaagcgaggtaatttcaccgaggaggaggacgagttcatcatcaagctccatgagcttctaggcaacaagtggtcactgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctcctttccagccgcaggatcagaccagcgagccgatgaaccaggaggagggcgacgaagcgtcagcgacggcgaacggcgccggcaatgcagcgatgacgacgacggcgacgacggcggcggtgtgcctgtgcttgaaccgcctcgggctccacggcggcgaggtgtgcagctgcggacgcgggggcgccccctccatgcaggccagcacacacatgtttagattcatcacgccgctaggaggaagccccccccccagtagtagcccaccaatgacataattaattaagttgagggaggagatatatataccctacttaattcgcaattaaaacccagccccacatgcttagctctttgtaatattcatcaggaaaggtgatctctttctcttttttttttt

SEQ ID NO: 1306 - protein, 287 aa, Oryza sativa
MGRSPCCEKAHTNKGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKLLSRGIDPQTHRPVSAGSSAAAASGLTTTASTAAFPSLAPAPPPQQHRLHNPVHAAAPSNASFARSAASPPSEDGHSSSGGSSDAPRCPDLNLDLDLDLSMSLPSSPPKTPAAASSTTASRHHHHQQQKTICLCYHLGVRNGDVCSCKAAAPSPAGPRAFRFLRPLEEGQYI

SEQ ID NO: 1307 - protein, 243 aa, Oryza sativa
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLGLRAGMLDFRSLPMK

SEQ ID NO: 1308 - protein, 2359 aa, Oryza sativa
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEVEMDRQWMYADRRSKEFIDGVHYFLRVAEANRQRGFICCPCNKCKNQKEYSASRTIHFHLFESGFMPSYNCWTSHGEQGVEMEEDEVEDDNIPDFAQYVGFEGNQTGEEEIAADGNDVADDLGQMLQDAREDCESEKEAHKLDKMLEDHRNSLYPGCEQGHKKLDTTLELLQWKAKNGVSDKAFGDLLKLVKNILPGGNKLPETTYEAKKIVCPLGLEVHKIHACPNDCILYRGEEYENLEACPVCKALRYKIRRDDPGEVNGQLTKKRIPAKVMWYFPIIPRLRRLFRNKGNARMLRWHAEERQQDGMLRHPADGSQWRNIDRKFKEFGKDARNIRFGPKQPGNDIDVYLRPLVEDLKQLWKKEGVPVWDEDKQEEFNLRALLFVTINNWPALSNLSGQSNKGYKACTHCMDETESTYLKHCRKVVYMGHRRFLAANHPVRKKGKHFEHKADHRTKPKHRSGKTVFAMVKDLKVVFGKGPGSQHIESEDGHAAMWKKNSIFWELPYWEFLDVRHAIDVMHLTKNLCVNLLGFLGVYGKSKDTLEARNDLKHMEQRGDLHPEPKEKGSHYLSPASYTLSKAEKESMFECLESIKVPSGYSTNIKRIISTKEKKFTNLKSHDCHVLMTQLLPVVIRGILPDNVRATITKLCAFMNAISQKVIDPDRLEALQNEVVQCLVSFELIFPPSFFNIMTHLLCHLVKEIRILGPMYLHNMFPFERYMGVLKKYVRNRARPEASIAKGYGTEEVIEFCVEFIEDLRPIGVPESRHEGRLRGKGTLGRKAIMTVDNNLFRKAHFTVLQHSSLVAPYIEEHLALVRARNIGKSDAWITRHHIDTFPAWLRQHLMGNESINQQLAFLARGPSGSIATFQGYEINGYTFYTRAQDMKSTNQNSAVRVDAMGHDGTTATYYGAIEDIWELDYGPLKVPLFRCQWVRLTGGGVMIDDSGMTTVDLNKVGYSDEPFVLANDVTQVFFVKDMSSKGKKGRGPDEPKRQVVLPGKRKIVGVEDKTDEDYDQLDGQPPFTVTIDPSILLSNEDTPYSRSDHKEGTIMADRDEEQILYDTIAEGSSQYWNEEEGNEDPNQYLNEEGNVERDAEGNQQGHVERDVEGNQEEEASGSQPSVGQKRARGQRGAAKKLEGRHIITEVEEDGRPSAPAEAAKNYVRHSGWVVRDNVPVSTVYWRRTRARGDHESFVQDSEKEMLWTTMLETFTLPAGTEDKVKRWTLKKMAEQFQSFKGDLYQKYILKGQTPNFDTFPKLRDHWDEFVAYKTGEQGKAMMERNKENAAKKKYHHHLGSGGYSVAMPKWEQMEASLIERGIEPATANWPERSKFWYYAHGGTLNPADGSLVFGYQIQEAVRRLTDAVEASSQGTFRPDRDRDELTLALQTPEHPGRTRGKGVIPWKIGFKEDIHTYRSRIRSKRDTEAKIADLEFRVSSYELNMQEEVARKVDERMAAHRSHDPQPTIPPAMVSPSGNRSSCASTGQVGSQSMDAMQTQDESTCPVDDITQRTPCELHIPFKNLSIKVASGMAIPTDPSGTYHCRPIPAGYSKVEVELVEGAYEDLELDYPGGDGETHLRDTCHAIILWRRRYIILPGRQAASRAPSPPAPPSPPQDPAPSPPHAPPAPSPPQAPASTPQDPAPTPPRAPTPTPPQAPVPAPSKSRAPPAPPLAHTRATKKAKVDAAKNKDPGYDCTQEELDAYVASEVKRQFKPRSPEKKIPIDPSVRNFFRGMSASVKEAIKLSDYEQTLKKASSGKSKPVPQLGEQPNQEIEPLVTGKEMTIEQFITDTGLTTDQLLGVAPIEKAEVKYMYELGKPLVKPELLQSLPTQMYKFHQLYMEMSATGREMIGARIRDTDFLQGDDILWINFRGIYELYQLDALDVSIMSCWILMEIQRARRRRVFDTGFIDPRKVNVAMLDQYPQETEDNLVHLLKAQHYKTFILLPYNTEFHWVLLLIDLEACTVNVYDSMDKKESTFDKVFELIDRAWYRFRHLVRGKWRERLRRKFKFPCAKQKQGTNLCGYYVCEYCHCLADQIITTRELDFIRMRDNLTTHKEFIAAVQEQLMGFINEEILDPKGEFYYDGNTIHRSLASELAASTTTSKS

SEQ ID NO: 1309 - protein, 261 aa, Oryza sativa
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEPRPE

SEQ ID NO: 1310 - DNA, 1274 bp, Zea mays
ttgggtacctcgaggccggccgggggctccttgcctttgttctgttctccattcgcgaaaggctcgcagcaaaaccacgccatcgatcgccgccaccagtccagcatcctccgatcgactacgtactcccacccactccggcagcagcgaggcctctctgtctgtgcgcggcgtggctgtcgtcgatctctgcctggcgggcggccggcatggggaggtccccgtgctgcgagcaggcgcacaccaacaagggcgcgtggaccaaggaggaggaccagcgcctcgtcgcctacatcaaggcccacggcgagggctgctggagatcgctaccaaaagccgcaggtctgctgcgctgcgggaagagctgccggctgcggtggatcaactacctgcgcccggacctcaagcgcggcaacttcaccgaggaggaggatgacctcatcatcaagttccacgagctcttcggcaacaagtggtcgctcatcgccgggaggctgccgggcaggacggacaacgagatcaagaactactggaacacgcacatcaagcgcaagctcctcgcccgcggcatggacccgcagacgcaccgcccgctcgccagcgcgaccgcggggcagcagcattaccagctgcaggagccgcagaagcgagcggccggcggcggtccagcaggccatccgcaccaggaccacttggaggtcgtcgtcatctccaactcgccggacgaggcctacagccgtagcagcgacgacgagccgcggtccgccacgccgccgcggcgccacctcgacatcgacctcaacctgtccatcagcctagcggcctaccagccgccggaggaaaccggcatcatcaagcagccactggtgatgaagcaggagcaggaaacggcggcgggcggcaccaatgccgcggcggtgtgcctgtgcctcaacagcctcgggtaccggccgggcgtcgagtgcgtttgcggcgacggcagctcctcctcctcctcctggcactcccactcccactcccaccaatgggctctgaattttttacaggcggcggcgccctgctacagaggccaatagtgtagtaagagcgatcagtgacatcattaaaatgggagcgttattacgatcgagactgagggtgagggaggggggcagagctgagcagggatagtagttaactacagctagtagtagtagtagtacgtaaaagacacacatgcttaggctttaacaagtctctgaaacacgcatcatgggttatgagttgtgctctta

SEQ ID NO: 1311 - DNA, 1305 bp, Zea mays
ccgggtcgaccccgcgtccgcggacgcgtgggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtagggccgccgcgcgcctctccctctccctcctacccctcgtcattcgtttcgtttcctaaactggccgggtacgttacgtgcaggtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggacgagaggaggaggagcgcaacaaggcgacgatggtcgtcggccgcgaccggcagagccagagccacagccacagccaccccgccggcgagtggggccaggggaagaggccgctcaagtgccccgacctcaacctggacctctgcatcagcccgccgtgccaggaggaggaggaggagatggaggaggctgcgatgagagtgagaccggcggtgaagcgggaggccgggctctgcttcggctgcagcctgggactccccaggaccgcggactgcaagtgcagcagcagcagcttcctcgggctcaggaccgccatgctcgacttcagaagcctcgagatgaaatgagcgcgcttctaccctctctgtgtagcttctccccccccgtcgtcctcgtttttgttttgccacacctcacatggatgatgaattgatgatacgtggttggttagttttttcgtaggtgaaaaatacgcgatggtgagcgagtgaaagagagattttgtgccctgggtcctcctccctgctctctcttgctgctccattttgcctccctctgtcctctctctctctctctctctctctctctctctctctctctctctctctctgtatctctgtaattaccatcgccaaatgatcatgggggcaatatcatgctaggtctctggaaaaaaaaaaaaaaaaaaagttgacgctaatcccgtttccagg

SEQ ID NO: 1312 - DNA, 1014 bp, Zea mays
  misc_feature (32)..(32): n is a, c, g, or t
gaggccaacccttttcaccactctaaagagcnctcgcgatccagtcaagtgcggtatggcggcccgccccccggcccggctcccacccttgcgcgcgcagtcgcagcaacgatggggaggtcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaaatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgtctgtctctctctgtaacttcacccctgataacacgcagtagtagtagtcaccaactgatttgtcgctccattaattctgtctctctctctctctctctcgctatgtaaattagcatcaccaactgattgattgatcatgggcaattaataatacttgttgctgctgcaaattgacattaaaaaaaaaaaaaaaaaaaaaaaaaaaaaaaaaaaaaaaaaaaaaaag

SEQ ID NO: 1313 - DNA, 1334 bp, Zea mays
cattgggtacctcgaggccggccggggattcctcagtcaagtgcctatgcctatctatggtaccctcccccgcctcccggcacacccttggccttggcctggcgctcgcacctcacagcagcagcagcaacaacaacctccactgccgcaacccaccgagaggcgagaccggcggcggcaaaaggacgatacaaaagcagccagggttgctggcaacagcgtcggtcgcccgcccgctcgccatggggaggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggacgagaggaggaggagcgcaacaaggcgacgatggtcgtcggccgcgaccggcagagccagagccagagccacagccaccccgccggcgagtggggccaggggaagaggccgctcaagtgccccgacctcaacctggacctctgcatcagcccgccgtgccaggaggaggaggaggagatggaggaggctgcgatgagagtgagaccggcggtgaagcgggaggccgggctctgcttcggctgcagcctggggctccccaggaccgcggactgcaagtgcagcagcagcagcttcctcgggctcaggaccgccatgctcgacttcagaagcctcgagatgaaatgagcgcgcttctaccctctctgtgtagcttctccccccccgtcgtcctcggttttgttttgccacacctcacatggatgatgaattgatgatacgtgggtggttagttttttcgtaggtgaaaaatacgcgatggtgagcgagtgaaagagagattgtgtgccctgggtcctgctcgctgctctctgttgctgctgcattgtgcctcgctgtgggctctgtgtctctgtgtgtgtggggagtgtgtgtgtgattctgtgggtgg

SEQ ID NO: 1314 - DNA, 1315 bp, Zea mays
cttttttttttttttttttttttgagcagactgcaatgaatcatatcctcaagaggataaaaaaactattacctcctgtgcagggcatcagcgacaggaaaagagagatgaatgaacgaacctaatccatccatcagcagcgtaaccaaatcaggcacaggtttgagtattaaaccagtggaagtgatgagctgggagcaggcctaacccttttccaccaactctacaagagctcccgcgatccagtcaagtgccctataaaatccagccccgcttggcttcacccacccttgggctcgcaatcgcagcaacgatggggagatcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaagtaggcagcccgaccgacctcaagcactaaggcacccactaaggcactaactgtgttgtctgtgtatgatctgtttgttgggtcacagatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgcccacgcgtccgcggacccgcgcccctgataacacgcaggagtagtagtcaccaactgatttgtcgctccattaattctgtctctctctctctctctcgctatgtaaattagcatcaccaactgattgattgatcatgggcaattaataatacttgttgctgctgcaaattgacattaaaaaaaaaaaaaaaaaaaaaaaaaaaaaaaaaaaaaaaaaaaaaaaaaaaaaaaaaaaag

SEQ ID NO: 1315 - DNA, 865 bp, Zea mays
  misc_feature (13)..(13): n is a, c, g, or t
  misc_feature (717)..(718): n is a, c, g, or t
gcccgggcccgtnagcacttagcccccaacaacaacaacagcaccaacttccactcctgcaaacccaacccaacccaacccaccaccgagcacaagaaaaaggagagccatcggcggcggcagaccatcgtctaaaggcaaaggccctgttcgataatacgatggggcggtcgccgtgctgcgagaaggcgcacaccaacaggggcgcgtggaccaaggaggaggacgagcggctggtggcctacgtccgcgcgcacggcgaagggtgctggcgctcgctgcccagggcggcgggcctgctgcgctgcggcaagagctgccgcctgcgctggatcaactacctccgcccggacctcaagcgcggcaacttcaccgccgacgaggacgacctcatcgtcaagctgcacagcctcctcgggaacaagtggtcgctcatcgccgcgcggctcccggggcggacggacaacgagatcaagaactactggaacacgcacatccggcgcaagctgccgggccgcggcatcgaccccggtcacccaccgccccgtcaacagcgaccacgccgcgtccaacatcaccatatccttcgaggcggcgcagagggacgacaagggcgccgtgttccggcgagacgccgagcccaccaaggcagcggcagcggcgatcacccacgtcgaccaccatcaccgtagcaacccccaccaccagatggactgnnggccagggaagccgctcaagtgcccggacctgaacctggacctgtgcatcagccccccgtcccacgagggacccatggtggacaccaagcccgtcgtgaaagaggaggccggcgccggcggtcggcgtcgtgggcctctgcttcagc

SEQ ID NO: 1316 - DNA, 1239 bp, Zea mays
gtgcggacgctcgaggccggccgggttgcgaggcctaacccttttccaccaactctacacagagctcccgcgatccagtcaagtgccctataaaatccagccccgcttggcttcacccacccttgggctcgcaatcgcagcaacgatggggagatcgccgtgctgcgagaaggcgcacacgaacaagggcgcgtggaccaagaaggaggacgaccgtctggtggcgtacatcaaggcgcacggcgaagggtgctggcgctccctgcccagggccgccggcctgctgcgctgcggcaagagctgccgcctccgctggatcaactacctccgccccgacctcaagcgcggcaacttcaccgccgacgaggacgacctcatcgtcaagctccacagcctcctcggcaacaagtggtccctcatcgccgcgcggctcccgggccggaccgacaacgagatcaagaactactggaacacgcacatccggcgcaagctgctgggcagcgccatcgaccccgtcacgcaccgccgcgtcgcggggggcgccgcgaccaccatctcgttccagcccagccccaacaccgccgtcgccgccgccgcagaaacagcagcgcaggcgccgatcaaggccgaggagacggcggccgtcaaggcccccaggtgccccgacctcaacctggacctctgcatcagcccgccgtgccagcatgaggacgacggcgaggaggaggaggaggagctggacctcatcaagcccgccgtcgtcaagcgggaggcgctgcaggccggccacggccacggccacggcctctgcctcggctgcggcctgggcggacagaagggagcggccgggtgcagctgcagcaacggccaccacttcctggggctcaggaccagcgtgctcgacttcagaggcctggagatgaagtgaacgaaacgaagcccacacgtcctttcttctccttttgttgtcggttttagtcttggcttgttggatttggatagagctagttggttactagttgttagttagaagatagtgcaggatgatcactagctactggctacctcaacacagtagctgctcccttcttctcttccattctatgtaaaccccccccaaaaatacttagtacctggttgatgaactttaggaataatcatgtgtactttcttctgactccgggttgcttcccggattctttgtgttgtaatgtaactactactactacaagtagtagg

SEQ ID NO: 1317 - DNA, 1027 bp, Zea mays
tgttgtaggaaggtggggcgcgagtcgcacctcgcagcagcagcagcagcagcaacaacaacctccactgcgcgcaacccaccgagaggcgagagcggcggcaaaaggacgatacaaaagcagccagggttgctggcaacagcgtcggggggtgtttttttttttccatggggaggtcgccgtgctgcgagggggggcacaccaacaagggcgcgtggaccaaggaggaggacgagcgcctggtcgcgcacatcagggcgcacggcgaggggtgctggcgctcgctgcccaaggcggccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgtctgtctctctctgtaacttcacccctgataacacgcagtagtagtagtcaccaactgatttgtcgcaacattctgtctctctctctctctctctctctctctctctctctctctcgctatgtaaattagcatcaccaactgattgatcatgggcaattaataataaaaaaaaaaaaaaaaaaa

SEQ ID NO: 1318 - DNA, 1531 bp, Oryza sativa
cactctcagaaagattttcttgatttggatcaggagtattgccgttctactgtaggccagtacgatgctgcaagcctggcagctgcatggattgcagggtttgacaacaatgtggagacaagcatgctggagaaggtggatgacatattggcaaaagatctgtaggcatcttggttgcagtggcattgcatcattggtgcaaaggctgcatagttgtgaggaaagggctgtgctgcggcattgccgtcgaattttggatccacaggaagtgttggatggatgcattgattcatagttccgctggctcctcccatttgatcacttgtttgatcaggatggcttccttcagttccagtggcttgaaagccagtaaccccatttctgtccatttggtagtgtgaagcttttgcagcagaccaatccacatatgttgtctccacagagtttgattttggcttaaattgttggcttgaggtatccaaacagttttcatgagaatgatcaggcttcgagctgatgtgtatcccattgagcctttccatttcttgatcattgatatcttttgcatccttccctgcaccattggaaatagaatccctttccaagatgaccacatctttgacttctgttttagtcggttccagccccctggatgcaccatgatttgaagagcttttgttaactgaagaaaatgatgccgatgggacttctcgaaagagattaagaacttcggagcaacttcctttttcagatatctcctttctttgaagtttctcccttcctggaagtttctcaagagctgcatcacctgccatttgtgcagtgctattgttcgtcatatttgatattgttgccttatcattttgaacttccctggtggatgtctcagagctgagacaactttttcgaggatatggactgttaggttttctttttggtcgtggtggaggtatgtcgatgtcatgagcttgtcctggagaagtgccattgttgatagcttccttttccaacttggtgaagaacttttgagcatgacttctgatctgcacagctgtctttgtcccaacatgctcttctatgcgctgccaggctctcccatacagtttcaaggcttcaaggaacctgttgtgctctgcctcagtccaacgctccctctgctttgtgattgtgtatggcttcctcacctttaccaccgcttcctcaccagaggaattaatctccattcccaattcaagaaaaagaagaaatataacagaagtgttggcaattggtcgctttgtcagttagagttgaggtcttccacaaacaaaagcactcctccttccatatctccaaccaaacgctggacctgacacaagtagtacctcatacctcctcctagacctctacttcacccgcgccccgtgctcccgctctactaaatcctcagctgcagttggtctgtgcacacaaaaaccaagtcagcagagttcacccttgctcctttcgttatcttcaactctagaatcagattaaaactcgcagttctcaa

SEQ ID NO: 1319 - DNA, 1310 bp, Zea mays
cctgccgggcttctattcgtcttcctcctcttccacccatcctgcctgctcacttccgttccgtagtccagctagatccccgggcaaccgatccaccgagaagcttgtggttgtggcggcggcggagagggaagcggggagcgggaggtcggaggtaggcgcggatgccactgttgtgccggcgccggcggggccggtgatgcccgcttgagctgggcctccgtgcgtcggaggtggacgagggagcgaggcggcgccagaccgaggttgcgtcgggctcgatttctactgggctgctgtctgctgagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggagatgaattcctctggcgaggaaactgtggtaaaggtaagaaagccgtacacaataacgaagcagcgggtagcggtggactgaggctgaacacaaacggttccttgaagccttgaaactttatggttgagcatggcagcgcatagaagagcatgttgggacaaagacagccgtgcagatcagaagtcacgctcaaaagttcttcactaagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccccataattgatttcttcaaagttatatttacatctaagctactatagggcttcagatcctgcaatgcagtgcttccttaaaactcaatctgttgtgtgctgtattttaatgcttgtcaagcaggcccctaggctgctttaaaaccttatctcgtagactttgatttaagcatcatgcaactatcaaacttttttttggtcaaaaaaaaaaaaaaaaactcgagggccatcgatgagcgctgtcctcaagatgctggaggaggagatcttgtccccctgcatgagcgagctgtgctacgagcagcacctggagctctgagctgaggaggaagatggtgctggctgcgtgcgtgaagcgtcatggatgagact

SEQ ID NO: 1320 - DNA, 724 bp, Glycine max
gcggccgccctttttttttttttttttttttgatcaattatctgttataccttgtgtttttttatttattgagaaacaacaacaaaactacatttaaaatgataattgatacctaagtttttaagaagaattacttaaaaaacctcaaagggagatctatgtcaatacaagaaaaagggggggggggagagaaaggaatgaaagaagtgaaggcttaacaaggttgacgttgaccacctgagctcatcctccgtcttttagatggaaaaagctgccggaaatcaccatgagccacggcggcaacatgccattcatccaaagccaacctctcctcctgaccaaactgcggtttgacctttcgcctgccagctcctactggcacgttgcgaagggccccaccagccgtccagtatctctggcatcccttgcagaaatgtctgggctgattaacgttgtagttattgaagtagcaaaacttggtttccatgctcttgcatcttgggcatggtatgatcttatcaggtctctttatctcctctgtcccatcttcactatcatttctatcttcttttctttctcttccatgcaacgtaatcgttgttccaaacagtttaatcccttcactagcttggccactttgtgcttcagccattaattttagagagaggaacaaagagagaatattattattcttattgaagaaggtttagctcgagccgaattc

SEQ ID NO: 1321 - DNA, 862 bp, Glycine max
tttcaatcctcttatctctttgtccatggactaatatttcatctatatctgcataccatcaatttcggggatcccaatcttatgtcacagctataatgtgtaacccccttaaccaattatccgcagtctatattcatgccttaaaattaaccttgcttatggacaatggacatgagcttcgaggaaaaaaaaccaatctcagcatctcacgtctcctcatagttgaacatcatcatttttttaggtgtgttcacatcttaattctcaagacacgctttggtcccttcgctgctgaagtccttaatttcttgttcataataattccaagttgtgttttcgtacatgatttcattgaccttgatgctgagctcctgaggtgattctctggcgcttggcctgaaaaatctggcggaaatgagtgttgggcatggcaacgtgtccctgattcatctcaaacctgttttcatcttcagaagtttcataggcacgcccatccatgaagtcaccggctccatggcacggtgacttagccttccggcgcccggcgccgaccgcgacgtttcggagggccccaccagccgtccagtacctctggcagctcttgcaaaaatgcctcggctgattaacgttgtagttgttgaagtaacagaatttagtttccatgctcttgcatctcgggcagggtattatcttctctgctctcttctccaccctctcatattcgcttcctttttctcctttctttacttccccacccttcaatgtaatcagcgcaccaaacagcttaatcccttgagattcctcgcccatttcagagagagagagagagagttattcttaacggagaaggttttggttggcg

SEQ ID NO: 1322 - protein, 205 aa, Oryza sativa
MAPAAGGFKLFGKVIMQCGVSEGTQDKAQGFVVAREKVEPEEEEEEEQRVPAAATSGQRASIKREAADRDEEQRQGGGDAAGQPTQRRLQDSAEARAAAAAPLPCPRCRSRDTKFCYFNNYNVNQPRHFCKACHRYWTAGGALRNVPVGAGRRKNRPLGPLAVAHHNHHHRAAAGFVLGFPNPSSPTSPSPVYTDRWPVTPDRPF

SEQ ID NO: 1323 - DNA, 820 bp, Glycine max
  misc_feature (7)..(7): n is a, c, g, or t
gtccggnaatctcccgggtacgacccacgcgtccgcaaaacccaaacctcaataaaaccgaaactcacaaacacttaaacagaggaagtaacgaaccaaccaacctgacacagccgccacaaccataaacattagcataaacaaaaaaccgttaatctcgcgcgttcttttttgttgttgtgtcgtgtcccttttggatctccagaaaatgcaggagaataaggatccagcaattaagctcttcggccagaagattgccttcgccggagaagtcgaccctccggccatttccgccggcgaaattgactcgccgccggcgatggatgtcgacaaggacgaagaagacgactttggtgactcagagactgaagatgagaaagacaaggatccccgagctgaaaaagttagtgagaaaacgaaagaagctgatcctcctccaaatgctgcagactcaaagaagaccccagagggtattcagaacccaaacacaccttccatagacgaagaatctgcaaagtcaaaaaccaacaagtcagagaacaacaacaacaacaaaacactgaagaagccggacaaaattttgccgtgtccgcgctgcaacagcatggacaccaagttctgctactacaacaactacaacgtcaaccaaccccgctatttctgcaaggcgtgccaaaggtactggaccgcgggcggcaccatgcggaacgtgccggtgggagcggggcgaagaaagaacaagaactcagcctcgcactaccgccacatcacaatctctgaagctcttcaagcggccagaattgatgcccccaacggaact

SEQ ID NO: 1324 - DNA, 1745 bp, Glycine max
ggctcgaggttaaaaagaaagaaaaataaaaaaaaaccaaagaaacagaaatgttggtggcaaaagactccacgatgatgaagctcttcgggaagacgatccctgcgccggagatctccgccggagctccggcattgtcttctggtgatgctgatgctgttggtgttgttcagaaccatggttcttcaagtgtcaatggggatggtgaagagcacgagattgagcaggacataatgggagaggaaacaactgagagtgagaaggaagatgaagtgaccaatcttgatactgtctcaagaccaggggaagtgtctattaacccctctaccaagaaggaggatcttacattgaaaacttcaaaaaagaccgaacaagaacaaggtgaaaattcccaagataaaacactgagaaagccggacaaaatactgccttgcccccgctgcaatagcatggataccaagttctgctactacaataattacaatgtcaaccaaccccgccatttctgcaagaattgtcagagatactggactgccggtggagtgatgaggaatgttcctgtgggtgctggtcgcaggaagaacaagaattttacttctcagtatcgtcagataactgttcctgaagcagcactcttgagttctcagccggacttgccaaatggagtcagtcatccttccttgaactgtaatgccacactccttgcatttgggtctgatacacccttgtgtgaatcaatgacatctgttttgaaccttgctgaaaaagcagtgaacaattccacaacaaatggatttaatggctcagaagaactagaaattccttttgcttatgttgctggagaaaaagtgaatgatgattccaataaatcttctgacatgtcaacaaagccaatggaaggtgaaaccaccaataggtcccaagaacaagtcatagagaattgtcatcccttcccacctcatgctccctactttcctggtgccccttggcctttcccatggaatccagcactgtggaactccccggtaccatcaccacctgcttttttcccacaaggatttaccatgcctctctatcctgcagcagcttattggggtcttactataccgggtgcatggagcatcccatggctagcgcaaccatcattaccaaatagcacagtgtctaactctggtccagaccccattgcccgaaccatagccatgtcttgattgccacgtcccaaaaagttaacaggaggaagtggggtttcaacaagaggactcttattgctgttcaaccatattgcaatggaaagtgagggaaagtgagataaggcttctagacccacccagttactgttgatgtctctcttgatcctttagccaacaaagaatagtgggtttcctcttgggggaatgtacagggcagtgggatatgcctaaggggaaaagcaaaagtggtgaggaaaagaaagtgctctatggatgtgttgaaagcaaaatgaaatgccaatgtccaagataattagcttgatgcagaagatgtgattcaaatgtgaaagctaatgaagatagggttttgcgtgactcttgtggtagtttcaaggaacaatcctaacaaaaagaaaagcgtgagccatatcagcaatactctcaagatattgtcaaacatatttcttttaacacactttatattatgagtttaatatcttattaacagtataaaataattttacattattatttaattataatttattgttt

SEQ ID NO: 1325 - DNA, 1896 bp, Glycine max
  misc_feature (1859)..(1859): n is a, c, g, or t
  misc_feature (1863)..(1863): n is a, c, g, or t
  misc_feature (1872)..(1872): n is a, c, g, or t
  misc_feature (1878)..(1894): n is a, c, g, or t
ggtccggattcccgggtcgacccacgcgtccgccagaaagaaaaaaaaaatgcacgaaattagagaccctgcaattaggcttttcggtcagaagatccctttccctgaagatgttgttgttgacaaagaagaaaaagaaatagaaagtggcgaggaaagagaacaagagatggaaaaatatgaagaccaaggacacaaggatgctggagttgaaaatgttactgaggaagagctagaagttgatcctcctccaaatgctgaagagactaagaattcaggctcatcccctgaggctattgtgaaccccaaaacaccttccatagaagaagaaacagaaaaatcaaaaggtgacaaaacagagaaggaacaaggtgatgcagccaactcacaagagaaaaccctgaagaagccagataaagtgctaccatgcccccgctgcaaaagcatggacactaaattctgttactacaacaactacaatgtcaaccagcccccgcattcggctcgggacggctgcgagaagacgacagaagggggcaccatgaggaatgttcctgtgggggcaggacggcgaaagaacaagaactctacctcgcattatcgccacatcactatctccgaggcccttcaagcagcaagaattgatgctcaaaatggaactcatcttccaactttgaaaggcaatggtagagtcctcagctttggattagatgcacatgcacctatttgtgattccatggcatctctcatgaatcttggagagaaaaaggctcttaatggcacaagaaatgggtttcatcatggctttgaggatcaaagactccccgttccttgcaaaagtggggaaaatggtgatgactcttcaactacatcctccattacaatttcaagtcccaagggagaaaataacaaaagcaccttccaacaacaaccattgccccaaaatcatggtttccttcctcaagttccatgcattcctggtgttccttggccctatacatggaattctccagttcctccacctgctttgtgtccttcaggatttcccctaccattctatcctgctacattttggaattgtggcatgcctgggaattggaatgttccatggttttcctcaagttcacctgcttcaaacctcaagtctccaagctccagtcccaattctccaactttggggaagcactcgcgggacagtgacatgattaagcaagactctttgcacaaagaagaagcttcaacgccaagaaacgggagtgttttggtcccaaaaacgttgagaattgatgatccaagtgaggctgcaaagagttctatatgggcaactctaggaattaagaatgagtcagtgagtgggggagctatgtttaaggccttccaatcgaagaagggtgaaaagaatcatgttgaagcctctccaatgttgatggctaaccctgcagctttatctagatccctcaattttcatgaaaactcctgaattagtggcactggtgaaaagtccttacagcaaagttagtcacttcttgagttatttgtctagctagcaagagacggtgaccatctttgagtgacattgaccttgtatagaagaagcgaaagggtggtagtctctgatttcctcggcacaagtgagacgacgaggactaattctgtctttaatttcattcgacaatattaaaatagagtatataggttttttttcatgtgcttagtttgatgagtgagttcatgtatatgtacatatataaaaatatgtgaaatactgatctttagcctagagagacggaaaagatcttttactttcttgtagtataaaataaaaatcctgactgtagaaaagttagtcacctcccttngagnataaaatangaaatnnnnnnnnnnnnnnnnnag

SEQ ID NO: 1326 - DNA, 2093 bp, Oryza sativa
gtcggatctctctctctctgtctctctccctctctctctcgcccatgtaccatctccatggacgacctcgccgccgcctcccctcctcacccgccgccgccgccgccggaatcccacgtgcctccgcccccgcagacgccggagaaggattcatgtgaggatacaggagacatgaggatcagtgaagaaaagccatgcacagatcaggagttagatgctgatcagatgaatagttctagctttaatagttccagcgagtgtgagaatcaaacacctagcaatgatgaaatgactggatcagagtccaaatctgaggcagctcaaacagagggtggtggatcgagtgaagagaaggtcctgaagaagccagacaagatcctgccttgtcctcgttgcaacagcatggatacaaagttctgctactacaacaactacaacattaaccagccaagacatttttgcaagagttgtcagagatattggacggcaggtggaagcatgaggaacctccctgttggtgctggtaggcgcaagagtaagagctccactgcaaattaccgcagtatattaatcacgggcagcaatctagctgctcctgctggagatgctcccctctatcaactctctataaaaggagatcaaacagcaacggcagttaaatttgcacctgattccccactctgtaattccatggcctctgtgctgaaaattggagagcagagtaagaatgccaagcctacctcaacagcacaacccagaaatggagaaacccagacctgcccggcttcaggaacaacttcagatagtccccggaatgaaccagttaatggagcagttagtgggcatcaaaatggaattgttgggcatagtggagtccctcccatgcatcccataccatgcttccctggtcctccttttgtgtacccatggagtccagcatggaatggcattcctgccatggcaccaccggtatgcacagcaccagctgaaccagcaaattcttcagacaatggaagcacagctagtgttcagtggagcatgccaccagtgatgccggtaccaggatactttccggtaattccatcttcagtttggcccttcatttctccctggccaaatggtgcatggagctcgccatggattcaacctaattgcagcgtgtcagcttcatctcctacaagcactagtacatgttcagacaacggctctcctgtcctaggaaagcactccagggactccaaaccgcaaggagatgacaaggcagagaaaaacttgtggattccgaaaacgcttcggatcgatgatcctgacgaagctgcaaagagctcaatctggacaacccttggcattgaacctggtgaccgtagcatgttcagatcattccagtcgaaacctgaaagcagggagcagatatccggtgctgcacgagtcctgcaggcgaatccagcagctctatctcgatctcaatctttccaggagacaacgtgatgtatattgaagaaatcgtgtgacaattgtagaacatgttactactataatttaagcaagtgctacagcctgaaggatgattggcgatgtaggcgctgctgcaaacatggaggcagcgtgatctgtactattgaaacctgaagagtactattcttgacatttttctataatttgcctgtggagcatgcaccagtctactgggttcatgatcaggctgtcagcatatgttttgttgtacaataataataattgttaatagctttgcctaaaggatactgatagtattctgctgatccttcagctctgtgatcaatggcccatatatttacctgacaagtttcagaaaggaaaaaaaaaaagatctgctgcctgacaagaggttcaactccgaagaaatggttagcatttttgtactgcgtctgcgtgatgttaccttgttgctttctttggttctctaatgatcccttagttacctctatgatgacttgcattagttgaagtacctctgtccttttgttcggctgtgttgcctttatactagcatctgtgtagaatgtagaccgaagtctcaagctttcctttttgattcagtacgcttattgtgg

SEQ ID NO: 1327 - DNA, 1875 bp, Oryza sativa
gcacgagctcgtgccgaattccgcacgggaagatttcaagaaatccaaccaaaaatctcgcgctctcctctcctcctcctcctcctcctccgcatgagctcgtcggcgttggcgttggcctgtcgtctccgggaggagtagtgcaggcggcggcggggaagtccgaaacggagtttgttcgttttggagcggagtggtgaggtgagtcgtcgagatgggggagtgcaaggtgggaggaggaggcggaggcggagactgcttgatcaagctgttcgggaagaccatccccgtgccagagcccggcgcctgcgccgccggcgatgttgataaggaccttcaacacagtggcagcagcacgactgaaccgaaaactcaagagaacaccgttcaagactccacaagtccacctccgcagccagaggtcgtcgacaccgaggactcttcagctgataagaactcatcagagaatcagcagcagcagggcgatacggccaaccagaaggagaagctgaagaagcctgacaagatcctgccgtgcccccggtgtagcagcatggacaccaagttctgctactacaacaactacaacatcaaccagccgcgccacttctgcaagaactgccagaggtactggacagcgggtggtgccatgcgcaacgtgcctgtgggtgcaggccgacgcaagagcaagagcgtatcggccgcttcccatttcctccagagggtcagggctgctctgcccggtgatcctcctctctatgccccagtgaagactaatggcaccgttctcagcttcggctccgacctgtccaccttagacctcacagaacaaatgaagcatctaaaagataagtttatcccaacaaccggtatcaagaacaccgacgagatgccagtcggtttgtgtgctgaaggattgtcgaaaacagaagaatcgaaccaaacgaacctaaaggagaaagtttcagcagatagatctccaaatgttgcacaacacccatgcatgaacggaggagccatgtggccatttggcgtggcaccaccacctgcttattacacttcaagcattgcaattccattctatccagctgcagcagctgctgttgctgcatactggggctgcatggttccaggagcttggaacgctccatggccaccgcagtcccaatcccaatcggtttcatcatcaagtgctgcttctccagtatccacaatgaccaactgcttcagattaggaaagcaccctagagatggtgatgaggaactggatagcaagggtaatggcaaggtgtgggtgccgaagacggttcggatcgacgatgtcgacgaggtggccaggagctctatctggtcgcttattgggatcaagggtgacaaggtgggagcagatcatggcagaggatgcaagcttgcaaaggtttttgagtcaaaggatgaggcaaaggcatcaactcacacagcgatcagcagcttgccattcatgcaggggaacccggctgccctaacacgctcggtgaccttccaagagggatcttgacttgaacaacgccttggaaatttttatgctgccttctgctgctataaagacatagcgtgatacagctgaaattttgtacattagaggattgtaaagtaggtatgggagatggagtgtcagggtgtataacttaacatagctacaagcaagcccagtagctgtattagataacttgtacatagctatgtgggtttgagaaagatagggagagcaagttccccttataatatgtagataaataatataatgatttgaatatttagatcaaaaggatttcctttaaaaaaaaaaaaaaaaaaaaaaaaaaaaaaaaaactcgagggggggcccggtaccca

SEQ ID NO: 1328 - protein, 493 aa, Oryza sativa
MAALRQGDDPAIKLFGRTIPLLLDPPAAAAAAADEENSVLENSVLSFLDFLATFGVMPNLGNGVKTNNDLPLVSDKLLIVKGIPFCPNNSKKNDLQGISRPDGRIEIDSMTEDVKTEPDGSVPEKILKKPDKILPCPRCNSMETKFCYFNNYNVHQPRHFCRNCQRYWTAGGAMRNVPVGAGRRRNKHVSKYCQAMMTCNNTVAPGDVSDVVHHQVITHGSSLLPATLKENETPTEFISEVPPCKSSASILDIGEPNDTDLVPLASGDNKEEKSCASSVVVSSCSENLMPDNAIMKEPNNRSGCCNGVALPFPTGPALVLPWSLGWNSVALMPATQCSMQPVLGLKDGIPCPPSWPPQLMVPAPGICTPVVPIPLVPPLWSCFPGWPNGMWNAQCPGGSSSLVLGKHSREESLQEEEKTRNYLWVPKTLRIDDPAEAAKSSIWATLGIKPDDKGIFKSFQPNVAKNGTAPESPQALQANPAAFSRSQSFQETT

SEQ ID NO: 1329 - protein, 513 aa, Oryza sativa
MTTRRTRKERKQMGGGGKCKRGKRGKIAAKRRRGQVRCCSSSSSSGGARRRARERESEESLGEMGECRGGGGGGDGLIKLFGKTIPVQPDAKFLILGSASLGEFSDVQQHSGSSSSSTESDVQETAAVAVADPSPRSEVVDGESPPQPGGEAASHQQQQKEMKLKKPDKILPCPRCSSMDTKFCYFNNYNVNQPRHFCKHCQRYWTAGGAMRNVPVGAGRRKNKNATAAAHFLHRVRACAAAAAMPAAPHDATNATVLSFGGGGGGHDAPPVTLDLADKMTRLGKEGLVAHARNADAAAACSEVSSNRDDEQIGNTVAKPANGLQQHPPPPHHHHHSAMNGGGIWPYYTSGIAIPIYPAAPAYWGCMIPPPGAWSLPWPATVQSQAISSSSPPTSATPSVSSFTLGKHPREGGDHEARDHHGNGKVWVPKTIRIDNADEVARSSIRSLFAFRGGDKADDNNDDDGTGVHKLATTVFEPKRDSKTAKHPAITSLPLLHTNPVALTRSATFQEGS

SEQ ID NO: 1330 - protein, 438 aa, Oryza sativa
MRISEEKPCTDQELDADQMNSSSFNSSSECENQTPSNDEMTGSESKSEAAQTEGGGSSEEKVLKKPDKILPCPRCNSMDTKFCYYNNYNINQPRHFCKSCQRYWTAGGSMRNLPVGAGRRKSKSSTANYRSILITGSNLAAPAGDAPLYQLSIKGDQTATAVKFAPDSPLCNSMASVLKIGEQSKNAKPTSTAQPRNGETQTCPASGTTSDSPRNEPVNGAVSGHQNGIVGHSGVPPMHPIPCFPGPPFVYPWSPAWNGIPAMAPPVCTAPAEPANSSDNGSTASVQWSMPPVMPVPGYFPVIPSSVWPFISPWPNGAWSSPWIQPNCSVSASSPTSTSTCSDNGSPVLGKHSRDSKPQGDDKAEKNLWIPKTLRIDDPDEAAKSSIWTTLGIEPGDRSMFRSFQSKPESREQISGAARVLQANPAALSRSQSFQETT

SEQ ID NO: 1331 - protein, 440 aa, Oryza sativa
MGECKVGGGGGGGDCLIKLFGKTIPVPEPGACAAGDVDKDLQHSGSSTTEPKTQENTVQDSTSPPPQPEVVDTEDSSADKNSSENQQQQGDTANQKEKLKKPDKILPCPRCSSMDTKFCYYNNYNINQPRHFCKNCQRYWTAGGAMRNVPVGAGRRKSKSVSAASHFLQRVRAALPGDPPLYAPVKTNGTVLSFGSDLSTLDLTEQMKHLKDKFIPTTGIKNTDEMPVGLCAEGLSKTEESNQTNLKEKVSADRSPNVAQHPCMNGGAMWPFGVAPPPAYYTSSIAIPFYPAAAAAVAAYWGCMVPGAWNAPWPPQSQSQSVSSSSAASPVSTMTNCFRLGKHPRDGDEELDSKGNGKVWVPKTVRIDDVDEVARSSIWSLIGIKGDKVGADHGRGCKLAKVFESKDEAKASTHTAISSLPFMQGNPAALTRSVTFQEGS

SEQ ID NO: 1332 - DNA, 507 bp, Zea mays
cgagggaagcgaagggaagctattgacagttattcttgtacaaccaagcacgcacgcgctggaaaacctgatcacctccaacccaacatgttgggggcacgctctacatggaaacaacacactgtttgaggatgcactcttccaatggttacagttacagtaacggtgcccgctgccttgtacagcagcagcacctatgttgccaatcatattgtacagaacatatatggcatgtttggtttgcttttacggacaacggaaacagggaagcctctccgccaggattagctacactactgctgcctggaacgggaatcaacacgctgcggcaactcgcgctggagctcttgctcttgcgcctcccagcaccaacggggatgtttctcatgcttccgcctgcggtccagtacctctgacagctcttgcagaaatgccttggctgcttgatgttgtagttgttgtagtagcagaacttggtgtccatgctgttgcagcgagggcacggca

SEQ ID NO: 1333 - DNA, 1053 bp, Glycine max
ccagatgcaagcagggcatcaagcaatggtgtctggactactactttatccgccgagcctgaagctgttagagaccatgtgccgagaacaagtcctcagaatgaaaaagggaaatcggagatgcttgaaccaactacaacttcatcatccggtggctcaggtagtagtcttggaaaaaattgttcgctatctacgagaaaccagggccaaaaaagaaaaggaatagatgtggaagaatctgaggagcaaagtgaggacacagaacttaaatcagcacttggaaacaagtcatctcaacgtgcagggttggctcgaaggaaccgcgctgctgaagtgcataatctatctgaaaggagaaggagagaccggatcaatgagaagatgaaggcattgcaacaactcatacctcacagtagcaagacagacaaagcatcaatgttggaagaggcaatcgaatacttgaaatcacttcagttacaacttcagctaatgtggatgggatctggcatggcaccaattatgtttccaggaattcagcactatatgtcacaaatgggtatgggaatggctacaccgcctttccctcctattcacaatccgatgcaattaccgagactgccgcttgatcagtctgtatctgcgtctcagacaccaaaccagacattaatgagccaaaatcctattttgggtgcctttaattaccacaatcagatgcaaaatccagctctttcagagcaatatgcgcgttacatgggctatcatcttatgcaaaatgcctctcagccaatgaatgtattcagatatggtccccagggggtacggcatagtcaaacaatgattacacccagcaacagcagtggaaacatgagtggagcagcaaatattgatgaggctgtgagtggcaaaatgggttaattagtttcaaagcatgcttttgagtacctatggcgtaactaacaagataattgcaagatgatagaagcccttgtaaggcttgtatgctttcacaatatgtctgcctgttcatacagtggctgatctacagttatgtga

SEQ ID NO: 1334 - DNA, 809 bp, Glycine max
  misc_feature (694)..(694): n is a, c, g, or t
  misc_feature (741)..(741): n is a, c, g, or t
tcgcgatctacctgattcatcccagaaagacaatgacttaggtgcatcacgaaaggttctaaattttcctcacttttcaacaccccgtaataatgtttcttcagcacctggtagtacacagtttagggaaaaaactactgctaacttgtcacaaagtgaggctagagagtactcagtgatcacagttggttcaagtcactgtggcagcagtcatatccctcaggagaaagatgtaagcagggtttcaagcagtgctgtttgggctactaataataataatagtttatctgctgagcctgaagctgtcagagattgtgtccagagaccaatttgtcctaggagtgacaaaggaaaatcagagatgattgaaccaactgtgacttcatcttctggtggctcaggcagtaccggtattggaagaacttgttccctatcaacaagagatcatggccaaaagagaaaagggacagaagaagaagcatctgaggaacaaagtgaggccacagaacttaaatcagctgatggaaacaaggcttctcagcggacggggtcttccaaaaggaaccgtgcagctgaagtgcataatcaatcagaaaggagaagaagagataggatcaacgagaagatgaggacattgcagcaactgatacctaacagtgacaagacagatgaagcatcaatgttagaagaggcnaatcgaatacttgaaatcgctccagtttcagcttcaggtaatggtgnatggggtctgcatgacaccagtgatgttcccaggaattcagcactatatgtcacaaatgggtatgggg

SEQ ID NO: 1335 - DNA, 487 bp, Oryza sativa
  misc_feature (382)..(382): n is a, c, g, or t
  misc_feature (439)..(439): n is a, c, g, or t
gccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaaggtaagaaacattattatatatgcatcttttttctgatcaggtgcaagtccatggactgatacagctatgttgancggacaaggcatctatattagatgaagcaatcgagtatctgaagtcactccaaatgncaagttcagatcatgtggatgactactgggatggcaccaatgatgttc

SEQ ID NO: 1336 - DNA, 1108 bp, Oryza sativa
ttttttttttttttttttttttttttttttttttaaagaagggcaaagattgccactggcacttcatattataaggattattagtacatacactgggaattagcatcttagggaaggggggaaatgctatgtgcatttacagacacttgtagcatttatgtcagacagatactgattgagatacataacagcaatatggatgcaatctgttcatcatgtcaatattttcagctatctccagaaagacgaccctttgtgcaaagcctacattgaattccttatcatgtttctggtcattctaaattccatcagaggttggtggttgttcagccccagaatttggcagaacagtgctagctgacgctttcggtatctggttttgctgtgctacttgaggcccagaagcatatggtcctgatacctgtggtggcactgtttgccagccatctgggtgaaggaagggattgcttgcctctctcagttgaatgttctgcatctggtttgcaacattcattgggttcatagctggagatgaatttagagggatgtgatttggcatagaatggttcatgtatggcaatcttgacatgtgacttaggccttgtgccgcaggcatgcacgcagaattcatgcccacggccattggtggcatgaactggtgagcaccagggaacatcattggtgccatcccagtagtcatccacatgatctgaacttgcatttggagtgacttcagatactcgattgcttcatctaatcgggcgcccgggtcggtcttgttgcaatgaggtatgagttcttgcaatgcgcgcatcttctcgttgatccgatcccttcttctcctctctgacaggttatgaacttcagctgcacgagttctcctctttgatccatatcgccgcgacgacgatttggtctcttcggttgcctcgcattcagcatcctcactgcgactgtctgaatccgctctgcctttcctcttgtgggcgctggcgctctcgctgggcaagccggaagcgccgaagttgctgccgatctcgccccccatccatcccacgattcttgtgtccccccaagaaattcacaacctgcataacccctcgtgccg

SEQ ID NO: 1337 - protein, 451 aa, Oryza sativa
MAICSTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRINEKMRALQELIPHCNKTDKASILDEAIEYLKSLQMQVQIMWMTTGMAPMMFPGAHQFMPPMAVGMNSACMPAAQGLSHMSRLPYMNHSMPNHIPLNSSPAMNPMNVANQMQNIQLREASNPFLHPDGWQTVPPQDKEFNVGFAQRVVFLEIAENIDMMNRLHPYCCYQQQEQQLGEPEDYVWEPYHHCKLPSSQQKPEGGDLEFMSKLVASIISC

SEQ ID NO: 1338 - protein, 447 aa, Oryza sativa
MDAGATARSSSSSAMMMNQKKPLLSDGELVELLWQDGGVVGHAQTRHRSSDVLARSGVTGEEETASAWFADGGGGGGGDDDALGLGMGRDIYSQLWHSFANVDGHAAGALALATPTPTPRAAARSDDVSSRLDEADLSICGSNAVVAPALPADDDDDIDAAAPREEEEEEEEGPGAARAAGASSSGGSGSGSGSYPLFKRGREELVDSLSEVADETRPSKRPAAKRRTRAAEVHNLSERRRRDRINEKLRALQELVPHCNKTDKASILDEAIEYLKSLQMQVQIMWMTTGIVPMMFPGTHQLMPPMGMGLNTACMPGAQAQGLNQMQRTTYYMNNSLPNQMPQIPSPAMNAPSVPDDMQNDNRIRGPRNPFLHCNDTLTATAQVDYYVKFHHYRSFRLQFLFILQYQFFSGARHRQYVKNIVAVWTQLEPASQKLHKNTTVTVSLFF

SEQ ID NO: 1339 - protein, 377 aa, Oryza sativa
MAVAAAAATTTRWAWAWAGTSTRRLWHSFANVDGHAAGALALATPTPTPRAAARSDDVSSRLDEADLSICGSNAVVAPALPADDDDDIDAAAPREEEEEEEEGPGAARAAGASSSGGSGSGSGSYPLFKRGREELVDSLSEVADETRPSKRPAAKRRTRAAEVHNLSERRRRDRINEKLRALQELVPHCNKTDKASILDEAIEYLKSLQMQVQIMWMTTGIVPMMFPGTHQLMPPMGMGLNTACMPGAQAQGLNQMQRTTYYMNNSLPNQMPQIPSPAMNAPSVPDDMQNDNRIRGPRNPFLHCNDTLTATAQVDYYVKFHHYRSFRLQFLFILQYQFFSGARHRQYVKNIVAVWTQLEPASQKLHKNTTVTVSLFF

SEQ ID NO: 1340 - DNA, 2125 bp, Zea mays
cgatatgatcgatgggcaggtaatcttgccggttgctctgctggttgttggttttttttttttttttttttttcctaggaattgactgctgattgaatattgcttgctgtacagatcagtacacacagtaggacaggagtcggagttggcatctcaggggagaggggttgctatctacctgcaactctgcatttacatgtagatgtagcattcgtgtccagacaagcattgccatattgatgtagatacactgcagcgcagctacagagatgccatccgctcctcatcacgtcagtatttccagggattgccagaaaagaaagaccctttcttgatcccattcaattctcttgaacgctgtactgcagtctgcacagcagtatgcagctcgagttcttccgtagatagaatacggcggtagacaggctgttgtcttgtaacctatacaagactcctgataataactctagaactaagcttacatgtcaaagaatatggttctgacacttctgtacagatatacagcttaaggcatgattttgatcactctaaactccatggaaagttggtggttgccctgccttagaagttggtataacagtactagctgccacttccagtatcttattgtgttcttcggcttgtgctatttgatgtccatgaacgacatggggtcctggtcctggtacctggggtaccactgctgctcgcccgccatctaggtgaaggacgtggctacctgcatccctgaggtgaccgatttgcacctggttcgcggcgttcagtggattcattagattcatagctggagacgagttcagagggatatggtttggcagggtgtggttcatgtatggtaatcttcgcatctgacttaggccctgtgctgcagggatgcaacctggattcatgcctagagccatcggtggcatgtattggtgagcaccaggaaacaccattggcgccatcccagaagtcatccacatgatctgaacttgcatttggagggacttcaggtactcaatcgtctcgtctagtatcgacgctttgtcagtcttgttgcagtgcgggatcagcccgtcccgcgcgcgcatcttttcattgatccggtcccttcttctcctctctgagagattgtgaacttcagctgcacgagtccggcgtttcgtcccatatcgccttgatggtttcgtttcctcccttgcctcctcacactcggcatcctcactcggactatctgagtcgtctctacacctccccttttctcttctgtacatggacgctgtcactgggcagcccggatccccccatagttgcttccagacccgccggatgacgatgtgccgtcgtgcgcgccggtattgctcggcaactccgactgcaatgccgcgtccttccccctgatccttgccggcgtcctgagcacctggttgcttccgcagaaggtcgagcagatgtcgccagcccagctcgactcgacgccgctgctcccaacgggcggcgaaggcgaaggctgcgaggtagggcccgggagcgttccctcgtgctgcggggcggcgtcggcgatggtgctgtaccagagctgcgtgtacaggtccttctccagcgcgtcgtcgagggtgtccgggaaccacgcggcggtctcttcgccggtgaggccgctggtgcccgggcggtcggggtcgtaggtgggcgccggcctctggtgcgcctggggctgcgcgacgacgctcccgttgtgccacagcagctccacgaggtcgtcgtccgcgacgacgggcttcttctgattcgttgccgccgacctcgcattgccgtccatctcgtcaggacttcgactcgagtgcccggagaacaacgtcttctctcctgattctgaacggagtactgctgcgtgctgctgctgcctcgcccgagcagagctaccttgcgagtcgtcgcctccgtccgtccttggcgccttgcaagctgcaaacaggagcaggctcagggagcttttatgaggcagctctgtagcagcacggcatgagagcacacaagtcggagcgctcgtacactgggtcgccgcccccgctgtcccgtttacttcgctctctcgagaaaggagagaggcccggacgcgtgg

SEQ ID NO: 1341 - DNA, 1850 bp, Glycine max
cctctattctccgtctctctactctcttattctcaacgtcaaacccaaaaccccttcttcttcttcttcttctctcgcgccgcaataataatactaaaacatgtccaactctgatggagccactaacgccgtccctcccaacgacgccaacaacaacacaatcgttgagtaccagcagcgaaccaccaccaccaccaccgccgccgccgccgccctcgccgtcaagaaaccgccttccaaggaccgccacagcaaggtcgacggccgcgggcgccgcattcgcatgccgatcatctgcgccgcccgcgtcttccagctcacgcgcgagctcggccacaagtccgacggccagaccatcgagtggctcctccgccaggcggaaccctccatcatcgccgctaccggctccggcaccactccggcgagcttctccactgtctccgaccacaagcccctcctccctccccctacccccttcatcctcggcaaacgcattcgccctgacgacgactccgccgccaaagacgacgccgtctcgctcgtcgccccccccacgccgcccgccctctgggccctacctccccgccccgacttcggccaggtctggagcttcgccgccgcgcccgaactcgtgtcggtgtcgccgcagaattcaatgtttcaccatcaccatcaacaccaccagcagcaacagcaacaggccgccatgggagaggcctctgccgcaaggctcgggaattacctccccggccacctcaatttgctcgcctcgttgtccggcggccacgggaattccggccggcgggacgacgagcctcgctgaatgaatcaatttctgaaattatgatggatttgattgtgatcttcttcgtatataaatatatgtattattgtgtgtgggtgggtgagtttgtattttgtctctgtgactttgttgttgtgtgtggactactgtggacaaggagaaggattgaagattcttagtgaaatttttagggttagttttttttttatttttaatttttggtagtatttcgagtggacaagtccatgaattaaggaattcaattggattattagggttttccttgtttggaaaactgattaggttacttgttaggagatgatgatgaatttgtttagaacattgctggaggagagacaacagagagtatgatgatgagatgaataaccagggattgaggcttggaagtgggtttcaggacctcgatccattgatcggtatgcagatgcagatgcaaatgcaaatgcagacgcagatgcaagtgtaatgaaatgaaaaattaatttaatgatgttattgtggaaaatatcacaccagagtccaaggcgaatgaattcaaggttaagcttcttcttgtttcttctgtctcgctttcactgtgggttttgatcaacttgacttactttctttcactttcctaatttgctcattaaaagtgattagtgttcatagtcttagtttgagtgattgtgtgtttgacaatcaagcgtcactcccattttcttggagtaaacttctttccaatgtttattgagaattcatgttattgcgcatcattgaaggattgtggtccttctaattatgcattctaccttgcttagttgctctctccttcactttcggggatgcctaacagcctgcttctgcaatgtaagacctctgtttctagatttttatctgaaattctcagccatttcttagattcgtcagcgtgacaataatgtcttttctagtatgtaactggatttccgtggggtgttagtgaagtgaataaagacccatctgctcatttctctctaaaaaaaaaaaaaaaaagggcggccgc

SEQ ID NO: 1342 - DNA, 421 bp, Glycine max
gggtcgagctctactctattgttatcagcgtcttttcacagaaccacatcgtcttcttatggtctcgcgccgtaataataagactaacacatgtccaactatgctggaaccgctaacgccgtccttgctaacgacgtcaacaacatcacaatcgttgagtaccagcagcgaaccaccaccaccaccaccgccgacgccgtcgccctcgccgtcaagaaaccgccttccaaggaccgtcacagcaaggtcgacggccgcgggcgccgcattcgcatgccgatcatctgcgccgcccgcgtcttccagctcacgcgcgagctcggccacaagtccgacggccagaccatcgagtggctcctccgacaggcggaaccctccatcatcgacgctaccggctccgggaccactccggcgagcttct

SEQ ID NO: 1343 - DNA, 1219 bp, Zea mays
gctgggggtgtggttttttttttacaaaaaaaaagaagccgcttttataaatggctccacaccggaggggccaaggactggcgcggccctatccctatccggctatccccatcggcttcctccccacaagtcgtgtccaccaccatcccccgcgcggcccgcgcgccccgagacagtgcgtggccatggcctctcgcgacggcgccaccttccaagtgtaccgggccatgcccgcgccgacgccgatgtctctggcgtccgccgctccagccgcagccgccgccgacgccgcggcgccgaagaaggcgggcgcgggcgcgggaaaggaccggcacagcaaggtgaacgggcgcgggcggcgcgtgcggatgccgatcgtgtgcgcggcgcgcgtgttccagctgacccgcgagctggggctcaagtcggacgggcagaccatcgagtggctgctccggcaggccgagccctcgatcctggcggccacggggtccggcaccacccccgccgtcttctcctgctcctccgcaccgtccacctccgcggccagcgccggtgccggcgccggcgccggtgtctccctcccgctcctcgggaagcgcccgcgcgaggagcacgagccggcggtggcggtggcagtggcgccggcgccgttctgggccaccctgcaggcgcggcccgtggcggcggcgtgggggctctcgccggcgcaggaggcggcggcgcaggcgtacgcgtcggtggcggcgcagggacaccacctcaacctgctctccgtgctctccggcgccgcgaggcagtcggaggaggagtcccggtgactgcctgcatgccgccgccgccgcactgttgctacgtaatcgcatgcgtcgacgcgtggtggcatgccgcgcgcatgcgtctcgtttccgtgcatctccggggggtgcgttgcgcgtgttttccctgtggttttgcggtgtgagaggaacgcggcgagctggacaaggaggatccagagcgcgagatcggatcggggttagcggctgtagatagcattcgtcaggttcgtgtttgtgataatgagctcgccgtagcgcgcgcggtggttatgtggtgtggttatgtatgcatgcatgcatgccgaattgtcaactgatctgaatcctaacactaaataatgcattgcacgtcccggtgtgtgcaattccgcaaaaaaaaaaaaaaaaagggcggccgc

SEQ ID NO: 1344 - DNA, 544 bp, Glycine max
aaacaagttaaggatgacagtaaaactctacttcaaactggaatttctcatcataacgagttggatgctttgggtttcaccctggagcctaattcttcacaaagcctaccgattgtatgtgcttcacattctcctcgtcctaaagctgacataactgagcctgtaataaggtatccctccagtccagctgtaattcatcagaggattcaaggcaactctgacatgttacctgagcatcaagtaaccagtttaggtagacattttgaaagtgaccatgattcagcaccttctcctgtcaatgtgtctgttgacaaaaatatgaaagattccaaagaactggttactgttcctgaaatggatgaggaactagctatggtacctgtacaccagaagccaaagcgatctgagatcgtccagcgtcgaatacgcaggcctttttctgtagatgaagtagaagcactggttcaagcagttgaaaaactaggaactggaaggtaagatttacattagacttggtttggcttgacaattatatttaatgggt

SEQ ID NO: 1345 - DNA, 464 bp, Glycine max
accgattgtatgtgcttcacattctcctcgtcctaaagctgacataactgagcctgtaataaggtatccctccagtccagctgtaattcatcagaggattcaaggcaactctgacatgttacctgagcatcaagtaaccagtttaggtagacattttgaaagtgaccatgattcagcaccttctcctgtcaatgtgtctgttgacaaaaatatgaaagattccaaagaactggttactgttcctgaaatggatgaggaactagctatggtacctgtacaccagaagccaaagcgatctgagatcgtccagcgtcgaatacgcaggcctttttctgtagatgaagtagaagcactggttcaagcagttgaaaaactaagaactggaaggataaatggaaaacactggtgcacacggcaagaatatcccctcagcataggaggggtgaacctgttccccaagaact

SEQ ID NO: 1346 - DNA, 2804 bp, Glycine max
  misc_feature (7)..(7): n is a, c, g, or t
  misc_feature (33)..(33): n is a, c, g, or t
aaaagcnggagctccaccgcggtggcggccgcnctagacccagcggccgcgaaaaaaaaaagaaaaaagaaaatgaaaacgaaaacttcacgttcctgaaagagagagagagagaaagttaaggacttaaatggtttgtttcagttcgtgaattccattagatctcttgcatttgtaaacagttttgcggggtttttgctttgtacgcaacaagttgtacttttttttcctgtgtcggaaaatgagtttcatcggaaacttcgttacttgatcgaagtttggttcatcggatcgagttcgaatgctgttttttcaggagtgacaaaagaatctggtgtatttatgcttctggttattggatgagctgtatatgttttaactatggtgttgaagaagagagtagatcatggatttgatggcttacgagttcctgttatacctaaagctcctagatctgcaagaaggaggattgctttcaaaaaagcagttgaagatggtcaagtttgtgctattgaactactggcatctttagctggtcagttgttgcaggagagtgaaggttctgcttccagcaatgcatctgaaggaaatcatcatcccccctttagccaaggtgtcattgagcaagatatacaagatggagttaaaccattaaagaaggaggaaattcatcagggaagttgtgtagagagtacttttaagaccgaggtagcctcacaaaaagtagtttcagacctctttcacataccaagactggacatgtttcagttaataatagttctgactgttgtgagaaagctgaagctgatgtgaagtctgaaattttcgaatgggataataaatttgggaattattctaatagattagtagaaacacgtgaaaaatttagggtgtccactcatggtaacataaagaatggatttaaatgggaacaggaggctggaagttcatgcattcggggatcaaatttagctgataagtgtagtttggaggatcacttagaattgtatgtatctcctgcactaattgactcgaaaagtaatattaaatctccatttcataggaaattttttcccagtgcttccttttccaggtatgggaatggcattaagttaggttttagagatgatgacgaaaactttttaaggtgcaaaaagttttgcacgaagccaaaggcttttaggtctccacgacgcattgcacaccgaagaatcaggaatttgatgtcttccaaatactggaagacagctccaaagttgaaggactctgaactttctagatctgatctaggagtacctcgttatcataagaggaagacttgttacggttttgaaagatctcagcacaatgccattgttaaaaagaggaaattcgttgaccgggtttcaggagtaacttctgatggaggattcagtagtgagagtgtgtccaattcaccacagaaagggatggatggagacaagcctagctcatctgcaaaattgcatgtacctaaggctaaggattctcatgtaaagtttagcataaagtcaataaggattccagagctttatattgaggttcctgaaacttcaactgttggttcactaaagaggactatcgtggaggcagtgatggctatacttggaggtggtgcacatgttggtgttcttcttcaggggaaaaaagttagagatgacaatagaacacttgtgcagactggtatatcttgcaatgaaaatttggataccctgagtttcatgttggagcccacttcactacaagcttctccaactgtttgtgttggtgatccttcttctcaatgtgaaacatcccagcctaccaggtccacagaaattcctgtcttagattcaggaattactgataccttgcacgactcacccttgctgacatatccgggcaacctaattgaaagtaaccatgagtctacttcttcacttgcggacactacacttgacaaactaacacctgattccagagcgatagttgttgttccagctaccacagaaacattagctgtggttcctgtgagtcagaaaaccaagcgctctgagtttgtacagcgtcgaaccaggagaccattctctgtgactgaggtagaagcacttgttcatgcagttgaggaactcggaactgggaggtggcgtgatgttaagttgcgagcttttgagaatgcagaccataggacttatgtagacttaaaggataaatggaaaacattagtgcacaccgcaacaatctcccctcaacaaaggaggggagagccagtacctcaggagctcttggacagggttttggctgctcatgctttctggtctcagcaccaagccaagcaacatggcaagcatcaagctggaccaggaaccttgaagattacagaagcctcagctgaaagaccttgtgtgtgttgaaggtgagaaggtgtccacttgtgatatgatgatggtgtagaaaggagtggtggtgttgacaggaaaagaggaagacaaaaacttgtacattttgatttgattcaatttcatgtaatattctcacaccaaattctttgccggccattaattgcatgcagggttggcatttgtaaatgatttgatgcaataagattgttctaacaggaacttatgatgttctttgatttttttttcttgatttcttttgcatttatgaatgtttgtagaaatgtaaaaagaacatagaacatgacgacccaaaggaaaaggtgaaaatgttcttgttattatctttcatttcatttatggaaattattgttcccacttgtttgatacttcacttcctgtttgctg

SEQ ID NO: 1347 - DNA, 2046 bp, Glycine max
  misc_feature (1566)..(1567): n is a, c, g, or t
gcggccgcccttttttttttttttttaaaagaaagtaaaatttcttatctcaactactttaagtatgccaatatgtgtattactattattcatttaatattatcatttagacttatacagcgattagctcttttttattcatggataagctctagctacactcattaacattattagctcctgtgggtccataattcaatttgcagataaacttctatcatcaacacgtgcatccacgtgcccctccactccagttacacaccgaaccttgactttggagtgaaaacctatgacgcaaattctctataggcatcaccttgttctaattttacatgatagataaagtgtgacattgtactaaaaatcaaagtgataaacacactttgtcataaatacaggaagaagaaaaaatgataaatgacacttttaacaaaggcacgtggtggtgtcaagtccttattaaaggagaaggcaaggttttgtagagtggtgcttgagctgttgcttagtctgctgctgggaccaatatgcgtgggcagttaggaccctgtccaaaagttcttggggaacaggctctcccctcctttgctgagctgatattcttgctgtgtgcaccagtgttttccatttatcctgcacttcaaatccacgtatgtccgatgctttgcattgtcaaatgcacgaagtttaacatcgcgccaccttccagttccaagtttctcaactgcttgaaccaatgcttccacttcagcaacagaaaagggcctacgaattcggcgtggtgcgatctcagttcgctttgacttctgatgcacaggtagtacagctagtgcctccatacccatttcaggaacagtaataagttcttttgaatctgtcaaatttttttcacctgatgtgttgattggagaaggtgctgaatcatgatcactttcaacaaggttacctgaactggttgcttgatgcttggctaacatgttagaaaagccctgaatcctctgatgaattacagcaggacttgaagggtaccctattaaaggctgaggcatatctgcactaggaatgtggagagaatctgttgtagcacatgcagatggtcggtttcgtgaacaattaggctccaaggcgaagcccaaagcatccaggtggttatcatgagaaattccagtctgaagtagagttttactgtcatctctaaccttctttccatggagaatcacacccacacgcaatccgcctccaagtacagcagtcactgcctccatcactgtcctcttcaaggacccaacggttgcagtttctggaatctcgataaaaagctcgggcactctaaatgatttgatcctaagcttcactggataaaagaaagacatctccatgtaagaacccctttgaagacctcgggccgatctcagagtacataaagaatcattccctcaatcttcccataccgtaagaatctctagatcgtaatgcagagtgtcccaaggatgatgttccatgatcttggctcattccagaagatgaacaagaaacactttggttcgtgtcattcttgggtgaatnngcgaagtgtcatcacttctgatatatccgttagagtttgcaccagagcggcagttaaaaagcttcctctttttgaaaggaatattcatctgagaactttggtgtttattgcagttcctcttgctgaggtaagttcgcttccaatctccatcattgttagaaagtgcataattctttgttttttcagcaactttctgaaagttagaagccattcttttacctatacaagtctttggcctaaaggacttggtttcagtatttatagggtgagtacacccagaagagttttcatcatcatctctactaactactggtacattgtcacgacttttggacaacaagctacagggaatcctatcattatacccagacaatttggcattgccacctaaactgatcaatgcaggaggatttacatccaaagggtcctcaaaattacacatgtcaatcccactaccaattggcacccggacgcgtggg

SEQ ID NO: 1348 - DNA, 519 bp, Glycine max
ggctcgaggttcattacacttgatagtaacatatttgctctgtataccttgtgaacagtaaagtttagcataaagtcaataaggattccagagctttatattgaggttcctgaaacttcaactgttggttcactaaagaggactatcgtggaggcagtgatggctatacttggaggtggtgcacatgttggtgttcttcttcaggggaaaaaagttagagatgacaatagaacacttgtgcagactggtatatcttgcaatgaaaatttggataccctgagtttcatgttggagcccacttcactacaagcttctccaactgtttgtgttggtgatccttcttctcaatgtgaaacatcccagcctaccaggtgagccaaattttacgacgatttctttttatcaccacagctgatttatgaagggaaatggccaaggttaatttatggggtagaaataatgattcagttctattcagccgaatttttattgtgatactattgctaatgtcattatttg

SEQ ID NO: 1349 - DNA, 730 bp, Glycine max
cggacgcgtgggcggacgcgtgggtggaacctttggatacatggctcctgaatacttcatgtatggcaaagtaaatgacaagattgatgtctatgcattcggtgtaatgcttattgagcttttttcatggagaaagcccatatgtggtgattatcccaaaggtcaagagagccttgtcatgtggtcaagtccaattctaaatagcggaaaggtgttagtcactaaagaggactatcgtggaggcagtgatggctatacttggaggtggtgcacatgttggtgttcttcttcaggggaaaaaagttatagatgacaatagaacacttgtgcagactggtatatcttgcaatgaaaatatggataccctgagtttcatgttggagcccacttcactacaagcttctccaactgtttgtgttggtgatccttcttctcaatgtgaaacatcccatcctaccaggtccacagaaatttctgtcttagattcatgaattactgataccttgcacgactcacccttgctgacatatccgggcaacctaatggaaaagaaagttgatcctacttcttcaattggggaaactacttttgaaattctaacaacctgattacagactgaagatgtggcttcagctaccacaaaaacataagctgggggtcctggggagtaaaaaaaaccaagcccttctgagttttttaaagcgtcaaaacctggaaaacaatttttttg

SEQ ID NO: 1350 - DNA, 588 bp, Zea mays
tgttcattaaggtcccagaaaatgcaaccattggatcactgaaggtaaacactagatgggcatacagaagttattgctaagcaatcgtgcattcatttggcatcccaatattctttttggtgatgttgttgttaatttactatacagtgtaattgatgaaatctgcaaggttgcaagagcgcacttgagttcatagatttatctttttcattccacagttggtacgctggattcagttgactgtcatgttagatttctgcatttgaggtttattgcaatgtggaataatgagtcttcacaatagttttactggtatacagagcaaataaataatttttttagtaacagtttgtagttcgtctatgcctacagagagctgttatggatgttgtcaatagtataatggaaggcggcctacgcgttggtgttcttcttcaaggaaaagatatccaagacgacaacaagacactttgtcaggctgggatatgccacgataaaaagctaaataacatagacttcacgctggagtgcgagcgtgagcgcgagcctccctctggagtcattgtacaagaacagatggatttcctc

SEQ ID NO: 1351 - DNA, 479 bp, Zea mays
aaaaaaaaggggggggggttggcaaaaccacacaaactaatggggttccttgggaccccccttttaacctggttttttataacccacagttttaacaaaagaacaagttttccttggaaaaaaaaatctaagaaaaaggaagagccgggggggggggtttgcccaaaaccctcccctggtgttggtgggggaaccagaaggcctgccctagaagaacccggtttaaaattttttggggaaccgggtgccctttcggtgggggggggaatatgctcgcagggaaaaccagggttttccatttgtccttggggccaacggaggcccggggatttatttgggcgagggcgagggtttaaaagggtttcccctttccagcccaaaggtggtggaccgttcccaccagcgcttaaacctcgcggaaggggaaggcgctcctaaggcgccttggcccggtttaaaacccttgggatttacaaggg

SEQ ID NO: 1352 - DNA, 2526 bp, Zea mays
ggatcctaaggcgaagtctgaggtccaggacaaggaatcctccatgatcagctatacgaaggctgaattgggttgtaattttggtgtgatcgcagacaggtggtcgcctgaatccgtggaatcaggagccttcacaggagatgcagtggcgagactgatgatgacggccccggcaggatttcataagaatgcacccgaaatgtatagtttgcttgattcaatggatgtggatgtcaagccgcctcctttggtcagctctgacagcaccggcgagatgccattgcatggcgataaaattcaccgctcaacctccttaccgaggggcccaaagggggtggggttttttgctgtagatagagatgatgacgacgacaagtcctcagggtgcactcatccgagcaccgccactaacaaggatttcacatccaattgtaaagctgagtataatagggtaaggaagctgctcactagtaagcacaggaaagttgctccagcgaggattcacaaatctgatctttcctatagtgatgtcgagcggaagccttctttccggtacaaaaaaatgcatacacgacagaggacacaaaggagtacattcaagcggaggaagctctttgatcgccatttagctctagcatctgaatttggtacagcaaatggaaagggaaacacaaaggttgccggaagaaactccaatgctgtgtctttggaagcaaacaaggggactaattcaatgccattccagaaatcttgtgggtcaaatgattgccatgtgaaacttagaattaagtcttttaacgtgcctgaacttcttgttgaaatcccagacagtgcaactgttggctcactaaagaaaactgttctcgaggcagtgactgcgattcttggaggtggcctacgtgttggtgttcttcaccatggaaagaaagtcagagatgatagtaaaacgttaattcaggctgggattggtcaggatgatatgctggacaaccttggcttttcacttgaacccaactgtactcaaaacccacaagtccaagctcctgaagatgtcagtttcctcgaaaacattgatactaccgaacccctcgcaaggatcacacctgctgactcgtcttctaagcttggtgaagttgacgtatcacaggagcttgcattaaccccattagcaatgaactaccagggcagtgatcatgattccgtgcactcccctggggctgtctcgtcgcgcgataaagactcgcgagccttatttctggttccagctgcagatcccaatgcaggagctgtagttccagcaaataagactaagaggtcaccagagcagggacaccgcagaatcaggcggccgttctctgttgctgaagtagaagcacttgtgctcgcagtcgaaaagcttggaaccggaaggtggcgagatgttaaacttcgcgcttttgacaatgcaaagcaccgtacctacgttgaccttaaggacaaatggaagacgctggtacacacagcgagcatctcgccgcagcagcggcgtggcgagccggtgcctcaggagctgctcgaccgggtcctggcggcccaggcctactggtcccagcagcaagccaagctccagccgaagacgccctcgctggctgaggctcgcttgctcacccaataattcgatgatcccggctgatggcctcctctgaggccgttgcagcctttgtataaagtcagtaagtcagtcagtcccttcacaggaggtttaatgaaaatataatattaggggaaaaaaagaatgcatatataaggtacaagaagcattgaccgatttgttgtaatatctactcaccaccggttattctttaagccaggattctctctccttgtgaatttaaccaaaggaaagggcatttctttggcaattgtacattttgatgatggaagaagaagatgatccatgaactgagatctgcagtgtctacctactaatggctcacaatttttgcaattgtgattaagaaattcaaggtgctgcttgaccaagctcggctccggcttccagtttttggattctcttgtgaagaagttgctgcctcttttttatacagcagaagctgagagccgaacagtgtatttggcttgaattgcagcctatatagtttcatccactcatacagacggccacaaatgccgtaaaaggagggtagcttcttttgctgagtctagtcttgggagcaaagctcaggaccgaagtctagacttgagacggagcgggggccaaagcggcacccgaatgaaagcttcagattcttttgttcagttaaattcattctttggtagtggagactgacggaaggataggagattaggtggggtggatctttggttctctttttctcttttcttcttctattattacattattagttgtattaatgtactatattattttaccaatcttgtagttaccctcaaatttgtaattggtgaaattaacaaaattgaaggagatacatttctaccacttcgctaaaaaaaaaaaaaaaa

SEQ ID NO: 1353 - DNA, 1528 bp, Glycine max
ccacgcgtccgggaatctctctctctctctctctttctttccctttttcactttctcattcattcttattagtatttctatttcacttcaccaacccactccaccgtttcccctttccttccatgctattatggcttcatcttccatcaaacacactcaccaccttaaccgcacaaaactcttcatgaaagaagaaacccttttgaaaaagaagcatcactatcccaaaatcatacgaatacgtgtcaccgacgccgacgctaccgactcctccagcgacgacgacgagccctccatgtcctccacgcgccgcagagtaaaaaacttcgtcaacgaaattaccatccaaggcggcggcggtggtggtggcgacgttaacgttgtttctaagaaaagaagattcaagtccggtgccggagctccgttatgtcggcggaagacgggggcgaaagaagttccgggggagtgaggcagcggccatgggggaagtgggcggcggagataagagacccgtcgcgccgcgtccggctgtgggctgggaacctacgacaccgccgaggaagctgccattgtgtacgacaacgcggccattcagctgcgtggcgccgacgcgctcaccaatttcataacgccgccgccggagaacagaaaaaccggttactgctccggcgaggagtctcgcaacaacgacgacttgcgttcccccacttcggttcttgggcgctgttcggtgtccgaggaagctgtaactgcaaacgacgtatttggaggctctagtgagtgcgagtattcatgcgtttcggagtcagtgtttcctattcctaacgaggtggtgtttgactttgaaagcacgttagatatgtttgatgaagggattaataatgttgtggcagagactagtatattcttggcggaggatttagatttgggttttacgagttggcatagagagtgtgataatttccaagacattgggggggatttgtttgtttgggatcctcttgtcgctctttgattgagacacagacaccattctctcgtctttgtaattctattgccaacgaaaatgggttgctatcagttttgtttcttttgggggtttaggcaaaaaccttgtgtctaaggagaggttttctaattttttattctagcagtatatgtttattaaccactagttgtaaaaccgtgcttcccacggtgttgccgtctttttgtttcttatataaaattatgtctcataaaaaaacccacgcgtccgtggttctatttgtttgatggccatcttgcacgtcctgatcttattgtgttcaagtgacagacaaatcagaacagggaagagagatttgaaatgtaaatgccaagtgaaagtgaaaagtacagtccagttttagtgatctctttaatttatttgttcatagattaatatgatggtgtatgattgcttttctatttattgtggcatttttgtgttgtaccctgttgttgtgtttgcaataagtattagtaataaagcagcaaattcaatttc

SEQ ID NO: 1354 - DNA, 2226 bp, Glycine max
ctgaactcttgttcttctttaccgattcaacaacagctcagcagtggtagtacccatgagcctgcagaatctgcactttttttgccttggcttctattctctcctcactttgaatcggaagatatcctttccattcaaggcagcaagcagaagtttcaacgaaagtctcctctcccacacagctactatcttctcaacactattggaatcaccatcatctgaataattcccttttttctttctctttctctcacacacccccatgatgtcaaaagttgttattttctctttattcctatcatcagtcccgaccatgtcttaatatttctttctttcttctttttcaaccttttggaagatttcggtttaaccttccccttcacgattctctctccctctctccctcttattcccaaaccaagcccctatttgtgttcatttcgcgtcacattagaataagaaacgcaatatggaagacagtatcctatgcaaacacacagtgcatcacaccgttaccaagaaactcatctcccccaaaaaatcatcccaaaccaattcgacgacagagcgcagaatagtgcggatttcatacactgatccagacgcaaccgactcctccagcgacgaggaaggtttccccttcgttcgccaaagaatgaagcgctatgttaaccagattgaaatagaaaccgccgccgccgaaaaagttgttcggaaaaggcccgccggtgaggcttgccgccggccggcgaagcttcactccgggaagaagttccgcggcgtccggcagcgaccgtgggggaaatgggcggcggagattcgggatccggcgagaagagtgcgtctctggttgggaacctacgacaccgccgaagaagctgccatggtctacgacaatgccgctattcgtcttcgtggccctgacgcgttaacaaacttcgtaacgccgcctcaaagagattctccgtctccgtctccaccgccggcggcggcggagactccggcggaggtttgcgagatgaaggttgtggtcaccgaagaagcctccggctccggctacgactccagcgaggatcattgccaccacaacctctcctctccgacttcggttctccagttccgaagcaactcgagcgaagaaaattccgagtctcagcagaaagcagaacaagtgttgagagaatgcgagggtgagacagaaacgagtttgttcgaggaaacgggtgagtttttggcgctggataacatgcctttgcctgcctgggatgacgtgttcaatttcgaaacgccagagtaccctcctcttctgtttcaagaggaggagaatctgaatctacttcatcagtcccagatgttgggcgaaacggtgcagttttcctcggaggaagggttcagtgatgaaagcagtatcatgctggccgactcgctcatagatttcgacagagcctgcccttcaccatcctccttgtgccaagtggacgatttcttccaagacattttgtttgcttctgatcctctcgttctgctctgaacactcttaaaacttactaaactgtcattcgttaatcgtcaatcgtccacttcacggcttgcccaatattcatggcagatttttgcttccggtggtaaaaaaaaaatgcctagtttctatttaattaaaatactatatatatatatatatatatatatatatatatatatatatatatatagttttatttgcgtatttatttagatgttttagatgctccgttacaaatagctaacggggggatgagttgagaacttgtgagcgaagttttgtttagtttttggttatatttgtaatctttttgcttaataagtaggatcgtacgttgagacttgagaatgtaatgtatatttgtccagatgttaatctaagtgtaatggcgttcttttctttacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1355 - DNA, 1184 bp, Glycine max
cgtacgcgcggtttttatccagacgccaccgactcctcctttgacgaggaaggtttccccttggttcgcaaaagaatgaagcgctatgttaaccagattgaaatagaaaccgccgcggaaaaagttgttcggaagaggcccgccggtgagccttgcaggcgaccggcgaagcttcactccgggaagaagttccgcggcgtccggcagcggccgtgggggaaatgggcggcggagattcgagatccggcgagaagagtgcgtctctggctgggaacctacgacactgccgaagaagctgccatggtctacgacaatgccgctattcggcttcgaggccctgacgcgttgacaaacttcctaacgccaccgcaaagagagtctccgtctcaggcgacaacggtggcggtgaccgaaagaagcctccggctccggctacgactccggcgacgaccattgccagcacaacctctcatctcccacttccgtgctccacttccgaagcaactcggagtctgatcagaaatcagaacaagtgttgagagagtgtgagggtgagggtgagttttggccgctgggataacatgccttctgccctggcttgggatgaagtgttccaattttcgaaacgccagagtaccctccccttctcctttcaagaagggaattttcttcatgattatcagtcccagatgttgggtgaaacgggtaccgttttcctcggaccaagggttcagtgacagtagtatcgtgctcgcagactcgctcatagatttcgacaaagcttgccctccaccatctaccttgtgccaggtggacgatttcttccaagacattttgttagcttctgatcctctcgttctgctctgaacactcttagtcagtcgactcaagttagtaaactctcattcgttaatccttcacgccagattttgcttccggtggtaaaacaaaataatgcttagtttctattaattaataaataaatttttaagtttttagatgctccgttacaaatagctaacggggggatgagttgagaacctgagagtgaagttttgtttaaattttactttattgtttgtaatcttttgcttaataagtaggatcgtacgttgagacttgagaatgttaatgtatatttgtccagatgttaatctaagtgtaatggagttcttttctttaaa

SEQ ID NO: 1356 - DNA, 1335 bp, Glycine max
  misc_feature (1305)..(1306): n is a, c, g, or t
gaacatctctgtctctctctcttccttaccccttgcaataaccaccctaaaccctcccatcttctcacacctagcaaattactgccatcaacttattttccttcatcacccaccactctctatttctcacttgcttcatgcaattaaaactaccactaccacctttttccatttccttactcttttcttcaataaaatgagtgacacacaccaaactttcatgtccgtacaaccacccctgaatctccaccacccctttaacccacaagcctcaagctcaaattttgacggcgacccaccatgcaaaaccgccgcaaaaaccaaacctccgcgcaagaagctactccgggtaattctcaccgaccatgacgccaccgattctgactcctccggtgacgacgacgacccaaaaaacccaccgaaacacaaaaaggtgaaaagacaaatcacccacatcaccataaaccttccctctttctcagaagccccaactccagcaccaataccaacaccttcttcgtcttcttctattgatccgacccgtttaaccctacccaagaaacgacccgccgtgcctcgccgccgtagcaagttccgcggggtccggcagcggccatggggacggtggaccgcagaaatccgtgacccgaatcagagaaaacgggtctggctcggaacgttcgacacggcggaggaagccgccgccgtgtacgacgacgccgccttgaagctcaagggccccaacgccgtcactaacttccccctctccgccgccggaaaaacggaacatgataccgcgccgccggaggcggctttctccggcgaaggtttttcatctcccacttccgttctcacttactttgacggagactcgacgccactttacggtttccgttacggcgaggtcgacgcgttcgggtttgacatcgatgcgccgtttagtttgacagacgttaacttaggggtgctgagtcagcggttcgggaaggaagatttccgcgaggttgacccggacgagctcttgacgtggccgagttaaggggcgtatttatcatttcgaaaaaaatacagggaatgtttagtaattctaatgaagtttttttgtcgtattctgcattgaattccgaaactaccctcgtgactaagtttttgtgcagcttagtagagtgttagagagcaatagagtgatccaagtagtagtagagaattttgtcctatgttaatttgtgtaattaattgtattgttatggagaaagaggatatgatggaaagtattagaatgattctcttgtagtttcttatatnnttttataaagtaaagtattagaattaatt

SEQ ID NO: 1357 - DNA, 587 bp, Glycine max
ctctctctcatcctttttccctttttcctctctcacccactccctcactccaccgttttccctactactcctttcaacgtcaatgctacccccaataatctaacaacatgactgcgccaccatccaagtacactcaccactccaaactactcattccctccgaagaagaccctcccaaacacccctatcccagactcgtcagaataaccgtcacagacaccgaggccacagactcctccagcgacgaagaacagcatacttccacgcgccaccgacacagaaagttcgtcaacgagatttctatcgagtcgtcgtgcgccagcgagaacgacggcgccgcttcgaggaagagaattcgaagaagaagcaccgctacgcccaaaggcagagcttcagacactcggctcgtgtccaacggcaagaaattccgcggagtgagacagcggccttggggaaaatgggcggcggagatacgagacccgtctcgacgcgttcggttatggttgggtacctacgacactgctgaggaagctgctttggtgtacgacaacgcggccattaggctgcgtggaccccacgcgctcaca

SEQ ID NO: 1358 - DNA, 1813 bp, Glycine max
cccacgcgtccgctctacctcccactctcacaatccctctctctctttctatcttcactccggctattacttattagcataactctcttttgctctgccttcccgccaaaacccttctctgtgatcaccaaggattcaaggttgagcgttgaattcttgaaccttgttgttgttgttgttgttgatgtgagtggagtgagatttcacttgaagcgcatccaaagttggccatattctcttctctctttctctctctctcttggaatatatctctagagacgaaaagcaaaagttgttacccataaaacatcttggtttttctttctgcttcaccaccaccaaaagtgtttccaaacgtctcaattcccccccagcatatacatctacttgtccacttttcccccataccctctaaattcttctcttactctttaaaccccacccttcatgcactccagccaacaccatcacacaacaaccttccctcttccctctctcactcaaacaaaaacatccttaaccactccaaaaacactcttttaggcatgtccgtacacgcaaaactgaagcaccaccccatgaacctagcatccccaagttcccattttgaggacgacccaccatgcaaaaccaagaccaaaacccaaaggaggctccttcggatcataatcaccgaccatgacgccaccgattctgactcctccgacgaagaacaacagcagcagcaacaaaaaacaagaagagtgaacagagaaatcacccaaatcaacatgcaacttcctctatcacataatagttccttttccccttcatcttcttattactcttcagcttccacctcatcggaacaaaacctaaagtgcaagagacccaacaaaaagccgccaccttcctccgccgaggcccgccgccgcaacaagttccgcggcgtccggcagcggccgtgggggcggtgggcggccgagatccgcgaccccacccgccggaaacgcctctggctcggaaccttcgacacggcggaggaagccgccacggagtacgacagagccgccgtcaaactcaagggccccaacgccgtcaccaacttccccctcgcgccggaggctacggcgcagtctccaccgctcgccgcggacaacctcagctccgacggcggcgcgtcgtactcggacctagtggcctcgccgacgtccgtcttggcctacgagtgcgactcgacgccgttcgacggtttccgttatctcgacgttgacgcgttcgggttccacatcgacgcgccgttaagtttgccggaagttaacgttaacgttgcgctgacgtgtcatcacgggaagaagcaggaggaggcgtttgatgaattcgatctggacgagttcatgacgtggccttactagtgataaaaatctcagggacagtttggtaaattacaccctgtttgcattgcggaagtgtgagttggaaatcccgaaattgcccccctccccctctcgttgtccaagtttgaaattttgtcgtactcgttggagctttggaagagtgtagagttgttggtacaaaattttatgtagtcgcattttactaccacctgaaacggcgattctttgtgtcgtatttggtagagtttaatttgtagttattatcatgaaaagaagaaaaaaaaaatgaagtgtcaaaactagtgagtgagaaaaggagaaaaggaaagatggtgttatttgagaaggaaggactatattgtaatttcggtatataaattttgataattatttaaagaaactttggtattgtctatatatagatcatgggttaactt

SEQ ID NO: 1359 - DNA, 1238 bp, Oryza sativa
tttttgggtgtactgcaataatttgctactatattttattctaatcgaagaacatgtctatatctcacatcaaaggtcttatttagatgcaacatactaattccacaacaccttatcgaagcctaccatactgcatcacatatatcagcaaccataccgtatatacacatcataaccttaccaaatcaggtcacatgcagagtcatcttcacatcataagttcaatactaaccaaaattacacaataccaagtttccaatgatgctatgcataacaataaagctgctaacgatagtaattacggataattggaccctcaggccccgccaacttcttccacacaggcggacacagcatggaaggcacggacacgggttccacagcccgatcgcttcttacgcttgcctgaaatcatcgtccacattggctccggagcaagcacctggacctcacagctactggcctcctccttgacccgaccgccacagctctcaccttcctccttcacccgtggaagaagggtcggcttagctgtcccaattggcaaggtgattggcctcacagctgcttcaggcggtgaaatagttggcttgggtagctccagcggcagcgagtagcagcggacggaggcgaagttggtggcggcgctggaaccgcggaggcggacgctggcggcgtcgtatgcggcggcggcctcctcagcggtgtcgaaggtgccgagccacaggcggcggcggaggtgagggtcgcggatctccgccgcgaacctcccccacggccgctgccgcacgccgcggaaccgcgcggtcggcctcgcctcccccgcccccgcctccatcacgcggcgcttcacgcccccaccaccaccaccaccaccacccaccttacccctccgccgcggccgaggctgcgccaccgcaaccgcctcgtcctcgctggaggacgagtcggtggcgtcggcgtcgcgcacgaggatacgcaccacgcgtccccgcggcgccgcccccgccgccagctcgtgcaggctagggtttgtacccatgcctcgggaaacccacctcaatccatacagggtgttcgatcgatgtggctacgcgtagcctccgcgccccgccatgggagcgtggggggtggaaggcgaggtgggggggctagggtttagggttagggtttggttccgatcgatgcggcggcgtgcggcggggtgggggtgccacgggggcccgctagtttagagc

SEQ ID NO: 1360 - protein, 299 aa, Oryza sativa
MSRSRTVRIFWDDPDLTDSSGEDEGCGGRRVGSMVRELPPAQMPVAQAGFAPAAAAAAAALPEQCSGGDGDMGRRVVGGGCTVGVGRRRLTKDGGPGAPSTKFRGVRRRPWGKFAAEIRDPWRGVRVWLGTFDTAEEAARVYDNAAIQLRGPSATTNFSASTNSAGAQDPVAVGYESGAESSPAVSSPTSVLRKVPSLCSLAEDKDDYEAGPCEPATAAGSNLTVLEEEELGEFVPFEDAPVYGGSSFWDFEPESGFLYAEPSSPETPWDAGATSSGEAQDYFQDLRDLFPLNPLPAIF

SEQ ID NO: 1361 - protein, 373 aa, Oryza sativa
MEEGFVALKRTEHVEVTSLAVAVEATPSAKGGKGKVVVGGGGAGGGVGPTRVRVFCDDFDATDSSSDEDEEEVTARRRVKRYVQEIRLQRAAAVAVPPVKVKGEEVFPAAVSAKMAEAAKARVVLAAGRKRKAGGVDGAEPRFRGVRRRPWGKYAAEIRDPWRRVRVWLGTFDTAEEAAKVYDTAAIQLRGRDATTNFNQSGDSASLDVPPEVAERVPQPPGASKNASPATSYDSGEESHAAAASPTSVLRSFPPSAVVATADTANKKQPPPPPLVVRETDESVDVFGCSFSDDGGFAGELPPLYTDFDLLADFPEPPLDFLSNLPVEPFSLAPFSSNNGSPDLHLDDAPSPAAAQVDDFFQDITDLFQIPVV

SEQ ID NO: 1362 - DNA, 1232 bp, Zea mays
ctcgtctgtctctccttgcctgtgcgcttcggttattagctagctagcttgggtctagtctagtgtaactcccggccgccatctttgctgtacttcgttcgtccatgtcgcgctcgcgcacggtgcggatcttctgggacgatcctgacctgaccgattcctccggcgacgacgagggctgcggagcccggagggtcggcagaatggtgagggagctggcaccagcaccagcaccggcaccagcggctcttcccgtgccggatcagtgcaacgccggggacggcgaccgcgggaggaaggccggcgtcgctggtcccggcgtgtgcagcggggcgcggagacgggtggccaagggcgccggtggcccggcgagcaccaagttccgcggcgtgcggaggaggccgtggggcaagttcgcggcggagatccgcgacccgtggcgcggcgtgcgcgtctggctcggcaccttcgacaccgcggaggaggccgcgcgcgtctacgacaccgccgccgtccagctccgcggggccaacgccaccaccaacttcgccgcgtccgccgccactaacagcggctccggggccggggccgggcaggacccggcgacgacaccggcagcgggctacgagtccggcgcggagtcgtcgccgacgtccgtgctccgcaaggtcccctccctgtcctccctcgccgaggacgactccgacgcgccggccgccgagcgccgcagcctggccgtcctcgaggaggaggagctgggcgagttcgtgccgttcgaggacgcgcccgtctacgccaccagcggcttctgggacttcgagcccgacgcggggttcctctacgccgagccgtcgtcgccggaggcgtcgtggaatgccgccgccgccgtcgccgagcccgcctcgtctgacgacgcgcccagctgggccgcgtcgccggtgcaggagaacgactacttccaggacctgcgcgacctcttcccgctcaaccggcttcccgcgattttctgaacaggtggacggggaacgccggaaccgggaacggcgccgctggttcgtctaccgggatgttattttggacgtcgagagtgcgctgtgtctgtgtctgtgtctgtgtcgtgcctacgcgcaccgtgtacttgtacgcctttccccacgccgtttttgttactatcttcgagtcgatgagaaatgtggaaatatgctgccgaacgatgagcacgtagagttttg

SEQ ID NO: 1363 - DNA, 1179 bp, Zea mays
acccctcactcagcccgtccccttttcccccattgggtccccggaggccggccggggtcttcccgcttccagcgcacccccatcttgagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgtcagcgccactaccaacttccctgcggcccgctactcgccccctccaaagccagcgaagcctatcatctcgctgactcctgaacccggaaaggtgatcaccttgccaccggtacctgtgaagccaaccttccctgttcaggtgaaggaagtgggtgggagctggggcggcctggtcaagggagctaggtcggaggtcaaggcgtttgcaccgaagccagtatggaagatgatccccagggtgcaccagaagtttccgggttgtgccgatggctctggcctgcgtgccgtccatgctgcctccatctacgtggaggaggttggcggtggctgatggtccaagtatctgcaattactatcgctagaggttttattgtctatctccatggcatcattataacctggtactgtattattttggttagtgttaaactgttgatgtggaaacctatgactcttgctgtgttatgatcggtggtaatataatgtgtatatggtgacatttggtaataaaaaaaaaaaaaaaaaaaaaaaaaaaaaaaaaaaaaaagaaaaaaa

SEQ ID NO: 1364 - DNA, 1305 bp, Zea mays
  misc_feature (1300)..(1300): n is a, c, g, or t
  misc_feature (1303)..(1304): n is a, c, g, or t
ttgggtacctcgaggccggccgggctcctcagcccgttctcttttcccccaccctatcaacacaatttacccttcgtcttcccgcttccagcgcacccccatcttgagtctcgccgccgcaagcttgtgtaaggtgtaaccctaaccctaaaacacttaccttcgcctccagcaccacacttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgccagcgccactaccaacttccctgcggcccgctactcgccccctccaaagccagcgaagcctatcatctcgctgactcctgaacccggaaaggtgatcaccttgccaccggtacctgtgaagccaaccttccctgttcaggtgaaggaagtgggtgggagctggggcggcctggtcaagggagctaggtcggaggtcaaggcgtttgcaccgaagccagtatggaagatgatccccagggtgcaccagaagtttccgggttgtgccgatggctctggcctgcgtgccgtccatgctgcctccatctacgtggaggaggttggcggtggctgatggtccaagtatctgcaattactatcgctagaggttttattgtctatctccatggcatcattataacctggtactgtattattttggttagtgttaaactgttgatgtggaaacctatgactcttgctgtgttatgatcggtggtaatataatgtgtatatggtgacatttggtaatatgttcctgatctatgtgatgcaatgtgctgtgctttgattgtgggatcaaacctgtcatatagtagtacaatctagatcctttcacatgaacagtgatacctagatgtatttgatggttatttcagttgaattaaacaaaattgctcnccnnc

SEQ ID NO: 1365 - DNA, 471 bp, Glycine max
gtttgtacatcttttggtttggggcgaaagttcatccttttcatatatgcatcaatttcaacagataacaacgcgatctggtcagtcttctatgcttctgcatacactctagggtttccttttcctaactcgttcttctcttcaatatatgcgggtctatttgaaacgattgaggggggtagagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtatagtcgcggaaactcccctcgtcgaagtacaagggcgtggtgcctcagccccacggccgctggggtgcgcagatctacgagaagcaccagcgcgtgtggctggtaaccgttctctaggaagacgaggcggcactgtcgtacgacataccagcg

SEQ ID NO: 1366 - DNA, 1952 bp, Glycine max
attcggctcgccctcgacccgaatcggctcgacctctctttgctacctcttagtcaaacaaagtaacaaaccatcctcccctctcttctcttcttttgttctctagatttcttctctcttgtttcttagaatccgtacaatctaatcaacataacaaaaatggatgcaattagttgcatggatgagagcaccaccactgagtcactctctataagtctttctccgacgtcatcgtcggagaaagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtagagtcgcggaaactcccctcgtcgaagtacaagggcgtggtgccccagcccaacggccgctggggtgcgcagatttacgagaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaacgttacgttaggttttttttttctttttttttttcgggagtttttgtgactgatgaaagaaagaaggtacaagaacggcggtgtagtggcatggcaagttgctgcaaagtgcaaaaggtgaattgtatattacttaatattattagatgttgaaattaggtgtaatgtaacaaaaactgtacaagaagaagaaaaaaggttttaagaaggggagaagaaaaataaaaataaaagatatcatatgaaaactgtttaatggtatatgttgataatattgttgaatgtatgttcatggcatctgatgttgtttttttttctttttttagttgtgtgggggttgagggaagtaaacatgggtttccaaaaatatctttgttgattgttgaacgcgcacacaacaaacaatttttttggttggtgaattaaaagtagtatgatggttgaggaaactaattaattttcgtggtgtattttgggtaatcataatgaggcattttgtcaggttgtgagaattgctattataattagacaaatgttaccaagtgttttaaatatgttatttgtattttttataaaaaaaaaaaaaa

SEQ ID NO: 1367 - DNA, 1651 bp, Glycine max
attcggctcgggctcatctatctttgcttccccttagtcaaacaaagtaacacaccatccatcctctctctcttctcttcttctgttctctagtttcctgctcttgtttcttagaatccgtacggtctaatcaacacaacaaaatggatgcaattagttgcctggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggacgccgtcacaaacttcaagccgctctccggcaccgacgacgacgacggggaatcggagtttctcaactcgcattcgaaatccgagatcgtcgacatgctgcgtaagcatacgtacaatgacgagctggaacaaagcaagcgcagccgcggctttcgtacgttcgccgcggctccgccggccggcgccggaaacggaaactcaatctccggcgcgtgtgttatgaaggcgcgtgagcagctattccagaaggccgttacgccgagcgacgttgggaaactgaaccgtttggtgataccgaagcagcacgcggagaagcactttcctttacagagcgctgctaacggcgtttagcgcgacggcgaacggcggcgaagggcgttttgttgaacttcgaaagacgttggagggaaagtgtggcggtttcgttactcgtattggaacagtagccagagttacgtcttgaccaaaggttggagccggttcgttaaggagaagaatctgaaagccggtgacacggtttgttttcaacggtccactggaccggacaggcagctttacatcgattggaagacgaggaatgttgttaacgaggtcgcgttgttcggaccggttgtcgaaccgatccagatggttcggctctttggtgttaacattttgaaactacccggttcagattctatcgccaataacaataatgcaagtgggtgctgcaatggcaagagaagagaaatggaactcttttcattagagtgtagcaagaaacctaagattattggtgctttgtagcgttacgttactttttttgagttttttttttttttgagttttgtgactgatgaaagaaagaaggtacaagaagaacggcggtgtagtggcatagtggcatcgcaagttgctgcaaaaggtgaattgtatattacttaatattagatgctgaaatattaggtgtaatgtaacaaaaaactgtacaaggagaagaaaaaaggttctaagaaggggagaagctagaagaaaaaaaatgatgtcatcatgggataactgtttaattgtatatgttgataatattgttgaatgttgattattatgttcacggcaaaaaaaaaaaaaaaaaaaaaaaactcgagactagttcc

SEQ ID NO: 1368 - DNA, 1483 bp, Glycine max
ttgactcgtgggcggacgcgtgggctcaggttcctcctatatatatatatatatacatacataatatccttctccctcaaaccaaaccatacctattctcaagtttctctctgtttcttcctacttcatgctatagcacttacaatactcaacaataacctaaccaaaccaaaccaaaccaaaacccttatctgcactcacttcacacaaaccaaagttaattaattaccaacacaaaatggatggaggctgtgtcacagacgaaaccaccacatccagcgactctctttccgttccgccgcccagccgcgtcggcagcgttgcaagcgccgtcgtcgaccccgacggttgttgcgtttccggcgaggccgaatcccggaaactcccttcgtcgaaatacaaaggcgtggtgccgcaaccgaacggtcgctggggagctcagatttacgagaagcaccagcgcgtgtggctcggcactttcaacgaggaagacgaagccgccagagcctacgacatcgccgcgctgcgcttccgcggccccgacgccgtcaccaacttcaagcctcccgccgcctccgacgacgccgagtccgagttcctcaactcgcattccaagttcgagatcgtcgacatgctccgcaagcacacctacgacgacgagctccagcagagcacgcgcggtggtaggcgccgcctcgacgctgacaccgcgtcgagcggtgtgttcgacgcgaaagcgcgtgagcagctgttcgagaaaacggttacgccgagcgacgtcgggaagctgaatcgattagtgataccgaagcagcacgcggagaagcactttccgttaagcggatccggcgacgaaagctcgccgtgcgtggcgggggcttcggcggcgaagggaatgttgttgaactttgaggacgttggagggaaagtgtggcggtttcgttactcttattggaacagtagccagagctacgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtttttgagtttcttttgtgaattttgtaactgttgaattcatgaggtagagatggtgatggtgttgttgcaagttgccactcacaaaaggtgtatagtctcagacaaaaagaaaaaggaaaaattagggcaagaaaaattgttgaacagaaattttcttaacaaaaaaaaaaaaaaaag

SEQ ID NO: 1369 - DNA, 1443 bp, Glycine max
acgagtatagctcttaaaatactcaacaataaccaaacctaatcaaaacccttatctacactcacttcacacaaaccaaagttagttcgttaaccgttacaaacacaaaatggatggaggcagtgtcacagacgaaaccaccacaaccagcaactctctttcggttccggcgaatctatctccgccgcctctcagccttgacggaagcggcgcaaccgccgtcgtctaccccgacggttgatgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgtcagagcctacgacatcgtcgcgcatcgcttccgcggccgcgacgccgtcactaacttcaagcctctcgccggcgccgacgacgccgaagccgagttcctcagcacgcattccaagtccgagatcgtcgacatgctccgcaggcacacctacgacaacgagctccagcagagcacccgcggcggcaggcgccgccgggacgccgaaaccgcgtcgagcggcgcgttcgacgcgaaggcgcgtgagcagctggtcgagaaaaccgttacgccgagcgacgtcgggaagctgaaccgattagtgataccaaagcagcacgcggagaagcactttccgttaagcggatccggcggcggagccttgccgtgcatggcggcggctgcgggggcgaaagggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaacattacatagtttttgagtttcttttgttaattttgtaactgttgaattcgtgaggtagagatggtgatggcgttgttgttgcaagttgccactcacaaaacgtgtatattcttaatttgatgggaaaaaaaaggagaaattagggcaagaagaattgtataatgcaaaggtttttttcaaaagaaaggaacatggagtgccactatttatttttgtaaaaaaacagagaaaagggcggcccgc

SEQ ID NO: 1370 - DNA, 425 bp, Glycine max
cgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtttttgagtttcttttgtgaaatttgtaactgttgaattcatgaggtagagatggtgatgtgggttaaaaaataaaaaaaaaaaaaagggcgg

SEQ ID NO: 1371 - DNA, 405 bp, Oryza sativa
gcggatgaggtgtgacgtcgaagcccgcacgcgcgtggccacatcgtcgaggtacaaggggtgtcccagccgaacggcgtggggggccagatctacgagcgccacgcgcgggtgtggctcgggacgttccccgacgaggaggcggcggcgcgggcctacgacgtggcggcagctccaggtaccgggggcgcgacgcggccaccaacttccccggggccgcggcgtcggcggccgagctcgcgttcctcgccgcagcactccaaggccgagatcgtcgacatgctgcggaagcacacctacgccgacgagctccgccagggcctccgccgcgccgctctagagatccaagcttacgtacgcgtgcatgcgacgtcatagctcttctatagtcacgtaatcatctgc

SEQ ID NO: 1372 - protein, 365 aa, Oryza sativa
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 1373 - protein, 317 aa, Oryza sativa
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSRSAAAWGTEKHLLIDCKKMERNNLATVDDDARVVVKLFGVDIAGDKTR

SEQ ID NO: 1374 - protein, 393 aa, Oryza sativa
MDSSSCLVDDTNSGGSSTDKLRALAAAAAETAPLERMGSGASAVVDAAEPGAEADSGSGGRVCGGGGGGAGGAGGKLPSSKFKGVVPQPNGRWGAQIYERHQRVWLGTFAGEDDAARAYDVAAQRFRGRDAVTNFRPLAEADPDAAAELRFLATRSKAEVVDMLRKHTYFDELAQSKRTFAASTPSAATTTASLSNGHLSSPRSPFAPAAARDHLFDKTVTPSDVGKLNRLVIPKQHAEKHFPLQLPSAGGESKGVLLNFEDAAGKVWRFRYSYWNSSQSYVLTKGWSRFVKEKGLHAGDVVGFYRSAASAGDDGKLFIDCKLVRSTGAALASPADQPAPSPVKAVRLFGVDLLTAPAPVEQMAGCKRARDLAATTPPQAAAFKKQCIELALV

SEQ ID NO: 1375 - DNA, 381 bp, Oryza sativa
gcacgagggctcacctttcctcagcttagctagctagctgctcgatccggcggcgtgatcgagtcgatctctctgattctatcaggtgttcgaccagattccatcgatggacagcacgagctgtctcttggacgacgcgagcagcggcgcgtccacgggcaagaaggcggcggcggcggcggcgtcgaaggcgctgcagcgcgtgggcagcggggccagcgcggtgatggacgcggccgagcctggcgccgaggcggactcgggcggcgagtgcaagggagtcctcctcaacttcgaggacgccgccgggaaggtgtggaaattccggtactcctactggaacagcagccagagctacgtgctcaccaaggggtggagccg

SEQ ID NO: 1376 - DNA, 441 bp, Zea mays
agccgcgcgcagcccacgccggcctgggcgcgcgtgctgctgttcgacaaggcggtcacgcccagcgacgtcggcaagctcaaccgcctcgtggtccccaagcagcacgccgagaagcacttcccgctgaagcgcgcgccgccgtcggtggaggcgcaggcgcccaccaccgccaagggcgtgctcctcaacttcgaggacggggagggcaaggtgtggcggttccgctactcctactggaacagcagccagagctacgtgctcaccaagggctggagccgcttcgtcagggagaagggcctccgagccggggacaccatcgtcttctcccactccacgtacggctcggagaagcagctcttcatcgactgcaagaagaccaagacgacgacgcccgccaccgacggggtaccggtaccattaccagcaccagcggagaaa

SEQ ID NO: 1377 - DNA, 576 bp, Zea mays
gccggccgggcctccatatcctacaacacttcccgcaacagttgcatacgccgtgcccatctatctatagctagcactaggagtggtgcacactgaaatggacagcgccagcagcctcgtggacgacaccagcagcggctgcggaggcggcgcgtccacggacaagctaagggctttgggcgtcttcgccgacgactcggtgacgccgctggagcgcatgggcagcggcgccagcgcggtcgtgaacgcgcccgaggcgggcgccgaggcggactccggctccggtgccgccgtggtgagcgtcgacgggaagctgccgtcgtccagggacaagggcgtggtgacgcaggccaacgggcggtggggcgcgcagatctacgagcgccaccagcgcgtgcggctcggcaccttcgcgctcgaggccgacgcggtgcgcgcctacgacgtcgcgaagcagcggatccgcggccgcgacgcggtcaccaacttccgcccgctcgcggacgccgacccgtacgcggcgacgagctccggttcctggtgtcccgctccaaaggcgaggtcgtcgacatgctc

SEQ ID NO: 1378 - DNA, 471 bp, Zea mays
cccacgcgtccgcccacgcgtccgcgcaagcgcaacagaagcatactacgccgctacgcgctgggcggtgccgcacagctatagatagctagcagtgttgcatagaaatggacagcgccagcagcctcgtggacgacaccagcggcagcggcggcggcgcgtgcacggacaagctaagggctttggccgccgccgccgcctccgcctcggggccaccgccggagcgcatgggcagcggagccagcgcggtcgtggacgcggccgagccgggcgccgaggcggactccggctccgccccggcctccgtcgccgccgtcgcggcgggcgtgggcgggaagctgccgtcgtccaggtacaagggcgtggtgccgcagcccaacgggcggtggggcgcgcagatctacgagcgccacctgcgcgtgtggctcggcaccttcgcgggcgaggccgacgcggcgcgcgcctacgacg

SEQ ID NO: 1379 - DNA, 497 bp, Zea mays
  misc_feature (221)..(221): n is a, c, g, or t
ctgcttttgttttctgtgcgtaccgctccaaggctcgaggttcgtggacatgctccgcatgcacacatacttatgcgagctcacgcacaacaagatgcgccttcggcggcgagacgctgtcaccagatggtctctggcctataacccttacttactacgcgtcaggtatacccggggaccgagatgggaagaaccgtcgccggcgcgggagacacctgttnagacacagaaagtcaccatcggcgacaaacgcaagcagaaccggctggtgatccccaagcaccacgccgagaagcacttacagctgcagatcccgtccgtcggcgatgagagcaatggcgcgctcctcaacctggaggacgaacagggcaaagtgtggcggctccactactcgcactggaacagcagacaaagctacctgctcaccaacggctggagccaatgggtaaaagagaatggccttcaacccggagacgtagtaggcttatagcgctccg

SEQ ID NO: 1380 - DNA, 2493 bp, Glycine max
  misc_feature (1707)..(1707): n is a, c, g, or t
gtatttttaaaaatataaaattctcagtctggcgtgtttttatagagatttgcgttcgtttcactctctgtgtcaaggttggcttttttttttttctcttttctttttcttctggatttattgagcttgtttcacccaagtcacatgccagtgttttcgttagagcgataaaaactagtgttttgttgtacgggaagatacaatcttggccttagatttgtaatattttatctggggaactagaccagactgtttttgtttttgtttttgttttgttttttggttatatatatcagtttctttcacctgttgatgctcttttctctcctgcttgggcgagtgaagaggtgagagagcagataaaagcttgaggcttgatttctgcgtttcttggagaatttgtcttcaaaaaaagaaggggcagcagtggatttatgtcgtctgggtttattctggcagtgattggggctccgttgaagctcttcattgtttatgtttccgtttttttcttcctgactcgcttcgtgttctactgttgctgtatgctacactgcatcctgaaccacaatactgtgaacccatctgtttcaatgcgattgagaccaaaaaggacttgttgtggagtggagtgtttcggaggctttcacatacaaagattttcttatctcttcatattcttaagaggggatttcacctgataccttgagagattttgttaccctaccctttttttcttcgtttcttactttgagatttcctttctttgattccatttggtttcctttctgggtattctgaggggtttttggagggtttttctttctcattttttttccaccatgcccgagtctcggaaacaaccggcttctagaccgaagcaaaagcttcatcaccactccttgcaagagtccaaggcgatgagaaaacttcgcatcatttgcgacgatcctgatgctactgattcatccgaagatgagactgagaaggttcagagcccgagaagagttaaaagaaacgtgtctgagatctctcttccccctcttcctccaccattcaccaccactcctgaaaccagctcctgtgaggtgaatagcggcaaaaatgcaacattgaagggtttcattgaaggtcaaccccagagtaagaagagggttttgactcaccccccatcaacaaggaggaacacttctgggaaattcagaggtgttaggcagagaaaatggggtaaatgggctgcagagattcgtgacccctttcagagtactcgtatatggctcggcactttcaacactgcagaagaggcttcccaagcctacgaggccagaaggcttgagtttgaggctatggcagaggctcaagcttacaaaactagttctgtttctgaacctttggctacaatttctgataataagagtaactgctgtaactcttctgccgctgctatctccgccgctgccgtctccgccgctgcatgtgtctgtatctgagaagttttctactacttttgatgacttagaagagagtgtgttgtctcacaattcaccatcctctgtgctagagttggatacattggcttccaaatcccttgagaagggtaatgtttcaaccgaggaagctattgaggctaatgatttggtggctgaacttgcagggttagaggtaccagatgtcagtctgttaaacttgttaccaccaccatctgattcntggtggtgcagctgctgctgtttcatctgggattgagccaaactttgggcttgattttgattggctatcgtttaatgattatggacaaggttttgatgatttcggtggcttggaagatattcatattggtgggtttgatgacaatgagcctactgagcttcctgattttgattttggtgattttggtgctgatgagtttgctggttggattgaggagcccctgaatataccttgtgcctaaggttttgcagagctacgtaggaatatgaggctagatttctacaatattataagttttgttatttataagttagtctttctgtgagatctcaggaatgatgagttagtttttctgtgggatctcaggaatgatgagtgagtgaatggttactatatgcgttttacatttcatttgtttttgatggagttgttagttagagcagtgagatggtgagagaatcctttgggttttcccgtgctgttaaagagccgtccaagggaatctcgaaccatgatactatgtcgtaatttcaaggttcttcaatggcagagtattaatggaatgaaagttaatgttttgcatcgttttttctccagtctcatagcatatgaattggtcgtctcattgatatttgtctttttattcacgaatttgcccatgtgcgaagatcttttttgtattttcttcatatagtcatcaaaatctcttggctggttgatctgcctaattatcagaatggatcatggtcaccctttatcgattaagattctaaaattggataaaaa

SEQ ID NO: 1381 - DNA, 2337 bp, Glycine max
  misc_feature (122)..(122): n is a, c, g, or t
tcgaattcgctcgaggaaaaacagataaagcgacagggcagagaaaaagaggttcctatgcattcaccataacagtgaatacacatagggacaggagcaagcataaagtgaaggtcggctanaaaaaggtcttcgattctcgtggcataaacattaaacaaaagggtgctctatgtttttattaatgcaattggggttaattgttttatagagatttgcgcctgtttcaatccgtgtaccaaggtagccacttttttttcttttcttttgttttttctgttaacccagacacaggtgatagatcggtcataaaaaaatatattttgggacagaaaaatcttggccatagatttgtaatcttttcatctcaaaaaatttctcgtgctgttgtgtctctatatatactgtgtagctctatctctaacgttttctctctttttggtcagagggagagtggggtgtgtgtgtttttgttgggatttgtgaggaatccattgaaggaggaagagcgggagatttatgtcgtcttggttttatttggaagtagtgattggagctttgttgaagctcgggttcggttacgcttgtgtttgctgcatgctactctggctggtgttgaattctgctgtttcgatgagtttgaggtcaaaaaggacatgttatggaattctggtttgttatggaggctttcagataaaaaaattctctgctttcttcctcctttggagagtggatctcacttgatgttcttgaaattatgagggattttttttttggtttattaaaaaaaattattttgttttgctgaacaatttttctgggtattttgaggggttttgacccaattttttttaccatggcggagcctcttaatcaatcgactcctaggacgaaaaatatgttacacatgcgcaatccggttcttgtctcgctaatgacccggacactgcgcatcttttgccttgatcctgatcctactgactcttcatctgatgaggatgagtattttgggaatgttaggaagatgatcgagccgctcgagccgctcgagcggctcgaggttccggttaaccctgtggttgcagatgaaactagtactgagagcacaaacaatgatgaattgaaccagacgaagagggttatggcgaaaaccccctcagtgaagaggcaatcttgtgggaaatacaaaggtgttcggatgcggaaatggggcaaatgggccgcggagattcgtgaccctttcaagggcacgcgaatctggttgggcactttcagcactgcagaagaggcttctcaagcctatgagaccagaaggcttgagtttgaggtcatggccaaggctctatctgatgagaagagcaacaatggcagcagcaacaacaatgttgttgcttctgctgaaactgaaactgtggctgcccctgaaaataacagttcaaactattgtgtttcttctgctgcaggttctgtatcagactccaagtctgcttctatggatgaatcagagagtgtgttgtcactcacatcaccatcttctgtgcttgaattggatacatctgctttcaatttgattgggagtggtaaggtttcaagcaatgaagttgttgagactaaaggattggaggctgaagttgctgagactaaaaatttggcagctgaatttgccgagctggaaatgctggaaatgccggatttgagtatgctgaatgtgccatccccatctgctgtcgctgctactgctgctgctccatctgagtttgaattggatttgttggcatttgttgattccgagtatggatttcatgatgagcatgactttgatgatgatcttgctgccctggaagactttcacatttgcggtttcgatgacaatgagcctagcgagcttcccgattacgattttgacgactttggtgctgatgagtttgctggttggattgaagaacccctcaatataccttgcgtatagattttgcagcttcataggaatgagttctatccaagagactagtactactacaacattacaagttgtgtcattgcttaaaaatgctatagttttttgagatctcaggaaaaaactagttcctgggagagttgttttgtcaggtttgttttaatttatttgtttctttagggatggaagatcaatgagaggttaagagacaatgccttggtttttcttgtgctattagagccgtccaagggtttttcaatttctattatcgtgaaagttgagtgtgtagatgtctatcaaacttgaaatctactatctttatcagaaattctatggtatccttggaaaagtaccccgcagaaaaaaaaaaaaaaaaataa

SEQ ID NO: 1382 - DNA, 1855 bp, Oryza sativa
gtggatccccgggcaccaggcccgttttggtcggggttttagcgagcgcgtgggaggccggaggcgacgacgacgaccgcgccgccgtcggagaagaaggccgcggaagcaccagtaccagcacccgtatatgtcttctagccccttctccgatctggtggtagtcgtgctcctcgtctgcgccgtcgtcgccgcagccgtcctcctccccctcgtctgcgcccgccgatctatgcaccagaggctccacggctggaacaagtccacgtcgatgctcagggacgggttcggggtcaagtattccgggttcctccacataaggccgtgtggtttctgtcgaggagattgacggattcgatcgattcgtgttcgtctccgtcaaatttttgcacaagagaaaaaaaaaagtttcccccttttagagtttttccccttcagttttgtcagttttggtgaggaattttagagttcttttccggcaagagttagaagaagagagaaatggccccttccaagcagcagcagcagatgctcctcaagaaggtgatggcgaagaagcccaagacgaagaggctatccgggtttggccttaaaccctctgctgctttctccaggccccatgtgccgtcggcggcggcctccctgcagccaagccgtcgcgtccgcgtcgtgttcgaggaccctgacgcgacggactccgactctgacgacgacgaggacgccggcgccgcctcaaagaagcgctactttgagctcttcattggcaagccagcttcgtcgacgaagcaggcctctccggcgtccaccgtcgctgcctacgccaacatcggcaaggttgggagcacctgctaccgtggtgtgcgcctccggaagtggggcaagtgggcggcggagatccgcaaccccttcaccggccatagggagtggcttggcacctttgacactgctgatgcggcctccgccgcctaccagtctgcctcccgcaacttcgccgaagagaagcgccgccgtggtgtggcctcctctgcctcacctgctagttcggcgacccctactccgactgcgtcctcgtcgtcctcgacttctgccgcgccattcgcccacccttcgccgtcgtctgtgctcgaagccaccaagccagctccaaagccagagtcgccgccgctgccggagcaagctgcaactcccctcctggtggaggctaccaacgagaccgccgagctgccggatgacccagagttctacaaggatatactgcgcggtctacagctgccggacattgacccgatggatttccgagctgggctggatgctctggatatctccgatgtgccggcttacatgaatggcgaacaagacgtactcttcactgaggacatgctgcttggagacttcgctgaagaagatgacctcgacctcgacgacatcggtgatgacttctgcgaggatttcccagagatacccagcggctacgacttcggccgtggtgatatgttccggcaggtggatttctgcgtgtgaattaagagcttgctaaagttattcaaaaaaaaaaaaaaaaaaaatgagaaaaagtgcttgggaggagatttcttgggttttttccccgagcaaaatcaatctgctcgtgcccttgagatttcagttccgcccataagaactccaacgcacatttagcattcggagagtaattttgttaggttaaaagtatggtaagttataggtggtatgttatgtttttctttttcttttctcaatgttatctggtacctaagtttgtcaagaaaatcatagtggacaagtcaagtatttggggctgtcgtctctgttatggaaagaaaaataagttttgatt

SEQ ID NO: 1383 - protein, 444 aa, Oryza sativa
MAPSKQQQMLLKKVMAKKPKTKRLSGFGLKPSAAFSRPHVPSAAASLQPSRRVRVVFEDPDATDSDSDDDEDAGAASKKRYFELFIGKPASSTKQASPASTVAAYANIGKVGSTCYRGVRLRKWGKWAAEIRNPFTGHREWLGTFDTADAASAAYQSASRNFAEEKRRRGVASSASPASSATPTPTASSSSSTSAAPFAHPSPSSVLEATKPAPKPESPPLPEQAATPLLVEATNETAELPDDPEFYKDILRGLQLPDIDPMDFRAGLDALDISDVPAYMNGEQDVLFTEDMLLGDFAEEDDLDLDDIGDDFCEDFPEIPSGYDFGRGDMFRQDSHASAHLGRGTAQLEATLRRWSEIRIYTNPARVLTGSMLRVADQEYTTATIPLAIAAYGEDKTSKSQTCPYTTTAGDKSVLLREDPKLPRLTDQLPVDMVSSAPDFSTFS

SEQ ID NO: 1384 - DNA, 2245 bp, Zea mays
cattgggtacctcgaggccggccgcccctttttgctcctctcgccgctttgggtcggggtttaagcgagtgttgagggaggccgtgacggaggcgacgacgacgacggacggacggacggtgccggcgtcggaagaacaagtagccagctctcgtatatgccttcttgccccatctccgatctggtcgtcgtagcgctcatcgcccccgtcgtcgccggcctcctcctcctcctcctccgctccctcgcctgctccagccgatctatgcgcaaggggctcaacggatggaacaaatcctcgtcgatgctcagggacgggttcggggtcaagtattccggattcctccacatacggccgtgcggtttctgtagaggagactgacggattcgtcctcaaggccgtgccgtttctgtagaggaggctgacggattcgaccgatttgcgctcgtctccgttatatttttgcacccagagttttttttgttttttttcttcagaagcttttccccgtagttttggctggagttctccccggcagaggagatacaagagacatggccccgttgaaccaccaccagcatgtcctcctcaagaaggccctggcgaagaaacccaaagctaagcggatgtccaggtttggccttaaaccctccgctgaagccctcctgaagtcccggccgcagcagccggcgcctgccccggcccagccgaggcgccgcgtccgggttctcttcgaggaccctgacgccacggactcggactccgacgacgaggaggccggcgcccctacgtgcccggcggaggccaagcgcttctccttcgaggcgttcgtcggcaaggtcccagccaagccggtccttccggcggccgctgtcgccgcgtgcaccagcggcggggcgccggagcgctaccgcggagtgaggctccgcaagtggggcaagtgggcggcggagatccgcaacccgttcaccggcaagaggcagtggcttggcaccttcgacaccgctggcgcggcctccgcggcctacctgtccgcctcccggagcttcgccgacgagaagcgccgccgccgcgggctgcccgtggccgcgtcctcaccagacactccggcaagcggcagcaccccgacggcttcctcctcgtcgtccgcctcgaccgctccattcgcgcacccgtcgccgtcgtccgtgcttgaaccgagcaaggaagcgcggaacacgcagtccccagaggcgacgcccgcccggccgtcgaccgactcagcgcagctgccggaggacccagagttctaccaggaccttctgcgcggcctgcagctgcccgacatcgacccgctggacttccgcgccgggctggacgctctggatctctccgatgcggacttcggcctggacgacgaacatgacctcctgctcggggacttcggggacgaggagatggagatcgacctcgacctcgacgacatcaacgacgtcttcccggagatgcccggctgcgacctcggccgcggcatggacgacttcctgcaaaccgttgatttctgcgtgtgaattgaaagggagtgtgcccttgatatgttagggttgtttggtttcataaacgagcccctgagagtgtgcttggaaaggggagatgagatatcttgggttttttccccgggcaagttggatctgctcgtgcccaggagatttcctctttgccgaacacaccaccattagcggccggagagaagaggtaattttggtaggttatattatgtttaaggtttaaggtatagtgcctaagtgtttgctttgttatttggtaattggtaatgcttgtcaaagacattgtagtggacaagttcattgagctgttactattaagcaatgaaagggaaaaaaataagtttcgtggtaaaaaaaaaaaaaaaaactcgagcccggggggctcatttaccccatcaggtaccacagagaaatcagtgatcactctagtgtatttacccatggccttagtgacaaagacgaaggggcagacggtcttgcagatgcaacacttgttgtcgcccatcacgaaacggaggcggacgatgcatgtggagcacacgtcgcggtgcccgcacgacccataggccacccactccagcgtatctgcgcacaccgcacaaaagtcttccatggctatctgcgcagctctaatctccgaagtccgaatatatcttcaaatctggtaagatagggatcgattctatctcgaacaggg

SEQ ID NO: 1385 - DNA, 1995 bp, Glycine max
gggaaaaatgtaaagataatggctttgatgatatctacatatcatcctttgctttcaagcgtgcaacagattcaggctctttttatcatggtgctggaagaaaaatgataaatcctactacacttcctcaacagtcccttcctggtattgaggtttcggctcagtctgaaaattcttttcaatctcaaagtgttgatgctgtcaaagctcaaactgagaacaaaagtggttttcgtcttcaggccgactttgctgaatcacctcctcaaaaagataatggaattaagatgttctcagctgatcaaagggcttttgatgttgttggcggtggcaatgaacattctacaccaattgaagagcaagtagatgaaggagatcaaagaggcaatggagactcaatggctagtggtgttggtggtgcaccatctgaagatggatataactggagaaaatatggccaaaagcaagtgaagggcagcgagtaccctccggagttactacaagtgtactcatccgaactgtcaggttaagaagaaagtagaacgatctcatgagggccacataactgagatcatctacaagggaacgcacgaccatgcaaaacctcctccaaatcgccggtcaagtataggttcggttaaccttcatactgacatgcaagtggaccaccctgaacacgttgaaccacacaatggtggtgatggtgacttgggctgggctaatgtacaaaagggaaatatagctggagctgctaattggaagcatgaaaacattgaagccacatcatcagcatctgttggccctgaatactgcaaccagtcccccaatttgcaggctcaaaatggtactcacttagattcaggagaggcggtggatgcctcatctactttttctaatgaagaagacgatcaagtcactcatggtagtgtatcattaggttatgatggggaaggagatgaatctgagtctaagagaaggaaactggaatcatatgcagagttgagtggagctactagagccattcgcgagcctagagttgttgtacagactaccagcgaagtagatatcctcgatgatggttatcggtggcggaaatatgggcaaaaagttgtcaaaggaaatcccaacccaaggagttactacaagtgcacgaatgcagggtgcacggtcaggaagcatgtggagagagcatcacatgaccttaaatctgtaatcacaacatacgagggaaaacataaccatgatgttcctgctgctcgtgccagcagtcacgtcaacgctaatgcttccaatgccgttcctggccaagcttctcttcagactcatgttcatagacccgaaccatctcaagttcacaatggcattggaaggcttgagaggccttctcttggctcattcaacctacccgggaggcagcaactaggaccatcccatggcttctcctttggtatgaaccaatccatgctatcaaatctggtgatgtcagggttaggccacgcgcaagcaaagcttcctgtcatgcctgttcatccgttcttggcagcgcaacaacaacatcaacagcgacaacaacatcaacagcagcagcaacatcaacagcagcagcaacaacatcaacagcaacagcaacatcaacaacaacaatgcgctgcaaatgatttgggtttcatgttgccaaagggagagccaaatgtggaggctattcctgaacatggtggccttaacctgtcaaatggctcatcagtgtaccaagaaatgatgagtcgcatgcctcttggacctcatatgtaaaattttattccctgattctttaaagaaaaaactaatgtttacatctgataacatacatatatagatttatacatatatgtaatgccaaggcatacataggcggacttttcattattagactcattgtaatgtttgacattcttcatcacatgtcaaaggtatatgttattttgctcatttattgcattggtcctggccggccgc

SEQ ID NO: 1386 - DNA, 1262 bp, Oryza sativa
ttttttttttttttttttcttttttcaccatcagcacttccgatgaatgttttgcctttgtcctgaacactaccaccaccttttttttccaattacaacataaacaaaacgggtaacatcttctgcattcttggcttccaaaaaataaaagcccaaagaaaaaataacaggtaaaagctagaacaacaagagctatgttgtagcatgctaccatgtatagaagctgaagcacatctatcattttcttttctttctttaatattattatttacatctgaggtccaaatgatggaggcctgttcatcatctgttggaaggatgatgaagattggtttaccgcggggaagccgagctgcgacatgggctctgtcttcatctctccttccggaatcatgagcccctggtagccctgcatggtggatggatgaccagcatctttgctggagcaagagaccctagagatggcatgggaatcgccatgcctggcgggaccatcccaaaggggaaattgctcgccgatggtccaaatgtggtttcttggtgggagaacgaaggagctgaagggagccgcgccaccaaactggctgaagctggcttgcccttgttcttgcctgcgctgagagccgttagattgcggtgcagatggagcgtttccagatccagagctcccatgtccactatttctggcagctggaacttcatggttgtgcttcccctcgtacgtcgtgatgacggattttagatcatgcgatgctctctccacgtgcttgcgcaccgaacacccttggtgcgtacatttgtaatagctccttgggtttggatttcctttaacaaccttctgtccatacttgcgccagcggtaaccgtcatcaaggatgtcaacctcacttgttgtctgaacaacaacacgaggctcccggacacctctcgatgccgcagctcccatgtcaatgttactggtggtggtaatagcagcagttgcagctgtcaaagcatccagcttccttctcttggaatcagtctcatctccatccccgttgcactctatagaagccgtgccatgcgttgccctatcatcctcctcattagatagtgttgacgacacatcaactgcatcttgggactccatgatagatgtatcacaattggttgatactggaagacaagcagctgttcttgtttcaataacttcactttgaacatcttgaaggcaatcatttttggcattgtcccacaaggatgcagagttatggccctcgtgc

SEQ ID NO: 1387 - DNA, 845 bp, Oryza sativa
gaactagtggatccccgggctgcaggtttggtccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcaggttggctatggctcagctggtcacagaccagcaaagcagtttggtgcagcagcagctggtttctcctttggaatgcttgctcgtagcatttgcaacttcggggccgtcttcggcgatcgccgttgccgcg

SEQ ID NO: 1388 - protein, 996 aa, Oryza sativa
MTTATLDPPPPPLLIAGSLLDDDRDAGSAASSSPRWLPRARGSTVGSPPRRGGEERGGEAATRRKGNSSCPDDDDDCRNDEDDCRNDDDYRDDDVGATTDGGGDAAALLPMAMMTATTMAPMPVEAAVDGGGELSSAGEGGQRRVNLLPTKILSAYENHLFSQALACREDEWIIEKLAVIAARRSSFVSEESLCSVPAAALVSLAIAHLAFSPMLVYGVLDRLCSVCHLGEMEGDIAMEEWKDSNHRGADYLMTMPMQNFLADAFPPPELLEGEGGFEKHGLSVAVGSPPPTPPPPEDGCSPLPLTPQFGQKFGSGGGGGGSLADRRARGGFSNVARISVPYNQPAADVSSAGAPSPYVTIPPGLSPTTLLESPVFSNAMGQASPTTGKLHMLGGANDSNPIRFESPRIEEGSGAFSFKPLNLASSHYAAEEKTKSLPNNQHQSLPISVKTEATSIQTAQDEAAANQLMQPQFNGGKRSRAAPDNGGDGEGQPAEGDAKADSSSGAAAVAVVAAAAAAVAEDGYSWRKYGQKQVKHSEYPRSYYKCTHASCAVKKKVERSHEGHVTEIIYKGTHNHPKPAASRRPPVHPPPPSPATTTTTPLPPGDAQADHAPDGGGGSTPVGAGQAGAEWHNGGVVGGEGLVDATSSPSVPGELCESTASMQVHEGAAAAQLGESPEGVDVTSAVSDEVDRDDKATHVLPLAAAAADGESDELERKRRKLDSCATMDMSTASRAVREPRVVIQTTSEVDILDDGYRWRKYGQKVVKGNPNPRSYYKCTHPGCLVRKHVERASHDLKSVITTYEGKHNHEVPAARNSGHPAGSASPGGGAGSSSQPHGVGVGGRRPEVPSVQESLMRLGGGCGAAPFPPHFGLHLPPPPPRDPLAPMSNFPYSLGHAPSPALRGLPPPPPPPPSASALAVAGLGGVVEGLKYPMLAPPSVHSLLRHRQGGGMEAVVVPKAEVKQEAMRPAAAVAGAGRGAAVYQQAMSRVSLGNQL

SEQ ID NO: 1389 - protein, 631 aa, Oryza sativa
MSSFLNEEFSSGPFSDIFCDNGSNKHQDGLGKSKAFIDSSREETAQLAKKFESNLFGANQKSSSNGCLSERMAARTGFGVLKIDTSRVGYSTPIRSPVTIPPGVSPRELLESPVFLPNAIAQPSPTTGKLPFLMHSNVKPSIPKKTEDETRHDRVFFFQPILGSKPPTCPVAEKGFSVNHQNQPSVTDNHQELSLQPISTASNDFTSPTIVKPKTSDSMLDNDDHPSPANDQEENASHKNEEYSSDLIITPAEDGYNWRKYGQMRVRTVERSQDGQITEIVYKGSHNHPLPPSNRRPNVPFSHFNDLRDDHSEKFGSKSGQATATSWENAANGHLQDVGSEVLTKLSASLTTTEHAEKSVMDKQEAVDISSTLSNEEDDRVTHRAPLSLGFDANDDYVEHKRRKMDVYAATSTSTNAIDIGAVASRAIREPRVVVQTTSEVDILDDGYRWRKYGQKVVKGNPNPRSYYKCTHPGCSVRKHVERSSHDLKSVITTYEGKHNHEVPAARNSGHPSSGSAAAPQATNGLLHRRPEPAQGGGGGSLAQFGYGSAGHRPAEQFGAAAAGFSFGMLPRSIATPAPSPAIAVPAMQGYPGLVLPRGEMKVNLLPQSGNAGAAASQQLMGRLPKQHPQM

SEQ ID NO: 1390 - protein, 650 aa, Oryza sativa
MSSFLNEEFSSGPFSDIFCDNGSNKHQDGLGKSKAFIDSSREETAQLAKKFESNLFGANQKSSSNGCLSERMAARTGFGVLKIDTSRVGYSTPIRSPVTIPPGVSPRELLESPVFLPNAIAQPSPTTGKLPFLMHSNVKPSIPKKTEDETRHDRVFFFQPILGSKPPTCPVAEKGFSVNHQNQPSVTDNHQELSLQSSSTAAKDFTSATIVKPKTSDSMLDNDDHPSPANDQEENATNKNEEYSSDLIITPAEDGYNWRKYGQKQVKNSEHPRSYYKCTFTNCAVKKVERSQDGQITEIVYKGSHNHPLPPSNRRPNVPFSHFNDLRDDHSEKFGSKSGQATATSWENAANGHLQDVGSEVLTKLSASLTTTEHAEKSVMDKQEAVDISSTLSNEEDDRVTHRAPLSLGFDANDDYVEHKRRKMDVYAATSTSTNAIDIGAVASRAIREPRVVVQTTSEVDILDDGYRWRKYGQKVVKGNPNPRSYYKCTHPGCSVRKHVERSSHDLKSVITTYEGKHNHEVPAARNSGHPSSGSAAAPQATNGLLHRRPEPAQGGGGGSLAQFGYGSAGHRPAEQFGAAAAGFSFGMLPRSIATPAPSPAIAVPAMQGYPGLVLPRGEMKVNLLPQSGNAGAAASQQLMGRLPKQHPQM

SEQ ID NO: 1391 - DNA, 984 bp, Zea mays
  misc_feature (651)..(651): n is a, c, g, or t
cgcgcagctacttcaagtgcacgcatcccaactgcctggtgaagaagaaggttgagcgctcgcacgaggggcacgtcacggagatcatctacaagggcacgcacaaccacccgaagcccacgcagagccgccggccaggcgcaggcgcgcacccgttgggcggcggtgcgcaggcggacgcagccgacaacctgcaggggtcacaggcaaacgcggcggaagccaaccagccgtggcgtgcgggtgtccaggatggcgtggacgcgacgtcgcccccgtcggttcccggtgagctctgtgactcggcggcgtcgatgcaggtcgactgcgcggcccggtttgggtcccccgagggcgcggacgtgacgtctgccgtgtctgccgaggtggacggggacgacagggggactctgactcatggcggtgccaacgcggcggagggcgacgaactggaatctaaacgaaggaagctggaggcatacgccattgacatgagcactgcgtcgagagctgttcgcgagcctcgagtggtgatccatacgacgagcgaggtggacatgctggatgacggctaccgctggcgcaagtacgggcagaaggtcgtcaagggcaacccgaatccaaggagcttctacaagtgcacgcaacctntctgtatggtgcggcctcttttttccgcgcgctttttacgctcttatgctcttctttccttttttccgtccctcggcctcctttttttttttttttccttggcttcttccccttttttttttttctcctctttccctcttttcccccccccgctttttcccttctttcccccctttttccgtcccttttccctcccctttccccttttcttcccttttcctccctccccgtttcgccttttctctcgtttccctcccttttccttcctttcctcccctttctctcccgttttccttccccttttcctccccgttcctttccgtttctttcttt

SEQ ID NO: 1392 - DNA, 1367 bp, Zea mays
ccacgcgtccgtgccaccccttccttcccctaatcccctcctcggtcaaaccgcctcactctcctactcttctctccctagtccctacccggctctctccctcccccctctctctaaaaaaagtagcgcccgcagaaccgagaggctggagaaataaaggcggaaagagggaggcaaatctcactttgttggggattctttcctccgtttccgactcctttgttctcttaagtgttcttggttagtggaatggaagctcagcagccccatttatgcccccgagagcctcgtcgttcccctcgtgtgtaggtgtagcctttcactcggttggtggaagggcagaggcacagtagaacatcgataaagggggggtcgtctattttttagctcttcgtgttcttgtaggaggaattcccgttcacatgatccgtgcctgcatcctcaagagctgtccgggagcctagggttgttgttcagaccacaagtgaggtagacattcttgacgacggttatcggtggcgcaagtatgggcagaaggttgttaagggcaatccaaatccaaggagctactacaaatgtacaaacccgggctgttcagtgcgcaagcatgtggaaagagcatcgcacgatctgaaatcagtcatcacaacgtatgagggaaagcacaaccatgaagttccagcagccagaaatagtgggcaaggcagttccagcgctccatctgcatcacaagctggtggttctcaccgtaggcaagaacctgcacaggccagctttgctcactttggtacggcttctttcagctcgttcggtctcccaccgagtggtcagttgggaccaacaactggcaatttcggcttcgggatggttcccccaggcatgacgatcccagtgccctctctaggatcgcttgcccctgtaaagatggttggaaattcatcagctatgcaggggtacccagggcttatggtgccgggagaaccaaaggtagagcctgtctcgcaaccactcatccaaatggcaaatgcatctccaccagcttaccaacagatattgagcaggcctcctttcggtcaccagatgtaaataataggaaagagaaaggggataatagatttgcttcagcttgtatacatgatagctacgctgcaacatggctttagtgttcatggatcgtccaattttttatttctattttatttttctgcccacgcatgtctttgaagcaaagaatgctgaggatgataccctgtcgtgcctgttgtaatcacgtaaaggatacctttcgtctttttgagactcgaaattggaaaacgatcaatcaaaatttctggttgcgaatgcaaaaaaaaaaaaaaaaaaaaaag

SEQ ID NO: 1393 - DNA, 3267 bp, Zea mays
gagctcacttttccgggggccgcccttttttttttttttttttttttttttttttttttttttcaccaaacctcaatgaagaggggcagtaaataaataaatagttgctgagctaaaaatgaagtggaagggtgaaaaaaaaacagaaagcaacgggtgtttgttcccacgttataacaattatcacgaactcatcctaatacgactggtaagaaactaataacttgagaatcactaatcctctccacatttatttatgtatctacatctgctggcgcaaccgcagcccgctgcacatcatctgctggtacaccgacggggcagcgccgccggcaacgttgccctcgacctttacgtcgtccttgggcgccacgaggccagcggcctgcatcgcctgccggtgcctcagcagcgggtgctgctgcagggacgacggcgccagcatcgggagcttcagcccatcgacggcgctgagggtccccgccggcaccggcaggctcggcagtgacgtggggccggcgccgccaaggggaatggaggaggcatacgtcgggtaattgcccatcggcgccagcggatccctaggcggcggcaggccgaacggcacgccgcagccgcccaagtgccccatcaggccgtcgcgcagcgacgggtgctccagcctgcgcgggccacccgcgcctgtcgccgccgcggtgcccgggtggccgctgttcctggcggcggggacctcgtggttgtgcctgccctcgtacgtggtgatcacggacttgaggtcgtgcgacgcgcgctccacgtgcttccgcaccacgcagcccgggtacgtgcacttgtagtagctccttggattcgggttgcccttgacgaccttctggccgtacttgcgccagcggtagccgtcatctaggatgtccacctcgctcgtcgtctggatcaccacgcgaggctcgcgaacagctctcgacgcggtgctcatatcgatggcgtacgactccagcttccttcgtttacattccagctcgtcaccctccgcgtcggcaccgccctgagacatactgccacgagtcaccctgtcgtccccgcccacctcgtcggacacagacgtcacatccgcgccctcgggggatccaaaccgggctgccgagtcgacctgcatcgaggccggcgagtcacagcgctcaatgggaactgagggcgacgacgtcgcgtccatgccatcctgaacacccgcacgcctcggctggttggcgtccactgcgtttgcctgtgaccccaggttgtcggctgcgtccgcctgcgcactgtcgccaaacgggtgcacgggctggacgcctggacggcggctctgcgtgggcttcgggtggttgtgcgcgcccttgtagatgatctccgtgacgtgcccctcgtgcgagcgctcaaccttcttcttcaccaggcagttgggatgcgtgcacttgaagtagctgcgcgggtactcgctgtgcttcacctgcttctgcccgtacttcctccagctgtacccgtcctccgctggcgctgtaacggccattgccgccgggtagtcttccctcgcatcagcttcctcggctctctggccgtaatccgggggtgatgcgtgttcattgcctgcaccggtgccagacgcaagacggctgagcttggagtcacgagcaccgtcactatccatgttggtctgcccatcgtgattctgctggttcagttggcccagcaaactagcctcttgtactgtcagaatcttggtttcagtcttgacagaagacttcgtattttgttcctgacggagcaattatgaactaactcgtaaggaaatggtatcaaaaggtattggatcatgaatagaaaaaaaaatgttcattgacattttgaaatgtacaattagaacgatgttcttatatgtttagttggaactcaaggaagactaacctgttgtttagttgccagtgagaattatttttattgaacttctaaactatctaacactagctggtctctggtctttctccaattagtatgaacaatatgcagcaaaacagccactttgtgtcactaacactcagagaatagacaaatgtgcttcaagcctcaaccattccaaaaagacaaactagtctgttacaggtagtgcaacagataaaagacttacagagcaaaaccatttggatttaaccgatttctcatctagactcggggcaaaatttcagaaacaaacatcactgcaaactgcacgtttatacgaatactttctaagttaagagatccttttaccattagcgcacaagcaaatgttatcatgaataacctatgaagtattcaaatgttaccttcaatcattaccacgcaagcgtcgcaggaataacctatgaactattcaaatgttgctaaccttcattgcttcagcagtgtagtgtgaggatttcagatctaagggcttgaaaggaaaagcattagggccatctccaactgaaggaggaccacctccaaatctaataggatcattgtcatttgtgctaccaaacatgaatagcgtccccgtggttggcgaggcctggccctgaagaattgcaaggaaacaaaaaacattgctgtcaggtacgaaatagcttcagtatcggagtttattaaaataattgtcctagttgatacctccttagttaatttacatatgaaataacatgatgattcaaaatacagatatgaatatgaagagagcaaacacatgaaattcctatgcagctttgacaacattaacagctattatattggagttccaagtagtacataagggggaagtttggacctgaagtgtgggggcatacattgccacataactatggaaagaacagagatttgatcatcatattcctgctttcaagaaaactttgaaatatttgaatggtacgatactatttttctgcttttgagaaaacaaacagaagcctgtttggaaagaagagactggatgctacaaaacaaggcagaactgatcatcatggaactgaagtagagctttcacgaactccctggagaggtcaaaagcttattaaagcaagcattcttgaactgccagtttagcatccatagacgaaagcaatactgattctggtaacgcgtccacaccctatcataacctagagaagagcacataccatggaattagaaacgaagactggtgactccagcagcgttgctgggctcaggccaggcgggatcgtgaggtagggcgatggaacttcgctcgagccgaat

SEQ ID NO: 1394 - DNA, 1091 bp, Glycine max
gcacgagcttcaatattctatgttaatttacttgctattgtttgcttatcatcctttcaattaagttatatgtagttgtgcttgatggtcgttcaactcttcaacacagaaatcataatggatgaaaaggtggaaactattaaagctgagttaaaacgagtgagagaggagaacaacactctaagaatgatgcttgaagttctaagcagcaagtacacaaagcttgagacccatcttcaagaaataaacaagacacggcactagggcctgaggtcaaatcaaatagggtcagtaacagtaccacctatgtttcatacaaacaagagaccgagactagagcttcccacagcaaaaaagccattacaaatctttgtcagaacacaccccaaggatgatagtttgatagtaaaagatggctatcagtggaggaagtatgggcagaaggttaccaaagacaatgcttcaccaagagcttatttcaggtgctccatggctcccatgtgcccagtcaaaaagaaggtgcaaagatgcttacatgataagtcaatcgttgttgcaacttatgatggagagcacaaccatgcggccattcatgagtcatcttcatccacatctaaaggctcatcaccagtggttaataacttacctctgatgacaagcatattaaatgacaaagaacccatgaacattggcttggctctttcagggtggtctcaaacagatagaagacattgtgaagatgtcatgcaacagaataataacaatggtggtagcaacatcaaaattgaagaatatgtaagttctctaatcaaggatccagacttcaccatgtcattagctgaagcagttgcccgcaccatcactggccagcagaagcaacaagatctaaacctcaatttggagcttcctgaagagtgaaatcaatcatttttttcccacaaaagccataatgcaagtgtaaagatgaattttagttcagtgaattgtagtccagtagcactgaaaaagcgaggaaaacttctttagaatggtttactttaagaaaacattataggttgttttcgttttccgtttccactttaattgcaaaa

SEQ ID NO: 1395 - protein, 396 aa, Oryza sativa
MAKMLPPPSQSVPSRPPSWLYIPPRRRHGTFTSSCAFRLSPSSPSSPPPPVLDFQYIQFMDSWIEQTSLSLDLNVGLPSTARRSSAPAAPIKVLVEENFLSFKKDHEVEALEAELRRASEENKKLTEMLRAVVAKYTELQGQVNDMMSAAAAAAVNAGNHQSSTSEGGSVSPSRKRIRSVDSLDDAAHHRKPSPPFVAAAAAAAYASPDQMECTSAAAAAAAKRVVREDCKPKVSKRFVHADPSDLSLVVKDGYQWRKYGQKVTKDNPCPRAYFRCSFAPACPVKKKVQRSADDNTVLVATYEGEHNHAQPPHHDAGSKTAAAAKHSQHQPPPSAAAAVVRQQQEQAAAAGPSTEVAARKNLAEQMAATLTRDPGFKAALVTALSGRILELSPTKN

SEQ ID NO: 1396 - DNA, 467 bp, Oryza sativa
  misc_feature (121)..(121): n is a, c, g, or t
gtggatccccgggctgaggcttctctccttggctcagcttgacatcgtcggagcagcagaaaagtttgctcgatcgagctagctactaggtcgcggatcagtgataaatcgttcgccgatngatccgtggattagcacccagccttcgctgagcctggacctccgcgtcgggctgccggcgacggcggccgtcgccatggttaagccctgcaagcgcatccgcgaggagtgcaagcccaagatctccaagctctacgtccacgccgacccatccgacctcagcctggtggtgaaagatgggtaccaatggaggaagtatggtcagaaggtcaccaaggacaacccctgcccaagagcctacttcagatgctcatttgctcccgcctgccctgtcaagaagaaggttcagagaagcgcggaggacaacacgatcctcgtggcgacgtacgagggggagcacaaccacg

SEQ ID NO: 1397 - DNA, 456 bp, Oryza sativa
gcacgaggggctgctgcagagccagttcagcgacatggtcaccgccgccggctacgccgaccgaagaccgagtgcacctccggcgagccctgcaagcgcatccgcgaggagtgcaagcccaagatctccaagctctacgtccacgccgacccatccgacctcagcctggtggtgaaagatgggtaccaatggaggaagtatggtcagaaggtcaccaaggacaacccctgcccaagagcctacttcagatgctcatttgctcccgcctgccctgtcaagaagaaggttcagagaagcgcggaggacaacacgatcctcgtggcgacgtacgagggggagcacaaccacggccagccgccgccgccgctgcagtcggcggcgcagaacagcgacggctccggcaagagcgccgggaagccaccccatgcgccggcggcggcgccgccggcgccggtg

SEQ ID NO: 1398 - DNA, 388 bp, Zea mays
  misc_feature (52)..(52): n is a, c, g, or t
gtcggccgcagccaccgccgccgccgtcttccaccacgagccgggcgagccnccgccgggaggagtggatgtccggggtgtcccggcgatacgtccacgccgacccctctgacctcagcctcgcggtgaaggacgggtaccaatggcggaagtacgggcagaaggtgaccaaggacaacccctgcccgcgcgcctacttccggtgctccttcgcgccgtcgtgcccggtgaagaagaaggtgcagcgcagcgccgacgacaggaccatcctggtggccacgtacgagggcgaccacaaccacgcccagcctccgcggcacaacggcggcggcagcaaggccgcgacgaggtcgacgccagcggcgaccgaggccgcgcgaccggcgcc

SEQ ID NO: 1399 - DNA, 1136 bp, Zea mays
gtcggccgcagccaccgccgccgccgccttccaccacgagccgggcagccgcgtccgggaggagtgcaagtccaaggtgtcccgcccgtccgtccacgccgaccccgccgacctcagcctcgcggtcaaggacgggtaccagtggcgcaagtacgggcagaaggtcaccaaggacaacccctgcccgcgcgcctacttccgctgctccttcgccccggcctgcccggtcaacaagaacgtgcagcgcagcgccgacgaccccaccatcctggtcgccacgtacgagggcgaccataaccacggccagcccccgccacaggcgcaggcgccgcacgacggctccagccctggcgccagcaagaagccgccgtcgccgccgaggccggtcgccgccgctccggcgccgctccaccaccagcaggtccagcagcaccagcagcagcaggcggttggcgcggtgaaatgcgagccgcccgtggccgcggcggcgtcggagctcatccggcggaacctcgcggagcagatggccatgacgctgacgcgggaccccagcttcaaggcggcgttcgtcaccgcgctgtccggccggctcttcgagatgtcgccgaccaaggactgacggaacggatcggatggattgggcgattggcatcgcaggagattctggatcagattgtcttcgagcgcacgccgcaatggtcaactgcgcagcgctggcttggctgctgcctccgttcactcttcgctgtcagagcgaaacagcggtaacagagcaagacacgaggggtctgcactctgcagttgtgcaggaggaggaacagacacagggagaggagggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcaaatgaaaattatttttccctagcactatgtttcatgagaatgagaccaggaatgaaccaacttgagtttgaaaatttccataggggagtaataataacagaggtatact

SEQ ID NO: 1400 - DNA, 994 bp, Zea mays
tagcgagtaccgtcgaattccgggcaccccccgcaggtcggctcgacctcagctcaaacatccctactctcctgctcctcttcttcctcctcctctcgctctcaagcgcgtcttcactccggcctagctcggacggatcgacatcgaggggaaagggaataagtgggggcgccagcagatggatccatggatcagcagccagccttctctgagccttgacctgcgcgtcggcctgccgccgctcagcctccaccaggcgccggtggccgtcgccttggccaggcccaaggtgctcgtcgaggagaacttcctgctgcctcccaagaaagaaccagaggtggcggcgctcgagacggagctgcggcggatgagcgaggagaaccgacgcctggcggaggcgctggccgcggtggcctccaagtacgaggcgctgcgcagccagcacaaggagatggtgtccgcggcgcccgccggcgggaacgcgtcgtccgcgtcggagggcgggtccgtgtcgccgtcgcggaagcgcaagagcgagagcgcggacacggcgccggcgcctgcgcagcgcccgcacccggcggcggacctgtcggagtgcacctccggcggcgagccgccgtgcaagcgcgtcgtgcgtgaccgggcggaggaggtggaggaggaggaggagtgcaggcccagggtgacgaagctgtacgtgcgcgccgacccggccgacctgagcctggcggtgagggacgggtaccagtggcgcaagtacgggcagaaggtgaccaaggacaacccctgcccgcgggcctacttccgctgctccttcgccccggcctgccccgtcaagaagaaggtgcagcgcagcgcccacgacgcctccgtcctcgtggccacgtacgagggcgaccacacccacgccccgcccccctcgggctcgggcaagaacgccgcgaagccgccgtcgccggcgcgccgccaggaggctgctgtcgcggtgacc

SEQ ID NO: 1401 - DNA, 838 bp, Zea mays
  misc_feature (827)..(827): n is a, c, g, or t
cctcgaggccggccgggaccgttcgatccgagtgtcctgcagagcccatcctgttcctgtccccctcgagcaatcgagctcagctgcacgctcgcttacgcggagacacagacgctgagacacacgcaggtcatgatgctgctcatggactcggggagccgcggtgactgctccccggtctgcttggacctcagcgtcggcctttcgccgccgtcgccggggagcggcccggaaacgacagctgacgctgagagactcgaccgccccgccactggctgctgggggccacggacatcgtccctggctgacgggcaggacgaggccaagaccctggaggccaggctcacccaggtcagcgaggagaaccggcggctcaccgagatcatcgcctacatgtacgccagccaggtcgccgcgcggcggagtcccgacggcaggaagaggagcagggacagcctggagccgtcgaattcgggcgacgccaacgctgccgtcgagagcgccgccctcagcgacgagggcacgtgcaggcggatcaagctcaccagggtctgcaccaagatcgacccctccgacaccacgctcaccgtcaaagacggctaccagtggcgcaagtacggccagaaggtgacgcgcgacaacccgtccccgagagcctacttccgctgcgcatacgcaccatcctgccccgtcaagaagaaggtgcagaggagcgcggaggacagcgccatgctggtggccacgtacgagggcgagcacaaccacccgagcccgacgcgcgccggcgagctccccagcttcacctccatcaactcctccggcccggncatcacgctgg

SEQ ID NO: 1402 - DNA, 1147 bp, Glycine max
tcgactcgagccgaatcggctcgagccacaactcaactaagcgcaaaccaaaccaacacaaacaaaaacatctctcagcaaatgaatattctcggacaatcactccaccaatcaaacaacggcagctactcttgttcgtcgccggagactgcaaactcctctaaccttccgaccactccgaaagccgttcactccgacgaggaagtgaacacattagcatcggctcatcctaagaaacgtgcggggcgtcgaatttttaaggagacaaggcatcccgtgtacagaggagtgcggcggaggaacaacaacaagtgggtctgcgaggttcgtgttcccaacgacaagtccacgaggatttggctcggaacgtatccaacgcctgagatggccgcacgtgcgcacgacgtcgccgcgctctcgcttcgaggtaagtcggcgtgtctcaacttcgccgactcggcgtggcggttgcccttgccggcgtcgaccaatgcgaaggagattcggcgcgtggcggcggcggctgctgtagcgattgcggcggaagacagccgcggcaagcagttgcggactaatgcgattgatgccgttgctgattgcgaagttagcagcagtgacataggcgtcgatgaaaattgcaataacaataaagcttcgcagaggttttgtgatttggatgaaattacaatgccagatgcaccggtttttgaggacatgcatgagtggcttcagactatggctgctgaaccattaagatcacctacttttgtaacatatgttaatgttagggatgtctggaactttgtggaggatgatgctgaggtttccttgtggagcttcaccgtctgaagagcatgcaatttaggctttaggtgtatttagtgtgtttagctttctttctcttcttttggtttttgtacataattaggaacggaggactacgaaaatgtacaaagaccgaaacgatataaggagatagctatctaggtaggaacataaaagtgtgaaacattgtaacttttctcattcggttgtttttgtaaaataaaaattctattttcatcaatacattatcaaagaccctccctgttagcaatcctccaaaaaaaagagagagaaaaaaaaaaaaaaaaaaaaaaaaaaaagg

SEQ ID NO: 1403 - DNA, 1014 bp, Glycine max
caacaacactctcaacaaatgaatattctcggacaatcattcaacgaatcaaacaacggaagctactcttgttcgtcgccggagactggtagctcctctaacattccaaacacttttcactccgacgaggaagtgcacacactagcttcggcgcgtcctaagaaacgtgcggggcgtcgaatttttaaggagacaagacacccggtgtaccgaggagtacgaaggaggaacaacaacaagtgggtctgcgaggttcgtgttcccaacgacaagtccaccaggatttggcttggaacgtatccagtgcctgagatggccgcacgtgcgcacgacgtcgccgcgctcgcgcttcggggcaagtcggcttgcctcaacttcgccgactcggcgtggcggctgcccttgccggcgtcgacaaatgcgaaggagatacggcgagtggcggcggcggctgctgtagcgattgcggcggaagacagctgcggcgagcagttacagaatagtattgtgaatgatgccgttgctgatgattgtgaagttagcagaagtgacgtcagctttgatgaagattccaatagcaacaaaggtttgagagttttttgtgatttggatgaaattacaatggcagatgcaccggtttttgaggacatgcgtgagtggcttcagagtatggcggatgagcctttaagatcgcctacttttgtaacatatgttaatgttagggatgtctggaactttgtggaggatgatgctgaggtatccttgtggagcttcacaatttagtgcgtttagtttgttctttgtcttctttcgtttttggtttttgtacataattaggaacggaggagtacgaaaatgtaccaagaccgagacgatataaggagctagctatatagggaggatcataaaactgtaagacattgcaaattttctcattcagttgtttttgtaattctcataatcatatagataaaggaaaggtttgtaaaataaaaaaaaaaaaaaaaaaaaagg

SEQ ID NO: 1404 - DNA, 1252 bp, Glycine max
ctcgacccactcactctatctcttttctccagcagcaccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaagtttatgtataaattaaataaaagaaaaatctagttttggttatgaatctttgttaaagtagaaatcgttctttggagagtctgcaggccaatgtgcataggctcaaaacagg

SEQ ID NO: 1405 - DNA, 1162 bp, Glycine max
ccctcattcactctcttttctccggcagcaccaaaaccacccaacacttgaaatcaatatccattgttaccaaaaaagaaaagatcaaaacaccctttacatcattatactcagttccctctttccctatcaaaaccctttcccacaacactactcactctagtagtacaagcaaaaccttctaactttggcttcagcggcacatatatatatatatatgaacatgtataccttgaaccactcttcatatttgtaccatgtttcccctgagctctcctcttccttggactcgtcctcgccggcttccgagggctctcgcggcgtggcattttccgacgaggaggtgcggctggcggtgaggcacccgaagaagcgggccgggcggaagaagttccgggagacgcgccacccggtgtaccggggcgtgaggaggaggaacacggataagtgggtaagtgaggtgagggagcccaacaaaaagaccaggatttggctggggacttttcccacgccggagatggcggcacgggcccacgacgtggcggcaatggccctgaggggccggtatgcctgtctcaacttcgctgactcgacgtggcggttaccaattcccgccactgctaacgcaaaggatatacagaaagcagcagcagaggctgccgaggctttcagaccaagtcagaccttagaaaatacgaatacaaagcaagagtgtgtaaaagtggtgacgacaacaacgatcacagaacaaaaacgaggaatgttttatacggaggaagaagagcaagtgttagatatgcctgagttgcttaggaatatggtgcttatgtccccaacacattgcatagggtatgagtatgaagatgctgacttggatgctcaagatgctgaggtgtccctatggagtttctcaatttaataacgtgcttttggtttggttttttatgttagttttggagtgtgactgtctgtactggttttttattagtagtacggatactagctataggtggcagattgaaagggaccaaaaggaattttcttttgaaaccctttttgtcaaagtaatcaatcgcgtatcatcaagtgaatcccttgatcaagtttatgtatgaattaaataaaagaagaatctagttttggtaaaaaaaaaaaaaaaagg

SEQ ID NO: 1406 - DNA, 800 bp, Glycine max
aattcggcaccaggttagttactactaactaccccttttgcacacgttgtctcattcactcaaacaacttcaaagaacgaagcttttcaccaagtaacatgttttccatcaatcatttctccgacccagatgccacctcgccggggtcgggaggaagctcccgaccggcgctgtcggacgaggatttttttctggcggcaagcaatcccaagaaacgcgccgggaggaagaagttccgggagacgcgccacccggtgtaccgcggcgtgagaaggcgggactccggcaagtgggtgtgcgaggtgcgcgagcccaacaagaagtccaggatttggctcgggacctttcccacggcggagatggcggcgcgtgcgcatgacgtggcggcgatcgcgctgaggggaaggtcagcctgcctcaacttcgccgactccgcgtctcggctcccggtgccggcgacggcggaggccagggacattcagaaggctgcggcggaggccgcagaggcgtttcgccctgggaaggatgatgatgcggtggcggagagggtggcagcgacggcgacggagcgtgaagaagaacaagaagaagggatggtgccggagtatctgaggaacatggtgctcatgtcgccgacgcattgcttcgggagtgatgagtatggaagtgctgacgtggaatttgacgatgctgaagtttctctgtggagttactccatttaatttaactcagttattggattttttttttactattttgagtaatgtaaagattgttcgtatgggacaagtagaatagtg

SEQ ID NO: 1407 - DNA, 974 bp, Glycine max
attcggctccggaaactccaaatacctcactccacagttgaacaacaacaccaacaccaacttctggaatgaacattttcaaatccccactggaccatgatttgaactgtggtggaatattccacgactcagcagaagcatcttattcgtctgaaacaaggagcaccccctcagacgaagaagtgattctagcgtcagcgcggccaaagaagcgagcgggaagaagagtcttcaaggagacaaggcaccccgtctaccgaggagtgcgtcgcaggaacaagaacaagtgggtctgcgagatgcgagtccccaacaacaactcacggatttggctcgggacatacccaacgcccgaaatggccgcacgtgcgcacgacgttgcggcgctcgcgctcaggggaaagtccgcgtgcctcaacttcgcggactccaggtggcggctgacggtgccggcgaccaccaacgcggaggagatacggcgagcggcgggggaggctgctgaggcatttgcagttgcagatggggacgacgttaatattgaacaacagcagagtgtgatggccacgaatgatgatgaagttcaagagcctctccagcaggaggaggttcaagacttgcatgatttgcttttgagtattgcgaatgagcctttgatgtctcctccaccctgtgcaagagatggtagggactggaatgacgtggacatatttgatgatgatgaaatctcactatggaacttctcaatttgacgcgtacgtcattaagagtatgactgtatgcatgtttgatgataagcgaaaacacctttttgtgtatgtgattttctatatttttagggacctgttgtgtgtagataaattaagtagcactcgattgattaagttgagtggagttaaacatattgtagttgtatctatgatttgtttcgtgattaaattttaatgacaagtacagttggcaaattcaaaaaaaaa

SEQ ID NO: 1408 - DNA, 883 bp, Glycine max
attcggctcgagtgggatttttagtccattgaattggatatatttatcctcatacatgatcttaggagacatttgtttttggtaaccactcgtcccaagcctaaataagttaaaacacagaagaaaatgcagaagcggagggcagggaggaagaagttccacgagacacgacacccggtgtacaagggagtgaggcagaggaacgggaagtgggtaagcgagctgcgacaacctaacaacaaaaacgcgcgggtgtggctcggaacattcgcgcaccccgacatggctgctatagcgtacgatgttgccgccttggctttcaagggcgacagtgcttccttaaacttcccgaacgccgccacctcgtttccccgccttaactcgcggacgtgttccgttagggccattcagtttgcggcgacgcaggcggcggagaagcatttttcttgtgtagagtctcaacaactccaaagggagggatcaggctccggaagcttctctttggacgatgattcttcggagttttcgtcccaaggaaggttcttttgggatgaagaggaagtgtttaacatgccggagttgctgaactgcatggcggaagcgctgattatcacaccgccggcgttggaaagagggttcaattgggttggtggcgaaacgactgtggatttgactctgtggtgaaactgatgaccacttaggttctctgcaaaccagagaggaacttgcaatttcgatctgttgcaaaatattatatatactaatagtctaaagatgtagttcatcatatatactagtactgatacattcaaaagttatatagcgtttgctgtatggttgagattttcgtcaaaaacaagctgtatcataaatcttttctgtt

SEQ ID NO: 1409 - DNA, 1014 bp, Oryza sativa
tttttttttttttttaacgtaaatccaaaatccttaaaatcattgttgttcttgaccaaaatagctctttggagaggagaagtaaatttacaggaattcattgactgcacattcaaaatcagatggaatcacaaaaggagggagaaatctggcacattccaaaattacaaaaattgccattcatcctcagtctcattgcctactctgttctaaattcaccaatactctgttctcttttttcccccaatttctggagaatcaaaatttgtccacacttttcagtgcgagattttgattagtagctccagagcggcatgtcggagccggcgagctcgccgtcctcccaccacgctccggcggccggcggctcgacgagcagcccctgcgccaagctcgcgtagtacgacccggcgtccatcccgccgaacctgaacccgtcgtcgagctcgaacgcccccgcgtcgaacacctccgccgccgccaccggcaacacgtccttgttgtcttcttcttcgtcgccatcgttggcgaaggtctccgccggagacgacggcgcggccgactggcgctggaacgcctcgacggccacggcgacggcgtccctgacccccctcgcgccggcgagcgcggcggacgcggggacgggcggcatccgccacgcggagtcggcgaagttgaggcaggcggccctgccgcggagcgccagcgcggcggcgtcgtgcgcgcgcgccgccgcctcggcggtggcgaacgtgccgagccacagcctggagccgcgcgccccgggcacccgcacctcgcacacccacctccccgccgcgcccggccgccccccgcgccgccgcacgccgcggtacaccgggtgcctcgtctccctgaacttggtccttcccgccggcctcttcggcggctccgaccacaccgtcctgtacgccgcctcctccacctccatggatgactctctctggttcacttcgccggccagcctgaacctcgtgccgaattcctgcagcc

SEQ ID NO: 1410 - protein, 236 aa, Oryza sativa
MEKNTTAMGQLMSSSATTAATATGPASPKRPAGRTKFQETRHPVFRGVRRRGRAGRWVCEVRVPGSRGDRLWVGTFDTAEEAARAHDAAMLALCGASASLNFADSAWLLHVPRAPVASGHDQLPDVQRAASEAVAEFQRRGSTAATATATSGDAASTAPPSSSPVLSPNDDNASSASTPAVAAALDHGDMFGGMRTDLYFASLAQGLLIEPPPPPTTAEGFCDDEGCGGAEMELWS

SEQ ID NO: 1411 - protein, 219 aa, Oryza sativa
MDTEDTSSASSSSVSPPSSPGGGHHHRLPPKRRAGRKKFRETRHPVYRGVRARAGGSRWVCEVREPQAQARIWLGTYPTPEMAARAHDVAAIALRGERGAELNFPDSPSTLPRARTASPEDIRLAAAQAAELYRRPPPPLALPEDPQEGTSGGGATATSGRPAAVFVDEDAIFDMPGLIDDMARGMMLTPPAIGRSLDDWAAIDDDDDHYHMDYKLWMD

SEQ ID NO: 1412 - protein, 219 aa, Oryza sativa
MEWAYYGSGYSSSGTPSPVGGDGDEDSYMTVSSAPPKRRAGRTKFKETRHPVYKGVRSRNPGRWVCEVREPHGKQRIWLGTFETAEMAARAHDVAAMALRGRAACLNFADSPRRLRVPPLGAGHEEIRRAAVEAAELFRPAPGQHNAAAEAAAAVAAQATAASAELFADFPCYPMDGLEFEMQGYLDMAQGMLIEPPPLAGQSTWAEEDYDCEVNLWSY

SEQ ID NO: 1413 - protein, 214 aa, Oryza sativa
MEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEASAAAAPAMMMQYQDDMAATPSSYDYAYYGNMDFDQPSYYYDGMGGGGEYQSWQMDGDDDGGAGGYGGGDVTLWSY

SEQ ID NO: 1414 - DNA, 430 bp, Oryza sativa
gcacgagggacacactgccacagacacaatccatagcttagctcctctccactggagggatcgatcgatcgatggactgggcgtactccggcaacagctacggctacggctactactcgtcggggacgtcatcccctccggcgggcggcgaggacgcgtacatgacggtgtcgtcggcgccgcctaagcggcgcggggggcggaccaagttcaaggagacgaggcacccggtgtacaagggcgtgcgcagccggaaccccgggcggtgggtctgcgaggtccgggagccccacggcaggcagcgcatctggctcggcaccttcgagaccgccgagatggcggcgcgcgcgcacgacgtcgccgcgctggcgctgcggggtcgggccgcctgcctcaacttcgcggactccccgcgcaggctccgcgtccc

SEQ ID NO: 1415 - DNA, 976 bp, Zea mays
cacgcgtccgctcgaacacaaactcaggcaaggcaaaaggaacccgcaccatccgaggctcaagcagggaagtgatcatcatcatcatcagaagaagatgtgcccaaccaagaaggggatgaccggagagccgagctcgccatgcagctcggcatcagcctcgaccttaccggagcaccaccagacggtgtggacgtcgccgccgaagcggccagcggggcggaccaagttccgggagacgcggcacccggtgttccgcggcgtccggcgccggggcagcgccgggcggtgggtgtgcgaggtgcgcgtgccggggaggcgcggctgcaggctctggctcggcaccttcgacacggccgaggcggcggcccgcgcgcacgacgccgccatgctcgccctcgccggcgcgggcgcctgctgcctcaacttcgccgactcggcctggctcctcgcggtcccggcctcgtgcgccagcctcgccgaggtccgccacgcggtcgcggacgccgtggacgacttcctccgccatcagctggtcccggaggacgacgccctcgcggccacgccgtcgtcgccttccagcgaagacggcaacacctctgatggcggggagtcctcctctgattcctctccgcccaccggggcctcgccgttcgaatttgatgtgttcaacgacatgagctgggacctgcactacgcgagcttggcgcagggattgctcgtggagccaccgtccgcggtcacggcgttcatggacgaaggcttcgccgatgtgccgctctggagctactagagactgaaattttccgtttctttgcttggcctgtggcgcctaattttggcagtgtaaaacggttacttcttttggtaatgagatggaacaagtttgcgaaacatgaaaacagagcatgctaatcgacattttcgcgcggccgaaaaaaaaaaaaaaaaaaaaaaaaaaaaaaaaaaaaaaaag

SEQ ID NO: 1416 - DNA, 543 bp, Zea mays
gacccacgcgtccgcccacgcgtccgagcagcgaaggtagccacaacatccactcgactgactactcgagagctaagaaactgttcaacaggtgatccagaacaagatgtgtccaaccaagaaggagatgagtgccgagtcgtcgggctcggcgagcagctggacttcggcctcgacctcgacctcgccggagcaccagaccgtgtggacgtcgccgccgaagcggcccgcggggcggaccaagttccgcgagacgcggcaccccgtgttccgtggcgtccggcgccgcggcagcgccgggcggtgggtgtgcgaggtgcgcgtgcccgggaggcgcgggtgcaggctctggctcggcacgttcgacgccgccgaggccgccgcgcgcgcgcacgacgccgccatgctcgccatcgccggcgcgagcgcgtgcctcaacttcgccgactccgcgtggctgctcgcggtccccgcctcgtacgccagccttgccgaggtccgccgtgcggtcgccgaggccgtggaggactttcagcgccgcga

SEQ ID NO: 1417 - DNA, 1065 bp, Zea mays
cgcgcgcgtcgccgcccgcctcatcagccatcgcgttccgcatcgaaccagcacatcgcaagacaagcagcagcagccaccactgccatcacatggagtacgccgccgtcggctacggctacgggtacgggtacgacgagcgccaggagccggcggagtccgcggacggcggcggcggcggcgacgacgagtacgcgacggtgctgtcggcgccacccaagcggccggcggggcggaccaagttccgggagacgcggcaccccgtgtaccgcggcgtgcggcggcgcgggcccgcggggcgctgggtgtgcgaggtccgcgagcccaacaagaagtcgcgcatctggctcggcaccttcgccacccccgaggccgccgcgcgcgcgcacgacgtggccgcgctggccctgcggggccgcgccgcgtgcctcaacttcgccgactcggcgcgcctgctccaggtcgaccccgccacgctcgccacccccgacgacatccgccgcgccgccatccagctcgccgacgccgcctcgcagcaggatgagactgccgccgttgccgctgacgtggtcgcgccctcgcaggcggacgacgtcgccgccgccgccgccgccgccgcggcggcggcgatgtacggcggcggcatggagttcgaccactcgtattgctacgacgacgggatggtgagcgggagcagcgactgctggcagagcggcggcggcggatggcatagcagcgtggacggcgacgacgacggcgccggcgacatgacgctctggagctactgagctgtagagtctgtctccagcgcaggaggttgggagaggagaccacgctctggagctactactggacagggaagaaagtgggggagccgggagcgagttcgaatttgaattcagaaactctgtactggcactggcacacgcggggaacgcgccacgcaagagcgagcgctatttccctccctttttgggtgctgggagaataataaaaagaccaacaatgaaggcattagtactaaaaaaaaatactatagcataaaaaaaaaagggcggccgctct

SEQ ID NO: 1418 - DNA, 994 bp, Zea mays
ccacgcgccccctcagctcaatcccgagacaaaggaacccacctccactcccaccagcaagctcaagcaagcagccaccaccagcagcgatcagcggcagccatggacatgggccggcaccagctccagctccagcacgcggcctcctcgtcctccacctcggcgtcgtcctcgtccgagcaggacaagccgctctgctgctctggtcccaagaagcgccccgcggggcgcaccaagttccgggagacgcggcacccggtgttccgcggcgtgcggcggcggggcgccgcggggcggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgcggcctgcctcaacttccccgactccgcgtggctgctcgccgtgccgcccccgcccgcgctctcgggcggcctggacggcgcccgccgggccgcgctcgaggccgtcgcggagttccagagacgccgcttcggggcggcagccgccgacgaagcgacctcgggcacgtctcctccctcctcctcctcctcggcgacgaagccggcgccggcgattgagcgcgtgcctgtggaggccagtgagacggtggcgttggacggcgccgtgttcgagcccgactggttcggggacatggacttggacttgtactatgccagcctcgcggaagggctgctcgtggagccgccgccgccgccaccgcccgccgcctgggatcatggtgactgctgcgactccggagctgacgtcgcgctctggagctactagcaagctatagcagcaataagctccaccaactcatctgtactgtagtgtacttgtaccttgtaccttgtaccaaaatccaaattgatttgtagcgaattaacttaccaatcccccttggcaactccaaaaaaaaaaaaaaaaaaaaaaaaag

SEQ ID NO: 1419 - DNA, 1002 bp, Zea mays
tcgcgatctagaactagtctcagctcaatcccgagacaaaggagccctcctccacctccactcccagcagcaagctcaagcaagcagccaccacaccaccagcagtgaacagcggcagccatggacatgggccggctccagctccagctccagcacgcggcctcctcgtcctccacctcggcgtcgtcctcgtcctcgtccgagcagaacaagctggcctggtccccgtcctccccgcagccgcccaagaagcgccccgcggggcgcaccaagttccgggagacgcggcacccggtgttccgcggcgtgcggcggcggggcgccgcgggccggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgccgcctgcctcaacttccccgactccgcgtggctgctcgccgtgccgcccccgcccgcgctctcgggcggcctggacggcgcccgccgggccgcgctcgaggccgtcgcggagttccagcgacgccgcttcggggcggtagccgccgacgaagcgacctcgggcacgtctcctccctcctcctcctcgtcgccgtcgggcacttatgtctcgcaggcgccggcgccggcgattgagcgcgtgcctgtggaggccagtgagacggcggcgttggacggcgccgtgttcgagcccgactggttccgggacatggacttggacttgtactatgccagcctcgcggaagggctgctcgtggagccgccgccaccgcccgccgcctgggatcatggtgactgctcccactccggagctgacgtcgcgctctggagctactagcaagctatagcagcaataagcttggcaatgccaccaactcatctgtactgtactgtacttgtaccctgtaccaaaatccaaattgatttccagcaaattaacttaccaatc

SEQ ID NO: 1420 - DNA, 642 bp, Glycine max
  misc_feature (562)..(562): n is a, c, g, or t
tcacctcatcatctatcattatatctttctttcaattcctatcctcttccttgtagtgtacccattttgaatgtgttctctctctctctctctttctttaggtccctggtgaatatctagaaccactctctagctagtttctctcttcttgctagctagctatcgccgatcactctcttggtttaaaccacctgaatgccggaaaacatgagcatatcagtgaatggtcaatctcaagtccctcctggcttcaggtttcatccaactgaagaagagcttcttcagtactacttgaggaagaaggtctcttacgagaagattgacctcgacgtgattcgtgacgttgatctcaacaagctcgagccatgggacatacaagagaaatgcaaaataggaaccactccgcagaatgattggtacttcttcagccacaaagacaagaagtaccccacaggaacgcgcaccaatcgcgcaactgctgcagggttctggaaggccactggccgcgacaaagtcatctacagcaatggaaagaggattggaatgagaaagactctggttntctacaaaggaagagcgccacatggccagaaatccgattggatcatgcatgaatacagactagacgacaccacaccagcg

SEQ ID NO: 1421 - DNA, 497 bp, Glycine max
gaaagaggaagacctactctctatctttaaacatgatccgggagagaataggggactcactcttcctatatttaccatcctaccatgaaggaaatagggggccttcacacttttggtttaaaccacctgtttgccggaacacattaccctgccaggtagtgcacaagctccagtgcctcctgggttcccgactcatccgactgaagaacagcttattcaccactactagacgaagaggtctcttacgagaagaggacctcgacgtgattcgtgacgttgatctcaacaagctcgagccatgggacatacaagagaaatgcaaaataggaaccactccgcagaatgattggtacttcttcagccacaaagacaagaagtaccccacaggaacgcgcaccaatcgcgcaactgctgcagggttctggaaggccactggccgcgacaaagtcatcttcagctatggaaagaggattggaatgagaaaaaactctgttttc

SEQ ID NO: 1422 - DNA, 1034 bp, Oryza sativa
  misc_feature (4)..(4): n is a, c, g, or t
  misc_feature (199)..(199): n is a, c, g, or t
  misc_feature (205)..(205): n is a, c, g, or t
catngtgtcatggctccatcaccacctagcagctctacacctctctcttatattagctctctctctctctctacccccattcatgctcatctccttctagcttccagcttaatcccttccttgtcaatgttaatggacaaactctgagcattgcactacccatcatctcctagctagactcaccttagcttgtctcttngcgtcnctagtgtgtgattctttctcccatttcctgtttggtttgcactgagtgaacaagcaattaagcttggtagtagtagtagttgttgtattgatcgatcgatcgatctagagacgacgatgagcatatcggtgaacgggcagtcggtggtgccaccggggttccggttccacccaacggaggaggagctcctgacatactacctgaagaagaaggtggcctcggagcgcatcgacctcgacgtcatccgcgacgtcgacctcaaccagctcgagccatgggacatccaagagaggtgcaggattgggtcagggccgcagaacgactggtacttcttcagccacagggacatgaagttcccggcggggacgaggacgaaccgggcgacgggcggccggcttctggaaggccaccgggcgcgacaaggccatctacaacgccgtccaccgcatcggcatgcgcaagacgctcgtcttctacaagggccgcgccccccacggccagaagtccgactggatcatgcacgagtaccgcctcgacgaccccgccaccgacaccgccgccgtcacacccacggttacttctgctgctgctgcggcggcggcgatggccgcggcggcggacggcgggcaggaggatggctgcgtggtgtgcagggtgttcaagaagaagcaccaccacaaggaggcccgcgggaggcggcggcaagcacggcggtcgacggcagcgcccggcgccaagggcggcgcacgcttactcctccagcgacgacgcgctcgaccagattctgcagtacatgggcaggtcgtgcatgcaggagcacgagcttccc

SEQ ID NO: 1423 - protein, 395 aa, Oryza sativa
MSISVNGQSVVPPGFRFHPTEEELLTYYLKKKVASERIDLDVIRDVDLNKLEPWDIQERCRIGSGPQNDWYFFSHKDKKYPTGTRTNRATAAGFWKATGRDKAIYSSSNRIGMRKTLVFYKGRAPHGQKSDWIMHEYRLDDPSSASASVSVNLPSYYSSSSSSSSPMHGVAGDQGAQEEGWVICRVFKKKNLVHHGGGAAAASHHAAAKLAAAAMEGSPSNCSTVTVSDHVKAQMLHSSASDDALDHILQYMGRSGCKQETKPAAMSASSAAAAAALEQHLSTPQYGKFMKLPPLEHVAGGVGLLAAAGGGGEYCSAADASGIADWDTLDRLAASYELNGALSDVASGKNMAGFFDVVDQPAGAAAFSSGDGDLWSLARSVSSSLHADLTTMNNV

SEQ ID NO: 1424 - DNA, 633 bp, Zea mays
  misc_feature (9)..(9): n is a, c, g, or t
  misc_feature (572)..(572): n is a, c, g, or t
ggtaccctnccgagcctggccgggctgccaccagcaattcccttccattcctcacatcgtcttcctcctctggccttcccatcttcttcctctcgtcctcgatcgatcatcctgctaactagctagaggtctggcactagctgctaactagaaaaaaggaagaaagcaagcaagctaagaaggaattgaagatcgtatcatcaatgagcatctcggtgaacgggcagtcgtgcgtgccgccggggttccggttccaccccacggaggaggagctgctcaactactacctccgcaagaaggtggcctcccagcagatcgacctcgatgtcatccgcgacgtcgacctcaacaagctcgagccatgggacatccaagagagatgcaagatcgggtcgggtccccagaacgactggtacttcttcagccacaaggacaagaagtacccgacggggacgcgcaccaaccgcgctacggccgccggcttctggaaggccaccggccgcgacaaggccatctacagcgccgtcaggcgcatgggcatgcgcaagacgctcgtcttctaccggggccgngcgccgtacggacacaagtccgactggatcatgcacgagaattgactggacaaccctgact

SEQ ID NO: 1425 - DNA, 1203 bp, Zea mays
ccacgcgtccgcccacgcgtccgcccacgcgtccgcccacgcgtccgcccacgcgtccgcccacgcgtccgcccacgcgtccgcccacgcgtccgcggacgcgtgggatcgtcttcctcccctcacatcctctggcctctggtcctccaccgtcctgctagccagagctgctcttgtacgcgcagctggcctctgtgcatatcaccagcacaccgcgcaggggaaggaaattaacaagagaaaaggcaaggagagcaggcaggcaaggaagctgcagaagccaaggaaggagaaggaggatcatcaatgagcatctcggtgaacgggcagtcgtgcgtgccgccggggttccgcttccaccccacggaggaggagctgctcaactactacctccgcaagaaggtggcctcccaggagatcgacctcgacgtcatccgcgacgtcgacctcaacaagctcgagccatgggacatccaagagaaatgcaagatcgggtcgggtccccagaacgactggtacttcttcagccacaaggacaagaagtacccgacggggacgcgcaccaaccgcgccacggccgccgggttctggaaggccaccggccgcgacaaggccatctacaacgccgtcaagcgcatcggcatgcgcaagacgctcgtcttctacaagggccgcgcgccgcacggccagaagtccgactggatcatgcacgagtaccgcctcgacgaccccgctgctgctgctgctgctggatccggtgatgccgtggccaacgacgacgcagccgccacggctgctgctgctgccgccgcgtcgtcggacggcgggcaggaggacggctgggtggtgtgcagggtgttcaagaagaagcaccaccacaaggagtcaggtgggggcgggggcaacaagcacggcagcagtaacagcgagcatgggcacggcggcgccggcaaggcatcggctgcggctgcggctgcggcgcaccagcaccagcaccatggaggcctgcagtactcctccagcgacgaggcgctggaccagatcctgcagtacatgggcaggtcgtgcaagcaggagcacgagctggtgtcgccggcgccggcgccgccgggacgggcggcggcgtccaggtacctccggcccatcgagaccgttctgggcgggcacgcgttcatgaagcttcccgcgctcgagagcccgtcc

SEQ ID NO: 1426 - DNA, 820 bp, Zea mays
  misc_feature (750)..(751): n is a, c, g, or t
  misc_feature (755)..(755): n is a, c, g, or t
  misc_feature (758)..(758): n is a, c, g, or t
gccggccggttctgggtacccggcttccctcgtcaccggctccggctccggcaccggctcaatacaatcccatcaccaatcattcattccctttgcctactactgctaccttctcctccttccatcttcgatagacgacgaaataatggcggtattcgacgtctgaatcctcgtactcttatactgcatacatacagacagacccttcttcttccttagttccctatagctctagctaggcgaccgatcatgagcatctcggtgaacgggcagtcggtggtgccgccggggttccgtttccacccgacggaggaggagctgctgacctactacctgaagaagaaggtggcgtcggagcgcatcgacctggacgtcatccgcgacgtcgacctgaacaagctggagccatgggacatccaagagaagtgccgcatcggttcgggcccccagaacgactggtacttcttcagccacaaggacaagaagtacccgacggggacgcgcaccaaccgcgccaccgccgccgggttctggaaggccaccggccgcgacaaggccatctacgcctcgccgggcgcccgccgcatcggcatgcgcaagacgctcgtcttctacaagggccgcgccccgcacgggcagaagtccgactggatcatgcacgagtaccgcctcgaggcgcccgtcgacgccggagccggcgccgcgcaccacctgctgctccccgccgccgaacatcctccctactacacnntcgncgncgcaggcggcttcttcaatactaccgcaacgatcccgtggcgcggcgggagaccagcgggca

SEQ ID NO: 1427 - DNA, 1465 bp, Glycine max
tacggctgcgagaagacgacagaccgcgaagagtgaaactgccaaaaagtgaggccaccccaaaaacaaagtgagattataggaaacaaaaatttctttgcttaatactagttcctcctttctcctagcctggtagtcttttgaaaattctttatcttgatcacataattttcattttgaacttgaagaaagttttagtgtatttttttttccttaaagaaacagaacatatcctgttctttctttctctgtttgcatttttgttcacttctttctttctttctttctttcttattatctagttaagcatgacaacatttatggacatgtacaacactactagtagcatcatgacaccggatttcttagaccagtgtagtgatcaagagctgatgaaagcacttgagccttttatgaaaagtgattcatctagcactacttcctcatcaataacaacatacccttcattctcttctttttcttcttctcccaacttgtcctcaacaacatggagcacccaattttgctcctcaagctaccaccaaaagggtccaactccaacccaagctagttccttcaaactgaaccaactcaccccatcacaaatatttcaaattcaagcccaaatccaggttccacgagcccagtttctcagcccaaagcccattcccatgaagcacgtgcgggcttctccttcttcaaagcccacgaagctttaccgtggggtgaggcagagacactggggcaagtgggtcgctgagatcagactccccaagaaccgaacacgtctctggctaggtacatttgacaccgcagaggaagcagcgttggcttacgacaacgcagcgtttaagctaagaggagaaaacgcgaggctcaacttccctcacctgcgtcaccatggagcacgcgcgtacggtgagtttgggaactacaagcctctcccctctgcggtcgatgcgaagcttcaagccatttgtcaaagcttggggaccaattcgcagaaactcaaaactcaaaaccctattgttctagatacacacaaggcagagacagagacatcggagtttcaggattttaataaggttgagaattaccaaacatcatcgtcctcggccttctccgatgaatattcttcttcttcttcttcttcttcacctgaatccgatattaccctcttggatttctcggattcttgtgaaacaatggacaatcttgggttggacttggagaagtacccttccgtggagattgattgggcagctttatctgactcatgaataatcagtggttaacgggtatagtttagatttgatgtgttttaggttgcttttgtttgtttttttcttgttaatcagtgttttagatattgttttggaagttcttctaaatcacagcgcattataatgtcactgtgactgataaattattaagccattaatcgaataaaattttacacaatcac

SEQ ID NO: 1428 - DNA, 1245 bp, Glycine max
ggttctagaacttccatgagctcacctctgaatggatctgcctcaacttgttcttgtgatttcccttcctcttctttactttctccacaccccaatttctacacacacactccccccccttcctacttactccaaagccaacaatccttaataggctttgagcaaccaccgagttcccttctcgggctcaaccacctaagcccgtctcagatttctcagatccaggcccagatcgaggcccaacagagccaaaaccagaacccacactctctcaactttctcggcccgaagcccgtcccaatgaagcacgtgggcgggcctccgaagcccacgaagctgtaccggggcgtaaggcagaggcattgggggaagtgggtggcggagatcaggctcccgaagaaccgaaccaggctctggctcggaaccttcgacacggcggaggaagctgctttggcttacgacaaagccgcgtataggctccgaggcgacttcgcgaggctgaacttcccgagcctgaaaggctcgtgccccggggaggagtacaagcctgtgcattccgcggtggacgctaagctcgacgcgatttgcgccaacttggcggaaatgcagaagcaagggaagacggagaaaggtgccaggtcagcgaagaaatcgaagcaaggtccgaaccaggaggccaagcccgaacctcaagcttccgctgaaagtgagggttctgcggattcttctccgctgtctgatcttacctttgatgtaaccgagccgcaatgggaacattttaatttgcagaagtttccttcttatgagatcgattgggattctctctgaacttcgtctttgtttttatgtctagtcttgtggctaataataataataatttaggttagtcttgctaggtggctgctgcaattgagtttttgaagattgcagtgcttcttgtaggatttcgatttttttttttttagcatttggttattggctatttggtcaatatgatgtaaatctctctaccttggtcagctgggtttttttttttttattattattttcttgcttggcctgggagaatgacttctagccttctaggtgttgtctatgctttgatgttcatccaagtatgttattattattattattgttgttgatgtaattcaattttatttgcatctcagaatttatgaatatatttgtatttcagcttaaaaaaaaaaaaaaaaaaaaaaaaaaaaaaaaaaaaaaaaaaaa

SEQ ID NO: 1429 - DNA, 1881 bp, Glycine max
ccacgcgtccgcccagagagagtttctcaccaaacacacacttctcttctcttctcttctcttcattttctgtggttctcactttcttttctctaatcttctaatctcttattttcttcccccctctgttactccccgcttctctgaatccctttctgttaatcatctgtctttcaactcgtgattttttgggtttgcctcaccaaaaagattcaaactttgaaaatttttctcgaaagccaggtgttttcagaatcgagatccagctttttttttgtttgtttttaaaaaattattattttctttcgttcagccgcgagggttgtttttgatccctcaaaagctctctttctttttttctttcttggatttaaggggttgtctattttaaacctctcccatccttttttgttgtaatatttaaaaaccacaggttgatttttttaatctaagatctgtgtgtgtagttggaaaattgaatttttatatggcagctacgatgaatttctacaacgaaacatcacaacaagttcagtcagatccattcagaggagagctcatggaagttctagaaccttttatgaaaacttgtccttcctcaactccctctattctctcctcagattcaccatcaccttcctcttactctcctttactacctccacaccccagtttctccacatacaccccctctgcctacttattccaaaaccaacaacccttaataggctttgagcaacaaccaagttcccttctcgggctcaaccacctaagcacgtctcagatttcccagatccaagcccaagcccaagcccagaactcgctctctcttaatttcttgggccccaagcccgttcctatgaagcacgttggtgggccggcgaagcccacgaagctgtaccggggcgtgaggcagaggcattgggggaagtgggtggcggagataaggctaccgaagaaccgaaccaggctttggctcggaaccttcgacacagccgaggaagccgctttggcttacgacaaagccgcgtacaggctccgaggcgacttggcgaggctgaacttcccgaacctgaaaggctcgtgccccggcgaggagtacaagcctatgcaggctgcggtggacgctaagctcgacgcaatctgcgcgaacttggcggaaatgcagaagcaagggaagaacgagaagggtgccaggtcggggaagaagtcgaagcaaggtccgaacctggaggcgaagcccgaacctgaagcttcgggttccggtgctgctgctctgtctcctgaaagtgagggttctgcggattcttctgctttgtctgatcttacctttgatgtaaccgagccgcaatgggaggatgcttcagcacattttaatttgcaaaagtttccttcttatgagatcgattgggattctctctgaagactctttgtttttttatttttatgtctagtcttgtgggtaattaataatttagttataattaggattgctcttgtggctgctgcaattgagtttttgaagattgcagtgctacttgtaggatttggattatgttagtcttttttctttttcttttttttttttaaatttgcttattggctattcgatggtcaatatgatgtaaatctctctaccttggtcagctggttttttttttcttgcttggccatggagaatgattccgggttaggtctttgtctatgttttagtgttcgtccaagtactattattgatgtaattcaattctatttgtatctcaatttatgaatgtatttgtatttcagcttacatattgtactagtttgtttcacacttgggccctcgtggtagttgtgtttggttcttgtatgaacaatcgattttattttctttgtggc

SEQ ID NO: 1430 - DNA, 1203 bp, Glycine max
  misc_feature (1058)..(1058): n is a, c, g, or t
  misc_feature (1128)..(1128): n is a, c, g, or t
  misc_feature (1142)..(1142): n is a, c, g, or t
  misc_feature (1158)..(1158): n is a, c, g, or t
gatccaagagtgacccgagacacagattcttaccaaataaacaaacaaaaaaacacacacacacacactttccattttctgtggttcttcttctcacttctctaatcttctcccccctctgttactccccgcttctctgaatccctttctgttaatcatctgtctttcacctcgtgattccaaaaagattcaaactttgaaaatttttctcgaaagccaggtgttttcagaatcgagatccagtttctttttatccttttgttaagaaattattattttctttcattcagccaagagggttgtttttgatccctcaaagcttttttctttcttcttggattaaaggggttgtctattttaaacctcttccatccctttttttttataaaaaaaattattatttttttttgtaatttttaaaagaaacgcaggttgatttttttaatctaagatctgtgtggtgtagttggaaaatttttatatggcagctacgatgaatttctacaacggaacatcacaagaacaagttgagtcagatccattcagaggtgagctcatggaagttctagaaccttttatgaaaactagtccttcctcaacaactccctctattattctctcttcagattcaccttcatcttcatcttttaatttcccttcctcttctttactttctccacaccccaatttctacacacacactccccccccttcctacttactccaaagccaacaatccttaataggctttgagcaaccaccgagttcccttctcgggctcaaccacctaagcccgtctcagatttctcagatccaggcccagatcgaggcccaacagagccaaaaccagaacccacactctctcaactttctcggcccgaagcccgtcccaatgaagcacgtgggcgggcctccgaagcccacgaagctgtaccggggcgtaaggcagaggcattgggggaagtgggtggcggagatcaggctcccgaagaaccgaaccaggctctggctcggaaccttcgacacggcggaggaagctgctttggcttacgacaagnccgcgtataggctccgaggcgacttcgcgaggctgaacttcccgagcctgaaaggctcgtgccccggggnaggagtacaagccntgtgcatttccgcggntggacgctaagctcgacgcgatttgcgcccacttggcggaaatgc

SEQ ID NO: 1431 - DNA, 1785 bp, Glycine max
ccacgcgtccgcggacgcgtgggcggacgcgtgggcgagaggtacttgctcacagatatattttttttttttgtctccatcattttctcgagagctttcagtttctgtggttcatctttcttcttcttaatctttccccccctctctgtaacatcccgcttctctgaatccctttctgctaatcatctgtctttcaagctaagattttctggtttgtcttttaattcaccaaaaagcaaacttagaaggatttttcgaaagccaggtgttttcagaaacgagatccaggttttattgtcgaatttcgctagtcatattaatatttcatcattttttttttcctttgaaaccagccaagagggttatttttgatccctcaaagctaatttctcattttcttttccgggactgaagaggttgtctatttgaaatctccttcatcctttcctttcttgttgaaaagtttttgtttttgttttaattaaccagcagttcttcagttttagaaagacgcaggttgaattatcatggcagctatgatggatttttacagccagcagcacagagtttcaatttcactcagatccattcaggggtgaactaatggaagttcttgaaccttttatgaaaagtcctttctcaaccccttctccttcaaattcttgttttctttctacctcttactctccttcccccaacaactactctccctccctatactcaaacgggttatcatccatacccaacaccacccaaaacttaattggtttcgggcaagggcagcccacatctcttgtgggcctgaaccacctaaccccatctcagatctctcagatccaggcccaaatccagatccagaatcacagcaacacgctgagcttcctagggccgaagcccatccctatgaagcacgtgggcatgcctccgaagcccacgaagctatacagaggggttcgacagaggcactgggggaagtgggtggctgagattagactcccgaagaaccggaccaggctatggctgggaaccttcgacaccgccgaggaagccgctctggcgtacgacaaggccgcgtacaagctccgaggtgacttcgccaggctcaacttccccaacctccgacaccagggttcctccgtcggtggtgacttcggggagtataagcctcttcattccgccgttgacgccaagcttcaggccatttgcgagggccctggctgagctgcagaaacaggggaagaccgagaagcctccgaggaaaacgcgatccaaactcgcttctccgccagagaacgacaacaacaacgacaacaactcttgtaaggtcgaagctgcttcctcctcttctgaaggttcttcgccgctttcggttctgactttcgctgacgtcagcgagccgcagtgggaaggtgattcggataattttaatctccagaagtacccctcttatgagatcgactgggattctctgtgaagccgtgttttcttagtgtcctatgttgttatgtaagggtattaatcttcattatgtatggtctagtctaggtcttagtgtcttctcaggtggctgctactgcaatggagtttttggcaattgcagagcccagtcttagttaattactagtattctgtgtataatctctctctaccttgggtcatagctggtttttttcttgcttgaccagggagaattagtccacttaatatgtttctcaagtggcatcgctgtaatctactacttttaattataaaaatatggatttattattgtaaaaaaaaaacacc

SEQ ID NO: 1432 - DNA, 1911 bp, Glycine max
ctcgagccgcgagaggtacttactcacagatatatttttttttttttgtctccatcattttctcgagagctttcagtttgtgtggttcatctttcttcttctccttccctcccccctctgtaacaccccgcttctctgaatccctttctgttaatcatctgtctttcaagctaagattttcgggtttgtctattaattcaccaagaagcaaacttagaaggatttttcgaaagccaggtgttttcagaaacgagatccaggttttattgtcgaatttcgctagtcaaattaattttcataattatttttttctttgaaaccagccaagagggttatttttgatccctcaaagctaatttctctctctctttttttatttccgggactgaagaggttgtctatttgaaatctccttcatcctttcctttcttgtagaaaactttttaaatttttttgtcagtgggtgttttaattaaccacctgttcttcaagttttagaaagacgcaggttgaattaattagtatcatggcagctttgatggatttttacagcagcaggcccagagtttcaacttcactcagatccattcaggggagaactaatggaagttcttgaaccttttatgaaaagtccttctcccaactatttcccttcctccccctccctccctaatctttactcaaacgggttatccagcaacacccaaagcttaattgggcttcgggcaagcgcaacccacatctcttgtgggcctgaaccacctaaccccatctcagatctctcagatccaagcccaaatccagatccaggcccagcagcatcagaatcgcagcaacaccctgagcttccttgggccgaagcccatccccatgaagcacgcgggcatgcctccgaagcccacgaagctttacagaggggtgagaacagaggcactggggaaagtgggtggctgagatcagacttcccaagaaccggaccaggctgtggctgggaaccttcgacaccgccgaggaagccgctctggcatacgacaaggccgcgtacaagctccgaggtgacttcgccagggctcaactttcccaaaccctgcgacaccaggggttcctccgtcggtggtgatttcggggagtacaagcctcttcattccgctgttgacgccaagcttcaggccatttgcgaaggcctggctgagctgcagaaacaggggaagaccgagaagcctccgaggaagtcgcgttccaaactcgcggagaaggttgtttccgacaaggagaacaacaactcttgtaaggtggaagctgcgtcctggtcgtcggaaggttcttcgccgctttcggatctgacgtttgctgacgtgagcgaggctcagtgggaaggtgattcggataattataatctccagaagtacccctcttatgagatcgattgggattctctgtgaagtgtcctattatgtatggtctagtctaggtcttagtgtctcttaggtggctgctactgcaatggagtttttggcaattgcagggctagtactattctgtgtataatctctctaccttgctcacagctggtttttttcttgcttgaccagggagaattagtccgcttaatatgtttttcaagtgcatcgctgtaatctacttcaatttcatcatcttataaaatatattattctactaattctgtgttaacaattcctgaattaatgtatacactcttcattcttcaacatagcatgcaggtctatacaggaaatacactctgttcaacagctgacattcaatgagctacatgacgtcggtcacttctctacgatgttaatcttttttcccactataacactatgtttggtttggaaaagaaagtggaaggaaagaaagtggaagtaaagaaagtgattcgtgaaggct

SEQ ID NO: 1433 - DNA, 903 bp, Oryza sativa
gcacgagggagagaactagtctcgagtttttttttttttttttttttttttttttttttttttgggtttttgatacagttaattcacagtagttctattacaggtagttaccaacaattgattacaacaacctacatgcacaagtatttgtacatttgtagagttgtacaactactacactaacgagtcactgcttactagacatcggagacgccggacacaaaaacgacgccggcgagcagcctccggaacctaaaaaaccaacacaaaaagaaaaggatctacacaagaacgaacatataatccatcgcctcgccgccgcgcagaatgcctaaaacctcatctgcgccggccggcaatggcgggctatggaggagaagagctagttattgttgttgagcagcgagtcccagtcgatctcgtacgacgggtacttggtgagcgcgaacccctccgcctcgtcccacggcacctcgctgaagtccagctgctccatcgccagcggcgacgccgccgcagacgacgacgacgtctccgagccgccgtcgtcgccgccgccggagtggtcggagccggaggacgacgacgccgcggcgaccaggggcgcattgatgggcatggccctgccggcgccgcccctggacctggatgaggcgttcttggacgcggcgatggtgtcgcagatggcctggagcttggcgtccacggcggcgtcgagcgggccccgcgacgcggcgttgtccgggaagttgagccgcgccgcgtcgccgcggaggcggtacgcggcctggtcgtaggtgagcgccgcctcctcggcggtgtcgaaggtgccgagccagagcctggtgcggtacagcttctgcgcccgcgccgccgccgccgccggagcagccgccctcgtgc

SEQ ID NO: 1434 - protein, 233 aa, Oryza sativa
MGLTHLGPAQIQQIQAQFLAQQQQQRALAGAFLRPRGQPMKQSGSPPRAGPFAAVAGAAQSKLYRGVRQRHWGKWVAEIRLPKNRTRLWLGTFDTAEDAALAYDKAAFRLRGDLARLNFPTLRRGGAHLAGPLHASVDAKLTAICQSLATSSSKNTPAESAASAAEPESPKCSASTEGEDSVSAGSPPPPTPLSPPVPEMEKLDFTEAPWDESETFHLRKYPSWEIDWDSILS

SEQ ID NO: 1435 - protein, 279 aa, Oryza sativa
MYDMVVDSKELMGALAPSMVSFSYPCSEQSASSLLAGANYLTPAQVLHVQAQLQRLRRPGRRAAASPGAAAPMKRHGAVAVAAAAAARAPVKLYRGVRQRHWGKWVAEIRLPRNRTRLWLGTFDTAEEAALAYDSAAFRLRGESARLNFPELRRGGAHLGPPLHAGVDAKLHAICHGMDLPQPQPQTQSNATTTTMSTTATNTPSPFFSSESPVVKSEPVCSASESSSSADGDVSSTGSSDVVPEMQLLDFSEAPWDESESFLLHKYPSLEIDWDAILS

SEQ ID NO: 1436 - protein, 291 aa, Oryza sativa
MAAAIDLSGEELMRALEPFIRDASGSPPVCSQFSPTSPFSFPHAFAYGGGLAQQPELSPAQMHYIQARLHLQRQAAQAGPLGPRAQPMKASSSSASAAGAAATPPRPQKLYRGVRQRHWGKWVAEIRLPRNRTRLWLGTFDTAEEAALAYDQAAYRLRGDAARLNFPDNAASRGPLHASVDAKLQTLCQNIAAAKNAKKSSVSASAAATSSAPTSNCSSPSSDDASSCLESADSSPSLSPSSAATTAETPATVPEMQQLDFSEAPWDEAAAFALTKYPSYEIDWDSLLAAN

SEQ ID NO: 1437 - DNA, 1844 bp, Zea mays
  misc_feature (1806)..(1807): n is a, c, g, or t
  misc_feature (1834)..(1834): n is a, c, g, or t
ctcgactggccgtgccgtgagaaaaaacaaccggcagctcaaccaggagattagcacatacttactgctgcatcacaacactggacgacgatgtactagctactagtttactcattgctactcgcagccgccatggccgatgtctaaaatgccatcgagccaccgccactgcaaaccccaaatcgaaaattacacagagctaccattgagctgacactgactgaatcttgctgctgctactactatagcagttgtagttgatcgttcacgagaggatggaatcccagtcgatctcccaggacgggtacttgcgcaggtggaaggtctccgtctcgtcccacggcgcctcggtgaagtccagcttcgccatctccggcacgggcggcgccagcgtcggggaaggaggggagccggcggagcccgactcctcctccccctccgtcgacgccgacgccgagcacttgggggagtccgggggggacccggccgactcgtcgccggacgagccgctcttggacttggactccgacagggactggcagatggcggtcagcttggcgtccacggaggcgtgcagcgggccggcgaggcgcgcgccgcccgccgcggcggagggacgggaagttgaggcgcgccgtgtcgccgcggaggcggaaggccgcctcgtcgtaggccagcgcccgcgccctccgggcgtgtcgaaggtgccgagccacagccgcgtgcggttcttggggaggcgggatctcccgccacccacttgccccagtggcgctggcgcacgccgcggtacagcttcgactgcgccggcggcgacccggacttctttcatcggctgcgcccgcgggcccagggacccccgcgtgcaggcccctctgctgctggtgctggaacatgagctgggcctggatctgctggatctgggccgggccgagctggttcaggcccatcggcccagccacgcccggacgccgtcgaagccgcgtaaggcgacgagtagagtggcggaagctgcgagaaaggcgaggaggtgggggtgggaagaggcgaggtggtgtaggagggagggtgtaggcatgtaagaatctggggccaacgagtagcgatggtagggggaggaagcactcgttataaaaggctcgagtgctttcgcgagctcctgatccgagggggacgaggaggcgataaggtgtggcgctgttattccagtacttgtacatgtatatggctgcggccattgggagctcatatatggagaaagctggactggagctagaagaagaggcctgggcaggaacttaaaacgggaagaaataaaaggaggttgtttatgaaaacaggggtaggaaaaagtttggaaatcaggccctgttcctcaataaaagtagagaaacgaggggtgtgtttgtgcagagaaaaaaaaaaaagaagcggtgagaatccagaagagaaaaaaaggttctctggatctctgctcctcctaggagaggtgtgatgaggtgagaaaaaaaaaaatcctaacccaagaacacgcttcctttgaggattctaataaacccaaaagaagagcctcttgaaccggacctttcttgtgctgcgcgtccctgctgctaaaagaaccagagagttcagagaacgaacctgcgttgctgcgcctcggttgattttttttgctcggatcgctcaaacctcaccgtggagttgggatgggatgtggcttgttgttcttgtggggggggtggggttgagttgggacgcctctctcccaggccggcctcgaggtacccattcggtaggttgttaaannggggggggggggggggggggtgggtgnggggaggggg

SEQ ID NO: 1438 - DNA, 1803 bp, Zea mays
ctttttttttttttttttttttttttttttttttttttttttttttttttttttttttttttttttttttttttttttttttttttttttttttttttttttttttttttttttttttttttttttttttttttttttttttttttttttttttttggggaacagccgaacacagattgtttatacaacaataaaccatacaatagtagcaccaacagtagcagttcatcaaattacaactcctggacacagctagctagctgattttacaacatacatcatacggagcactactgcttgacaagcatctcctcacatcacaccgtgctgctctttacaacctgtagagcacagcacaccatctagcacaacaaaaacagctaccaggacaacggacacctgaacggccgggggggtggggtcactgacccagtgtgacacgtaccggccaccaccggagaacgccgggacacaaaaacgccgggcttcccgtcggttgtggttctctcctcctccggagaaccaaaccctaataaataacccgagatctacaactgactcaccagtgacaaggaccaaacgaatcggacggacatctacacagaacgaaccaacgaacggacggacggggattagcactaatgatccaactagtgcccgcgcaggatgtctaaaatcccatctgcgcgacggccgttaaccttctttaaccctcctcctgctgcgcgacggcagtgtgggtaggaagggagccagccagccagccagccagccagccaacaaggggcgacggattaattggcgaggagggagtcccagtcgatctcgtacgacgggtacttggtgagcgcgaagccggcggcctcgtcccacggcgcctcgctgaagtccagctgctgcatctccggcaccgtcggccctggcgaggcggacggcgacggggaccgggacgggcacgaggactcggtggcggactcgaggcaggacgaggtcgcgtcgtcggacgacggcgaggagcagcagttgctggtgggggcggacgtcgacgtagcagctgcggcggaggctggcttcttggcgcccttcttggacgcggcgatgctctggcacaggctctggagcttggcgtccgacggaggcgtggagcgggccgcgggaggcggcgttgtcggggaagttgaggcgcgccgcgtcgccgcggaggcggtaggcggcctggtcgtaggccagcgccgcctcctcggcggtgtcgaaggtgccgagccagagccgggtgcggttgcgcgggagccggatctccgccacccacttgccccagtgccgctgccgcacgccgcggtacagcttctgcggccgcgccggggcgggggccgcggacgccgacgccttcatgggctgggcacgcgggcccagcacggaggtctgcgcctggcgacgctgcaggtggaggcgggcctggatgtactgcatctgggaagggctcagctggcccgcctcgtcggccgcggcgaacgggtagttccctccgtaggaggaggcggcggcgacggcttggtggaaggagaacggcgacgaggggctaagtggctggtgcgggtggaggagcggactggatccgtgagcagaggcatcccggataaaaggctcgacgtgctctcatcagctcctcccctgacagatctatagtagcagccatctagactgtttttttttgttttttttgttttttttcctctctctctagcaaaccaagaacaaacgaagamactggcggaacccmacagccacagtaaaaaacagatc

SEQ ID NO: 1439 - DNA, 2146 bp, Zea mays
  misc_feature (2134)..(2134): n is a, c, g, or t
  misc_feature (2141)..(2142): n is a, c, g, or t
ctttatcagctgaccgatccgttataaaagacgtttttattttctctttttttttttaacagacatacaccaaaagagttaattaagttgcagcagagagatcataacaggggattgcacttactttctcgactggccgtgccgtaagaaaaaacactttttttttttttttttttttttacatacatacgccagaagagttaattaagttgcaacagaggagatcataacaggggattacactgactttctcgactggccgtgccgtgagaaaaaacaaccggcagctcaaccaggagattagcacgtacgtttacttctgcatcacaacacagccgccatggccgatgtctaaaatgccatcgatccaccgcagctgcaaaccccaaatcgaaaattacacagagctatcactgactgaaccttgctgctgctgctgctactactactaaaatactagttgtagttgatcgttcatgagaggatggaatcccagtcgatctcccaggacgggtacttgcgcaggtggaaggcctccgtttcgtcccacggcgcctcggtgaagtccagcttcgccatctccggcacgggcggcgcctgcgtcggggaaggaggggagccggcggaggccgagtcctcatccccctccgtcgacgctgagcacttgggggagtccggcagggacgcggccgactcgtcgctggacggagctgttcttggacttggactccgccaggggactggcagatggcggtgagcttggcgtccacggaggcgtggagcgggccggcgaggcgcgcgccgccgccgcggcggagggacgggaagttgaggcgcgccgtgtcgccgcggaggcggaaggccgcctcgtcgtaggccagcgccgcgccctcggcggtgtcgaaggtgccgagccacagccgcgtgcggttcttggggaggcggatctccgccacccacttgccccagtggcgctggcgcacgccgcggtacagcttcgactgcgccggcgccggcgccagcggcggcggcggcgacggcgacccggactgcttcatcggttgcgcccgcgggcccaggaacgccgcgtgcaggcccctctgctgctgctgctgctgctgctggaacatgagctgggcctggatctgctggatctgggccgcggccgagctggttcaggcccatcggcccagccacgcccgacgccgtcgaagccgcataaggcgacgagtagagtggcggaagctgcgaggaggcgtggaggaggaggtggtggcggcgggagtgggaagaggcgaggtggcgtagctggtgtaagaaggtgtaggcatgtaagaatcttgggacatggatggagaggacgagtagccatggtagggggaggaggacgaagaggaggaagcactcgttataaaaggctcgagtgctttcgcgagctcctgatccgagggggaggaggaggaggcgatctggtgtgcgctggtattgtagtacttgtacatgtcgatggctgcggccattaggtctaaagcttggatggagctagaagaaagaggctgagaggttttctttatggaaaatcaaagtagattttttttttggaaaaccagctctgttcctcaataaaagtagagaaacgaggtgggtttgtgcgaagaagaaaaaaaaacagagagagggtattgcaaaacaaccccctttcgaaggccaaaaggcggcaaggatccagaagagaaaaaaggttctctggatctctgttcctcctaggagaggtgtgatgaggtgagaaaaaaatcctaacccaagaacacgcttctcttgaggattctaaaaaaacccaatagaagagcctcttgaaccggaccttttcttgtgctgtgcgtccctgctgctaaaagaagaaccagagagatcagagaacaaacctggcgtcgctgcgtcgcggatgattttttttttgctcgggtcgctcaagcctcaccgtggagatggatggatgggatgtggctttggtggtgttcttgtggtgggggtgaggcgtgtcctcgtgccgccctcccgcagaaaaaaaggcatccactagttctagagcgccgcacacggacgttttataaacacttggggagagggtgtntcaaaanngtct

SEQ ID NO: 1440 - DNA, 1765 bp, Zea mays
tgaggtggttggctaaagttgaagacctatgtgagaaatgcctgggtgaactgtaataatacgtttgtcctgcacgagtttgttaactgcgtccctggttctcctcaaaaaaaaaaaaaaaacatgggatccccggcccccggcactcaacccaaacaccacaatccccttcaacaaacgcaccgcactccacggcagccagaaaacacaatccacacagtctccgtgaggtctgagcgaggtaggactagctctgagcgagttcttccgtcttccaggtataatccttgcaactctcactatcctcttcgcatcgctcgtctctttttgagactagttggatttctcttctttttccttggatcctactacctactagaacagagctccggagccttttagtttctggtctctgatctactcattttcttttcttccccttttggtgacataggtaggtctagttaagatctgtcgtgcctgttctttgattttagctaagaaccaggcgatttagtcttcttcttccttacaaaaaaaatccccagaaaaaaaagttgtgagtagtatattcttgtaccatttgatggccgctgctataaatctccccgggcccagcgaggatctgatgcgagcgatggagtccttcatgcaagacgacgccccatcccctctggccatgccgccggcgccgtctttcccagcggccgcagcccacggggcccagtacccggcgacccacctgagcccggcgcagatgcagttcatccaggcccagctccacctgcagccggacccggggctgggcccgcgggcgcagcccatgaagcccgccgtcccagtgccgccggcgccggcgccgcagcggcctgtgaagctgtaccgcggcgtgcggcagcgtcactggggcaagtgggtggccgagatccggctcccccggaaccgcacccgcctgtggctcgggaccttcgacaccgccgagcaggcagcgctggcctacgaccaggcggcgtaccgcctccgcggggacgcggcgcggctcaacttccccgacaacgcggagtccagggcgccgctcgaccccgccgtggacgccaagctgcaggccatctgcgccaccatcgccgccgcgtcgtcgtcatccaagaattccaaggccaagagcaaggcgatgccaatcaacgcgtccgttctggaagcggcagcggcgtctccgagcaacagctcctccgacgaaggttccggctccgggttcgggtcggacgacgagatgtcctcgtcctccccgacgccggtggtggcgccgccggtggcggacatgggacagctggatttcagcgaggttccgtgggacgaggacgagagcttcgtgctccgcaagtacccgtcctacgagatcgactgggacgcgctgctctccaactagtcgcccttcgccgacagatgtgctgttgtagttcagtagtggcagtatctctggccgccgcagatgaggttttaggcaatctgcaggccgccggcccatgtgtattaagtaggttttgctcagttgttggccccggacttcgccggcgtttttgtgaccggcgtccccgagtgcactgcattggtgtactggtctgtctgtaaaaaaaatggatctgtgacttctatagtgtgtattcaaccattgttcttagttgtgatgttactcgtgctgaaaaaaaccgccgccgggtttcgtcaaaaaaaaaaaaaaaaaaaaaaaaaaaaaaaaaaaaaaaaa

SEQ ID NO: 1441 - DNA, 458 bp, Glycine max
acgagaacactctatccctcgttctttctctctctctctctctctctctctctagccagctttggttagacaacatagttctgaccaacatggtgcaatcaaggaaattcagaggtgtgaggcaacgccattggggctcttgggtttctgagattcgtcacccattattgaaaaggagggtgtggcttgggacattcgagacagctgaggaagcagcaagagcatatgatgaggcagccattttgatgagtggaagaaatgcaaaaacaaacttcccagttggtgaaaaccaaatagtgggaaatcacagttcaaacacttcctcttcctccactacaacattgtctgcagttctgagtgcgaagctgagaaagtgttgcaagtccccttcaccttccctcacttgcctgaggcttgacactgagaattcccacattggtgtgtggcagaagcgagcg

SEQ ID NO: 1442 - DNA, 514 bp, Glycine max
gttacatatataaataaattaacttttccttctttttttttctcttttctcttcctatctttttgttgagtgcaggaagagaagggtgtggctagggacatttgagacagctgaggcagcagcaagggcatatgaccaagcagccattttgatgaatggtcagaatgcaaagaccaatttccccacctcaaagaaccaagctgaagctgatgacaacaacaacactgacactttcttatctccaaaagctctttcagaacttctcagcacaaagctgagaaagtactgcaaagaccctgctccttccctcacttgtctgaggctagatgctgataattcccacattggagtgtggcagaaaggggcaggaccacattctggctccaactgggtcatgaggttagagcttggaaagaaacaaattaccgaggagggtagtgagtcaacggagtcaccacaaagtagtactaatggtgctactgaaaataatgaagtagaagaggaggatagagtg

SEQ ID NO: 1443 - DNA, 867 bp, Glycine max
tgttttattttacatctctctctctctctctatatatatatatataatcaacaccatccactactttctcacgcgccattaacaaagatatggtacaaacaaagaagttcagaggagttaggcaacgccagtggggctcctgggtgtcagaaattcgccaccctttactgaagagaagggtgtggctagggacatttgagacagctgaggcagcagcaagggcatatgaccaagcagccattttgatgaatggtcagaatgcaaagaccaatttccccacctcaaagaaccaagctgaagctgatgacaacaacaacactgacactttcttatctccaaaagctctttcagaacttctcagcacaaagctgagaaagtactgcaaagaccctgctccttccctcacttgtctgaggctagatgctgataattcccacattggagtgtggcagaaaggggcaggaccacattctggctccaactgggtcatgaggttagagcttggaaagaaacaaattaccgaggagggtagtgagtcaacggagtcaccacaaagtagtactaatggtgctactgaaaataatgaagtagaagaggaggatagagtggctttgcagatgattgaagaactacttaattggaactagaagaagaagaaaaaaaaaagggaaccttaatccgtgtcatatatagttcttgaatagtagtccttttttcatgctatccttttcaattcgtttacttttgtgctttctgtaaaaaaaatgtttgtcaaagtgctgatatctatatgatgatggccagtttgatagttacttatattatacactttttaagatatattgtgattgatggtaattatgcatc

SEQ ID NO: 1444 - DNA, 817 bp, Glycine max
aattcggctcgagcgacagaagggggtcaacactgaattcaaaatcactttcgaccatattctcttcttcttctctctctccatcatggtgcaaacaaggaagttcagaggtgtcaggcagcgccattggggttcatgggtatcggaaattcgccacccttttctcaagaggagggtgtggctaggcacgttcgaaacagcagaagaagcggcacgagcttacgaccaagccgcgatattgatgagcgggcgtaacgcgaaaaccaatttcccaatactccaaaccccggagggtgacccaaagacgacgctaacacccatcgatcacgagacctcatcatcgtcgacgaccacctcgaaggaactggaagagattcttcacgccaagctccgaaagtgcgggaagcttccgtccccttccatgacctgcctgaggctcgaccccgagaattctcacatcggagtgtggcagaagcgcgccggccagcgttccgattccaactgggtcatgatggttcctcccctcggaaaaaaaggtggtgctaatgaaggaggtactggaggagatgcttcttgttctaactcctttccgttctccgagtgcgatccgaccccgcaagtggcaaggcaggagcttctgaggacggagatggacgaggaagaaagaattgcgctgcaaatgatagaagaactcctcagcaggaactgccccactagcccttcattcaataacttatattaattaagggaaatgtttcctgaagaaggataattctattcagtttctttaagggtctttagagataaattatgctgg

SEQ ID NO: 1445 - DNA, 1128 bp, Glycine max
ttttttttttttttaactgaaaatatatttattatttatgataaataaaccatgaacgtttcaaacaagcagcagacgatagggcctttacatatgaactctgaaaataatattctgtatacatctctcttattttcttatgtatattttcctatgcatgcatgtaatatgtatgtgtatatatatattatctacacttataataaatatgacatacatgaaaacagatatgatatgatagatatgatgtggttatatataattagcctataactaccacttccctttttttcccaaataatgacaacccttgttgaagatgaagattaaacatgcatgtgaataccataacgctgtgtggaaaaaagaagcttaaagaaaaaagtggtcatgatcagcaccatccctttcttgaatgttgttgttaaatgatgggctagggcagtttctgtcgttgaggagttcctcaatcatctgaagggcaattctctcctcttcgtcaatctctcctctcacaacttcttgatgatgaagattacctgtcacagccagtgatggagactcaatgtggtgatgttcagaagaaggtagagaagaagaaagagaactactactgctactatcagcttgatgatgagtgtcattattattaacattaacactcttctttcccagttgaaccgtcatgacccaatttgaatcagaacgcctcccagcacgtttttgccacactccgatgtgggagttctccgggtcaagcctcaaacaagtcatagaaggtgaaggtaccttcccacattttcgaagctttgcatgtaagatttcctccagatccttcgaggtggtggagggagtgtcctcactggtagtgctctttggatcaccttctggagtttgagttattgggaaattggtcttggcatttctcccactcatcagaatcgcagcttgatcataggctctagcagcttcttctgctgtttcaaatgtccctagccacacccttctcttcagaagcgggtggcgaatttcggatacccatgaaccccaatggcgttgcctgacacctctgaacttctttgattgcaccatgatgttgttagagtttgttaattgctcgagccgaat

SEQ ID NO: 1446 - DNA, 479 bp, Oryza sativa
cggcacgaggggaggatgctcactgtctgactgactgactggctgctgctgctgctcattccttctcctactctgcctgcctcctctgctgtgtccctgggagaattcttcagggacagtatccctgcagaggtgagatcatgggacagtcgaagaagaagttccgcggaggcaggcagcgccactggggctcctgggtctccgagatcaggcaccctctccttaagaggagggtgtggctgggtacctttgagacggcggaggaggcggcgcgggcgtacgatgaggccgccatcctgatgagcggccgcaacgccgagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctc

SEQ ID NO: 1447 - protein, 243 aa, Oryza sativa
MGQSKKKFRGVRQRHWGSWVSEIRHPLLKRRVWLGTFETAEEAARAYDEAAILMSGRNAKTNFPVARNATGELTPAAAVAGRDGRVGGGSGSSSSMTANGGGNSLSQILSAKLRKCCKTPSPSLTCLRLDPEKSHIGVWQKRAGARADSSWVMTVELNKDTAVSSAATVAAATAVSSSDQPTPSDSTVTTTSTSTTGSPSPPPPAMDDEERIALQMIEELLGRSGPGSPSHGLLHGGEGSLVI

SEQ ID NO: 1448 - DNA, 438 bp, Oryza sativa
ctgcaggaattcggcacgaggctcctccgttcagttcagaggcgcctagcaatagcagctcattgcctcatctctgcctcccctgtccttctgggggcagagaatctctccactgctggaaaaatggtacagccaaagaagaagtttcgtggagtcaggcagcggcactggggctcctgggtctctgagatcagacaccccctccttaaaaggagggtgtggctgggcacctttgagacggccgaggaggctgcgcgagcctacgatgaggctgctgtgctgatgagtggccgcaacgccaagaccaacttccccgtgcagaggaactccaccggtgatctcgccacggccgcagaccgggacgcccgtagcaatggcggtagcaggaactcctccgcgggcaacctgtcacagattctcagtgctaagctccgcaag

SEQ ID NO: 1449 - DNA, 434 bp, Zea mays
tctgaggacggcggcctcgtcgtacgcccgcgccgcctcctctgccgtctcgaaggtgcccagccacaccctcctcttactgcatattcgattcaagcatgcatgcccaccacgccgccatcgtcagaacgcatggcgaaagagaaagaccgaggcatctactactactactagagagcagcgtggctagctagtagagctgagggaagaagatctagcatggggggccaccagtttcttacagcagcgggtgcctgatctcggagacccaggagccccagtggcgctgcctgacgccgcggaacttcttctttgattgcaccatgatgcctgcagatccccgcgctctgcagggcagggacgggccggccggcaagcactgcagattctctgccaggggaaggaaggaaggagtgagcagcagtccagtcagt

SEQ ID NO: 1450 - DNA, 1039 bp, Zea mays
attgggtacctcgaggccggccgggcacacggccccacacacttcacttcataggcgccccagcagagctcatctctgcctcctgtgtccttctccatgacagagaatctccactccaggaaaatggtacagccaaagaagtttcgtggagtccggcagcgccactggggctcctgggtctctgagatcaggcatcccctccttaagaggagggtctggctgggtacctttgagacggctgaggaggcagcgagagcatatgatgaggctgctgtgctgatgagcggacgcaacgccaagaccaacttcccaatccaaagaagcagcacaggggagcctaccccagctgcgggaagggacgcccgcagcaacttcagcagcggctcctctaccaccaacctgtcccagattctcagtgcgaagctccgcaaatgctgcaaggcgccatcaccgtccctgacctgtctccgccttgaccctgagaagtcccacattggtgtttggcagaagcgtgcaggagcccgtgctgactccaactgggtcatgacagtggagctcaacaaagatgcagcatccactgatgctgcatcacagtccacatcagcaacaactgctccaccagccacgccgatggatgaggaggagaggatcgcactgcaaatgatcgaagagttgctgagcagcagcagcccagcttcaccctcaaacggagatgaccaaggtcgcttcatcatctgaaaagcatggatcaaacagcacaagtcaccatcccagatcagagtttcgctaggtcggttggtacacaagcagttcaggttgcttcagtaatatagatatatgtctattactaaatccaacttacaagaactataaagtttgcaattgtgtgcagttctatgtacgtgaaaagctctacatacacatgttcctatcaagatactttgttacacatcaatgtcagtgatataattgcttataaaagaaataaatagattatgattgtgttactgctcaaaaaaaaaaaaaaaaaaggccccta

SEQ ID NO: 1451 - DNA, 1410 bp, Glycine max
tcaccatccatctttgttctttctcgtgcatggtgcaaccttctccatggccaaaaaatcacagctgcgtacccagaaaaacaatgttaccaccaatgacgataataatcttaacgtaaccaacactgtgaccaccaaggtgaaacgaacaaggagaagtgtccctagagactccccacctcaacgcagctcaatataccgaggagtcactaggcaccgatggacaggccgatacgaagctcatttgtgggacaaacattgctggaatgaatcacagaacaaaaaagggcgacaagtctaccttggcgcttatgacaatgaagaggcagcagcacatgcttatgatctagcagcactgaaatactggggtcaagataccattcttaattttccgttatcaaactacctgaacgaactgaaagaaatggagggtcaatcacgggaggagtatatcggatcgctgaggaggaaaagcagtggtttttctcggggaatttctaaatacagaggtgttgcaaggcatcatcataacggaaggtgggaggctcggattggcaaagtttttggcaataaatatctttacctcggaacttatgctacccaagaagaagctgctactgcctatgacctggcagccatagaataccgtggactcaatgctgtcaccaatttcgatctcagccgttacattaagtggcttaagcctaacaacaacaccaacaacgttatcgacgaccagattagtattaatctcactaacataaacaataataataattgcactaacagcttcaccccaagtcctgatcaagaacaagaagctagcttcttccacaacaaagattcactcaataatactattgtagaagaagtcacgttggtgccacatcagcctcgtccagcgagtgccacgtcagcattggagcttctacttcagtcatcaaagttcaaggaaatgatggagatgacatctgtggccaatctttcttcaacacagatggaatctgagttgccacagtgcacatttcctgatcacattcagacgtactttgagtatgaagattccaatagatatgaggaaggagatgatctcatgttcaagttcaacgagttcagctccattgtgccgttttaccaatgtgacgagttcgagagttgaagaagtcaggtttatataatgcatggaaaaaagaaactctgatatgtttgtttatttgtttaatttgttgattatgttaaagaccatattcataaatctttagctaattaaggtttaagtttttagaagagagatcatgtcattcacaactattataataagtggacttgttttcaatttgtgaacatgaaagtttattctttttatagcaacgtcgtcattaatcacataaaaatgaatattaatgcggc

SEQ ID NO: 1452 - DNA, 4176 bp, Glycine max
gccctttttttttttttttttttttttttttttttttttttttttttcaacatctttcatattcatcccgtctaatcctctgtgtctcattcctatatttcaatttactttcatataataagcttatataaatatattattttcttatacaaacattttttgttttcaatttttattaattcttatttttctttatcttgttaaaagtttaacttattattcaaatttcattttttcttttggatggattttggttgacaacgtcagtgatcccagtgaaagcaatacctcgccggtgggagagttgtacttgtccttattatcggagccctgctcattgctgagcccaatatatctccacaactattaacctacctacgcaacttgtctttgaataatttaagaggaaaaaaaaaaccacacttattaatttctttttattttatcctttttcacggctcttcatggcttcatcttaccacacttatcctatatatatatatatatataggataagatcatctcacaccaagtataagtttcatgacttacacaaaatctcagccattaatctaagtaaatccaacaaatcataatatttaaacaaaataaaaataaaaaatatgaaaaagtaatcacgtgagttaagactcttcctgtgtgtaaattttgaagattaatgagttagcttttcataaaataaaataaaaaactgtttgggggtttaatcccttaaacacatcaatcacctcgtcaaaagacagtaatttgtcgcttgaataaggattaatgctgttatgattggtaattacatatacaagtttttttttataaaaaaagacaaacaagtatagttaaaaatgaaaattaatgttaaagtaacatgaaaatgtgttagctttagtgcgcctgtgtgtaaattaatgttaaagtgacatgaaactatgttagttttgttttgggtttgattccgtaaacacatcaattatttcgttgcaaatttgcataaaaagacaaaatgtgtttgtaatacaattgtgggaggcaaaaatttaaaattaatcgtgatcatatgactaattaagaaatgaaaaaaaataattatatgttaataatataaaataattttatattatcattcaataaaaaattattatttaggataaattattaattttaataaaattatcttaaaaattatatcaataataatttacaattaaatgacacacaaaatatcatcattaaacatttaaaaaatatttttattaatctttaaaacttaacaaattaaatatgatttaataatttaacatttatctttaaaaaaatattattcttattgcttataataactaaatgttgtgacatctacccacgcttgtggagacatacataataaaactaaattgttaaaatgaggcagttgtacttgtatgccatgcatcttgttctatcgcaaataaaatgatccaatccctcttccccccttgtatgttacttttaaagaatcttccactcgatctctaaaatgtttactcttaccccctaatttctttatcatcttttttggttgattacccccttttgaaaaataacgtattggccagaagaagtcctccaattctaaacatcaagctcgtaatgaaaaattggtgcaccaaaggagcccaggtcaccaaaaatgatatcatcattttcagtgtagatgcctgaatcttgattttcaaaaattgtttgaatgtcttcagggaatgtgcgacgagaaggatttgattctgaagatggtgctacaccctcttctgtgatctcatcactagccgaacctagctcaagttcagcattagagtttacattttcattgctaggaatagtttgatgattttcttctgttttaggacgtggccaattgatataacggctcaggtcaaagtttgtaaccgcgttaagtcctctgtattctattgctgccatgtcatatgctgcggctgcttcttcttgtgtagctacaatacgacataataacatatggacacacacatgtaagcaaatttaattgtattattgtttgcatatgtcggtctaggatttctctttttcttcttccgatttggtttatattaaaatgactagaaaagaatgatatcattattaaatagctctattaagcagttgaagtttggtgatctatatcacaaccaatatgatctgattgcatatgttgacctttatatttgtcctactattttgatccgcgggaccatgttgaaaccaagtaggtactttcttgttagaaccggaaagaatggtcaaatacattttcaaaatttcaggtatgggtacatcctctcttaattaattaaacatcgctacacctatattagctactttatttcgtttatattcaaccaatacataaacatacaatttaatttgttcattatttagagtgctgacataggcccatatcacatgcatgttttataattcgtagcaaatataaccaaatataaatgatgataatgaaatgctatatatgaaccatgtaaatgcattcaaatgctaaggtaaggccatatgcttctgtctaagagaattgtacatcaaatgcatagaaaatgaccttttgattaggattttaaaaaacatttcgtcccctgaactatataattgacaaattatatgtatagacgcacactttaaaatcacatattcaatttttttttaaaaaataactaacaatattcttattttgagacatcttgagatttgaataacaataatataatgcaggaaaattacttttcaaaactgttaataatatatttctgtacacatttttttattatataaattttagaaataaatgtaattatggtccctattttattttattcatattttaaaattgaaacatgtagtacttttgttttaaaaaatatacaattttagtctttcccgttttaaaatagatatttagtcttcttattttaaaaaattgtaattttgatcaaattctcaattttatcaatgttttatttttttcttttggtccaattgaattataaatctaatatattcatttaaggtatcatcaaaatttgatttaattagttacaaaataagaaataaaagaaataaagcatatacaaaattaaagattaaattaaaattatagattttctaaaaaaggaaaccagaatcgtcaattttttaaaatataaaaattaaatatttatattttgaaatagaaaaaccaaaattacaaattttttaaaataagaaaaataaatgttttaattttaaaatagaaaaattaaaattatgaattgactaaaattacatttaatcctaaattttatgtgagtcacactcaatgatataaatttattctttatttaacgaaattcacataaaatttcaataagaagtagcatccatctatgcatgcgctttctttacattagatcatagacaatgaaattaccgtaagttccaaggtatagatatttgttgccaaagacccttccaattcgagcttcccatcttccgttatggtggtgtcttgctacgcctctgtattttgaaactcctcgagagaatccactgctttttcttctcaaggatccaatatattcttcttttgactggccctccatctccttgagcttttcctcataatttgataatggaaaattgagaatggtatcttggccccagtacttcaatgctgccaagtcataggcacgtgctgcggcttcttcatcatcatatgcccctagcaaacccaagtttattgcaatcattaaatcgtcccccatccgccaatttaaggggaacaaataatgaaggtttttgttatatatgcaagctaattaattaatactctcaaatcatacctagatatactgcatccagttgttttccatagccattttcaaccaacccaacataattaatatgacaataaatcaaataatcatataagtgaaggaaatcagaaatctatatggagattatagagagcaaaataatgaagagccttgtcttcctttcttgctctgtgattcattccagcaattcttatcccacaaatgagcctcatatcgaccagtccatcgatgcctaaaacaatcacatgcacatatttgagcccacgcgtccgcggacgcgtgg

SEQ ID NO: 1453 - DNA, 684 bp, Glycine max
accacaatggtatgttctaaaaacatttcgtacactcgtgtgtgtatatatatattcgtgcacgccccactttctgaattcaacaaagatatcaatggtttattttgttgaccatgatgatctaccgtaaaacagattgaaaaattgcaaaacctagcattttgcagtgaacagagcagggttcaagtaccttgctacgcctctgtattttgaaactcctcgagagaacccactgctttttcttcgcaaggatccaatatattcttcttttgactggccttccatctccttgagcttctcctcataatttgataatggaaaattgagaatggtatcttggccccagtacttcaatgctgccaagtcataggcacgtgctgcggcttcttcatcatcatatgcccctagatatactgcatccagttgttttccattgccattgtcaaccaacccaagataattaatatgacaataaatcatataaagcgaaggaaatcaggaaaattaaactaaagattatagagagcaaaataatgaaaaccttgtcttcctttcttgctctgtgattcattccagcaattcttatcccacaaatgagcctcgtatcgaccagtccatcgatgccttgtgacacccctatagattgagcttcgttgaggaggtgagtctcttctcgagccgaat

SEQ ID NO: 1454 - DNA, 926 bp, Oryza sativa
tggcgacgcgagcgagcatattaaagctgtgccggcggctgcaactttgccgccatttatttagctccggctcttttaaaagctctcttctcctgctgccatcttcttctggttggcaccaccattccatatataccatctccctcctcctcccgcgctcgctcttcgccaatggccaagcgacgcagcaagggcgagaccgccgccgcgagcagcgacgactctagctccggcgtctgcggcggcggcggcggcggcagcggcgaggttgagccgaggcggcggcagaagcggccgcggaggagcgccccgcgggattgcccctcccagcgcagctccgcgttccgcggcgtcacacggcaccggtggacggggcggttcgaggcgcatctctcgcgcgggaacacctggaacgagtcgcagagcaagaagggcagacaagtttacctcggggcttacgacggcgaggaagcggcggcgcgcgcctacgacctcgccgcattgaagtactggggccacgacaccgtcctcaacttccctctgtcaacatatgacgaggaattgaaggaaatggaggggcagtccagggaagagtacatcggatcgctccggaggaagagcagtggcttctcaagaggggtgtccaagtacagaggagttgcaaggcatcatcacaacggcaaatgggaggctcggattgggcgtgtgttcggcaacaaatacctctatctaggtacttatgcaacacaagaggaggcggccgtggcgtacgacatcgcggcgatcgagcaccgcggcctcaacgccgtcaccaacttcgacatcaatctctacatcaggtggtaccacggctcttgccgctccagcagcgccgccgccgccaccaccatcgaagacgatgatttcgccgaagccatcgccgccgc

SEQ ID NO: 1455 - protein, 426 aa, Oryza sativa
MVSMRKKKKAFAVAAATTLLSPPRSSSSSSSTASSCIVPPRTESGKKKSKHRKRAKDGTGGDDDDAAVAAAPRKGSSIYKGVARHRGSGKYEAHLWDKQGWNPNQTRKRGRQGAYDTEEAAARTYDLAALKIWGSDHVLNFPIDTYRKELERMQRMTREEYLATLRRKSSGFSRGVSKYRGVAKHHHNGRWEARIGRAVGKKYLYLGTFDTQEEAATAYDLAAIQLRGRSAVTNFDASCYTYTDHLPPPPPPQPPSVCKTEPELEPPQPAAPPGSESLLRPKMEPCDDWEPPAICPSLRDADDADHAIAEILPALCMDRADFEARYPARRARDAAADGWSTSSDDVAAASVDDDVLRSLPDDVGFVDDVESLFLDAPGPAAAAAAAAMPDDVERAVQRAPSAASRRANAAAVSYAISSLASGRWWY

SEQ ID NO: 1456 - protein, 443 aa, Oryza sativa
MAKRSSPDPASSSPSASSSPSSPSSSSSEDSSSPMSMPCKRRARPRTEKSTGKAKRPKKESKEVADPSSNGGGGGKRSSIYRGVTRHRWTGRFEAHLWDKNCSTSLQNKKKGRQGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQEPQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGMAEYNLFEECNMLEKDISDFLDKDISDFLDKDISISDRERISPQANNISCPQKMISVCN

SEQ ID NO: 1457 - protein, 429 aa, Oryza sativa
MVSMRKKKKAFAVAAATTLLSPPRSSSSSSSSTASSCIVPPRTESGKKKSKHRKRAKDGTGGDDDAAAVAAAPRKGSSIYKGVARHRGSGKYEAHLWDKQGWNPNQTRKRGRQGAYDTEEAAARTYDLAALKIWGSDHVLNFPIDTYRKELERMQRMTREEYLATLRRKSSGFSRGVSKYRGVAKHHHNGRWEARIGRAVGKKYLYLGTFDTQEEAATAYDLAAIQLRGRSAVTNFDASCYTYTDHLPPPPPPQPPSVCKTEPELEPPQPAAPPGSESLLRPKMEPCDDWEPPAICPSLRDADDADHAIAEILPALCMDRADFEARYPARRARDAAADGWSTSSDDVAAASVDDDVLRSLPDDVGFVDDVESLFLDAPGPAAAAAAAAAPMPDDVERAVQRAPSAASRRANAAAVSYAISSLASGRWWY

SEQ ID NO: 1458 - protein, 399 aa, Oryza sativa
METYGLVKDELLHGIGGGQGRLYCEVKPTAAPAVITAAGGGAKSVKRRKREPSAAAMSAVTVAGNGKEAGGSNAANKRSSRFRGVSRHRWTGRFEAHLWDKGTWNPTQKKKGKQVYLGAYNEEDAAARAYDLAALKYWGPTTYTNFPVADYEKELKLMQGVSKEEYLASIRRKSNGFSRGVSKYRGVARHHHNGRWEARIGRVFGNKYLYLGTYSTQEEAARAYDIAAIEYRGINAVTNFDLSTYIRWLKPPSSSSAAGTPHHHGGGMVVGADRVLAPAQSYPISAAADDDVAGCWRPLPSPSSSTTTALSLLLRSSMFQELVARQPVVEGDDGQLAVVSGDDADADADSDVKEPPPESEYGEVFASDEAAAAAAYGCSMYELDDSFALIDDSVWNCLI

SEQ ID NO: 1459 - protein, 416 aa, Oryza sativa
MAKRRSNGETAAASSDDSSSGVCGGGGGGEVEPRRRQKRPRRSAPRDCPSQRSSAFRGVTRHRWTGRFEAHLWDKNTWNESQSKKGRQGAYDGEEAAARAYDLAALKYWGHDTVLNFPLSTYDEELKEMEGQSREEYIGSLRRKSSGFSRGVSKYRGVARHHHNGKWEARIGRVFGNKYLYLGTYATQEEAAVAYDIAAIEHRGLNAVTNFDINLYIRWYHGSCRSSSAAAATTIEDDDFAEAIAAALQGVDEQPSSSPATTRQLQTADDDDDDLVAQLPPQLRPLARAASTSPIGLLLRSPKFKEIIEQAAAAAASSSGSSSSSSTDSPSSSSSSSLSPSPLPSPPPQQQPTVPKDDQYNVDMSSVAAARCSFPDDVQTYFGLDDDGFGYPEVDTFLFGDLGAYAAPMFQFELDV

SEQ ID NO: 1460 - DNA, 651 bp, Zea mays
aggataactttggcgacacatagctctcggaattcgattcagatcaagtaaggcggacaggcttatctgggagcatatgacagtgaagaagcagcagcacatacgtacgatctggctgctctcaagtactggggacccgacaccatcttgaattttccggcagagacgtacacaaaggaattggaagaaatgcattttgtgtctgtggaagaatctttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgtcatttctgcgattgagtatcgaggcgcaaacgcggttactaatttcgacattaggtaattacattgaccggttaaagaagaaaggtgttttcccgttccctgtgaaccaagctaaccatcaagagggtattcttgttgaagccaaacaagaagttgaaacgagagatgcgaaggaagagcctagagaagaagtgaaacaacagtacgtggaagaaccaccgcaagaagaaagaggagacggaagaagagaaagcagagc

SEQ ID NO: 1461 - DNA, 670 bp, Zea mays
cgcatggttcctcttccgctgctgccgtcctgcgatcgaccgggttggcgggcggtccggcgcgtgcctgcagtttatctcggcgcgtacgacgacgaggacgcggaggagcgcgcgcacgacctggcggagctcaagtactggggccccgccggcaccgtcctcaacttcccgctgagcggctacgacgaggagcggagggagatggaggggcagccccgggaggagtacgtcgcgtcgctgcggcggcggatcagcggcttcgcgcgaggggtgtccaagtacaggggcgttgccaggcatcatcacaacgggagatgggaggcgaggatcgggcgcgtgttaggcaacaagtacctctatctcggcacttacgcaacacaagaggaggcggcagtggcgtatgacatggcggctatagaacaccgcggcttcaacgcggtcaccaacttcgacatcagccattacatcaaccactggcatcgacattgccatggcccctgcgacggcagcctcggcgcgatggacgtcgcaccgaacgtctcgctcgaactagacctactcgagtgcccagtcaccgtccggctcagcctcgaggagaccacgggcgacgatgaattccacaaccgcgaggactacctggggcaccttttcggcgtgcagcagcttc

SEQ ID NO: 1462 - DNA, 2042 bp, Zea mays
tcaacaactatctcaacaagttcagatgatgcagggaatggtgatgcaggtaataattttagtaatccgctcaaaatttgcccaatctcagaatttgcccatatttttttatctaactcgctctgagccttagacaacccaaaatcggtctggtcaacgttgagtgatttctgcatttattaggaggttgtcacagcctgtgatatgaacatacatactatggtgatatgaacatacatactatgtagtcatatgtatgaagaaaaaaaatagacaatgtttttttttcctcagagtaaatatagaatggtgaaaacaaaggttccttaatctggagcttactagggttacagccttggtaaactgttcaaacgaacaaatctatgctgcactggctgcgttaccatgatcatgccatgtaaactcagtgataaactgcacaagcacaaccacttcagattcaggatgtgattagttgaatctaggctaagtgagacaatgacaaacccttaacgttagccaagcagcctaggggcaaattcaaagaattaaagaacatcgacacacttgtctaacgccaaactgccatgggctttctacaagaaagttctcagctgctctggtgcagtggcactgtggcattagacagatcaaggattacccaagacaggacacctggaaagcgaaaacctcctcgggttccagaattagttgcacacactgatcatcgctggaggttgtatcccctcttccatatccgaaagaacatccttcagctggacatcacctgcctcaaacagactgaaatctgccagacctacaccatccttgcttccttcgtcagccgcagaacacccatcgaacaggcatccgatgttgcagtcgaagtctgcgtcagcgaaccactcgctcagattgattgagctgccaaagtttggtctcgacatggtgtctagctcgtaatccatgcaagggctccacaagccctcttcgatgctgtcgtcgactgtggtgaggggctccgcggtgtcgtcaggcaccgcgttctcatcgggttctgcactgccatccggtgtcttggcttcgcttgactccggctcttgctctgtagttccggtttcgctctgatcaggttgaggttcttggttgagtgccggcaccacctgtggctcctgttggagctgtgccaggaacagcgggtggtccaggtagcagctgatgtcgaagttggttacagcattgacgccacggtattcaatggccgcaaggtcataggccttggctgcctcttcttgagtgtcaaatgttcccaagtagaggtacttgttcccaaagactcgcccaatccgtgcctcccacctcccgttgtggtgatgcctggcgacgcctctgtacttggagacgcccctggagaagccgctgctcctgcggcggagggaggccaggtactcctcccgggacacggcctccatctccggcatctcgctggagtaatcctccacagggaagttgagcagagtctcaggaccccagtacttgagagctgcgaggtcataggcacgagcagctgcctcctcgctgtcatacgcccccaggtagacttgcctgcctttcttcttgttgtggagcgcggcgaggcagtgcttgtcccagagatgcgcctcgaacctgcccgtccacctgtgcctggtgactcccctgtagacggagctcctctccccggcggcgggaggaggatcagaggggtccttgcgggccctcttattaggctcggcgccggccttggccgtcgccgccctccgccgcctctttcccggagggacgaggacggtgtccgcggagacgcaggacgaggaggacgacggcgacggtggcggaggagactgccgttgagatctctccatgtccgtggtctccgtcccccctcctcctcgatgaacggtggtggtgcagcgcggacgcggttgtgcaggggagccgagtggtgaatctgacctggcggcgaggcgggggaggagcccggccggcctcgaggtacccaa

SEQ ID NO: 1463 - DNA, 1182 bp, Glycine max
  misc_feature (1175)..(1175): n is a, c, g, or t
  misc_feature (1177)..(1177): n is a, c, g, or t
gattttggcatccgttatggcttccagtggccagctcttatttatcgtctatcaaaacaacccggtgggcctcccaagctgcgcattacagggatagagctcccacaacctggtttcaggccagcagagagagtccaggagacggggcttcgacttacaaggtattgtgatcgctttaatgttccatttgagttcaatgccattgcacagaaatgggaaactatcaaaattgaggacttgaagataaaggaaaatgaacttcttgttgcgaatgctatgtttcgatttcaaaatctacttgatgagacagttgtggtgaatagtccccgggatgctgttttaaagttaataaggaaggcaaatcctgctatctttttacatgctaatgtcaatgggagctataatgctccattctttgtgacacggttccgggaggcccttttccattattctactttgtttgatgtgcttgataccaatgttgcttgtgaagatccaatgaggttgatgtttgagagagagttctttgggcggcaggtaatgaatattgtagcttgtgagggttgtgagagggttgagaggcctgagacatacaagcaatggcaggttaggaacatgagagctggatttaaacaattgcccttggataaacatctcattaacaaattaagatgcaagttgaaagatgcgtaccacagtgatttcatgcttcttgaagatgacaactacatgctgcaaggttggaagggccgagtagtttatgcttcctcctgttgggtgcctgcataggccttgacaatgttcttcccaaggtagttaattaggagaagcgtttcatgagttgtaggggagacatggacttccaaaattcttgtggttgacatattctagaagctgatccctgctaatgtaatgacatagcatagttcaatttcagttctcagaatatttttaaattggtcaagtcataagtgtgtgtataatataactgataactggtgctgtgtggatgacatatttcaatgttgaacaattccttcttgagttcttctgataggcactcatgagcagcagaatcctgagattgtgagattttaggtctaaaatttgaactggtttctaagtttgtatattaagttaatattttattctgttcaattaattatttagttaananaaaaa

SEQ ID NO: 1464 - DNA, 1741 bp, Glycine max
atggaggtaagggtcgttcaaagaaacaagggatcaggaagaaggaaacggtggatttgaggaatcttctattgatgtgttcacaatctgtgtatcccagtgacatcagggctgccaatgaattgctaaagcagattaggcaacactcttctcccattggggatgcatcacagaggttggctcattactttgccaatggcctcgaggcacgcttggttggggatggtacaagtacccaaggaatgtatacttttctgagctctaagaacaacactttttctgagttactcaaggcataccaggttttcagttcctccagccctttcaagaagtttgcatatttatttgaaaatacaatgattatgaaagcagctgcaagtgcagaaaccgtccatattattgattttggcatcctacacggtttccagtggccaatgctcattaggcttttgtcaaatagggagggtggacctcccaagcttaggatcacagggatagagtttccccaacctggctttcgtcccacagaaaaaattgaggaaacgggtcgccacctggctaactattgtaagcgttacaatgttccctttgagtataatgccatatcatcaaggaactgggaaaccattcagcttgaagccctcaaaattgcaagcaatgagctagttgctgtctactgtcaccaggggtttgagaatttactggatgagtgtactattgaagtgaacagtcctagaaatgcagtcctgcatttgatcaggaagataaatccggatatttttactcactccatcactaacggatcatataatgcccctttctttaccacgcggtttagggaggctctctttcattattctgccatttctgataagaatgacactgtcatatctcgtgaaaacgaaaggaggttgatggttgagagagagctctatggcagggagattatgaatgttatagcatgtgaaggttctgacaggattgagaggcctgagacctacaaacggtggcaggttaggaatatgaaggctggtttcaagcagctaccactgaatgaggaattaatggccaaatttaggagtaagttaaaggaataccacagagattttgtcttagatgaaaataacaactggatgcttcaaggttggaagggccgcattttgtttgcttcctcttgttgggtgccggcataatgagatgctactgtgactcggttcagaattcatactatactaaaggtatgattccaagaatcagtcattggctttaactctatccacttctttttttccctggttctgatattcttggtctggctacctacttactctaccttcagcttttgtgatgaagattgtaccaagctttgcaccaagttccttggtaaaattatagcatcacttttctggtagattaagacttgtgaaggtaatacaatttcgttagtgatattgataagaagggcatattagtcatcagagtaggagggccattatagcatgtttgcccaagtacttgcaatcctattattgagttattttctctttaaccaacatgtatcaggcatttcacgtccttctatttaagtttgttaatttcttttacaggatacttgtcttttgagacaaattagttgagaagatgtgattaatttgaaacagatgatgactatgttccgtttgttttttccggtgatattcttgcttgcagttttgtatttctatatatagcaacttatgtg

SEQ ID NO: 1465 - DNA, 1023 bp, Glycine max
gaattcccgggtcgacccacgcgtccggccatagcatcgcgaaactgggaaaccattcaaattgaagacctcaaaattgagcgcaatgagctgcttgctgtgaactgtctggtaaggtttaagaatttgcttgacgagtcaattgaagtgaacagtcccagaaatgctgttctgaatttaatcaggaagatgaaaccagatatttttgttcacagcgtagtaaatggatcttataatgctcctttctttctcacacgcttcagggaggcactgttccattattcttcaatttacgatatgtttgatactctcatatcccgtgaaaatgaatggaggttgatgcttgagagagaatttttgggccgggagataatgaatgtggtagcatgtgaagctcttgagagggttgagaggcctgagacatacaaacaatggcaggctaggaatactagagctggttttaagcagctcccactggataaggagataatgaccaaatttaggggcaaattaagggaatggtaccacagggattttgtctttgatgaagatggaaactggatgcttcaaggttggaagggtcgcattttgtatgcttcaacttgttgggtgccagcataatgatgtgtgtgactcaactcttgtttcagaattcatactggatggaaggtcaccttcgctgttgtgaactgtgatgaatattcttcccaggtttgcaccaagtgaccctgtataatagtgccagaatttttcccagattagcattaaatcctacaatgacatggacgcgaacattaggagtcaaaattgttatttacgatgcttttccttttcttttcactctctaaccggcatgtactataggcacttcaggatcctaagaagtacttagtaaattggttaaaaggttttttcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcggccg

SEQ ID NO: 1466 - DNA, 1055 bp, Glycine max
gaattcggctcgagattcaatttgcaacctaagtgaggatgcaaaaacaattcacatcatagactttggcatccgctatggcttcaaatggcctgcacttatcagccgtctatcaagacgccctggtgggccacccaaacttcggatcacggggatagatgtgccacaacctggtttaagaccacaagagagggtgctcgaaacagggcgcagacttgcaaattattgcaagcgtttcaatcttccatttgagttccatgctattgcacagagatgggacaccatcagagttgaggacctcaagatagaaacagacgaatttgtggctgtgaactgcttgtttcagtttgagcatctacttgacgagaccgtggtgttgaataatcccagggatgctgttctgaggttgattaagaatgcaaatccagacatatttgtgcatggcattgtcaacggatcctatgatgtaccattctttgtgtcacggttccgggaggctctctttcattacactgcattgtttgacatgcttgacaccaacgttgctcgtcaagatcccatgaggttgatgtttgagaaggagttgtttggacgggagatagtgaacatcatagcttgcgaaggttttgagagggttgagagaccacaaacatacaagcaatggcagcttcggaacatgagaaatgggtttaggctgcttcctctggatcatcgaatcattggcaaattaaaggataggttgagagatgatgcgcacaacaataatttcttgcttgaggttgatggcgactgggtgctacaaggttggaagggtcgaattctatatgcttcctcttgttgggtacctgcatagcataggccttgaacattatttattccagattacaaaaatctagtcttacacacaactattagtacgtctccttcaatctccctagctcatttgttgttttttatgataaggaaaaaccaaagttatagttagtttctttcaatgtgtagtttgtttagtacttacatatctaacaaattcagcaaatacaattgagagccgc

SEQ ID NO: 1467 - DNA, 2281 bp, Glycine max
gggaatgattcaccacttgtaacataaacgagaaaataaagtttagagtacagcagtgagcattaagcaaatgaagatttataataactaccaacttctttctatgttgctcctaggcatcactagaaaactagtacattaatgtggatattagatatccttctaaaatcagtgatttcagaggagtttaagtcttctactcttgttcataaaagtgcacatataagagggtattttcactattcaaatagaaacaaaatatgatcatgattcacttctattcaaggataaatatacccttagtgcaccttacacctaaaacaattttccttgccaatgagtgggttaggagttggtcattcctcaagcaggaacccaagaggaaacagcaaaaagaattcgccctttccatccttgcaaaacccacttgccatcctcatcaaccacaaaatctttatgatgttccttcttcaccatttccttcactctattcacatgctctggggccaatggaagttgcttgaaccctgctctctggttcctaacttgccactgcttgtaggtttctggcctttcaaccctctctgccccctcacatgctatcacattgattgcatcccttccgaacacccctttctcaatcataagcctagatggatcttcacgaggcacgttaacttcaaacatgtcaaacaatgatgagaagtggaagagtgcttccctgaaccttgtcacgaaaaatggtgcattgtaagtgccattgacgaccccgtgcatgaagatgtttggattgatcctcctgatcaacctcagcaaagcatctcttggacagtttgcagtcacggtttcatcggaaaggttcttcaatctgtacaaacagttaaccacagttacttcactcctatcaattttgaggtcttcaagtcttatagtctcccatttttgtgcaaggcaattgtactcaaatgggactccaaacctcttgcagtacttctccagccaccgccctgtctcctcaaccctttccgccggcctaaatcccggctggggaagatcaattcccatcatacgaagctttggaggcccgcccggcctctctgaaagccgttggatgaggcaaggccactggaaaccatagctaatcccaaagtcaataatgtgaagactgctttcattttgcgctagcttcagaatagtgcggtttgccaagaaattagacatccttagaaatggtgatgccgagatatacactcggtatgctttcaacatatctgcggcagatgctgactgaaaggaaatgaactttggtgtcccagcagctaaccgtttctcgaggccatcggcgaagtaatgagccaaacgctgaagtccatcgccaaaaggtgaagagtgctgcctaatctgcttcagtgtttcatttgcagtcctttggtcaaagctagccacagcctgtgcacattgaattagcaaagtccataaatccaccgtcgtcacgcttgcccttgtccccttattggaacctctctttgatcgtgttttcttcccattagatcctcctgagtcagcaatctgcgatggtgatggttcacggccagcataaaaaatggatggactcttaccatccttacaaagcagcacctcatcaaacatgctagatggctccgaatcatcggagtagacagaagaaagcttgttgcttctctctcttcttcatgtgacatatcattcatgagataactcctcttctccctcaatcctgtggctgttacagaaccctgcatcacaccatcctcaatcacacgcggcttgttctgtgggtgaatcaaattccaggctccatttgaaaaatggaccccagcttgtgtctctctaaacggatcaggagctacatatgcgtgttccggagaatcaattagagatctttgtaggaaagaggaatccaagtcactagcaccgttaaaccaatcagactcgcatgaattatcagtggtataactgctaaaactctcagaactagtagttccaccaaaattatcatctgggtcaggattatcattaaattgaccagttgatgaagggtaactacgaaccaatgcatcatagaatgatttttcagcagcctgaagtctcaaacaatcctgcaacatgcagggttttcgctccaaatcaacttcttcatccatgaggatgtcactaatgtatctgagaatgggattggagtgcttagtactctctgcatgttctccattcgagcttgtcccagaagaaggaccagaatcag

SEQ ID NO: 1468 - DNA, 723 bp, Glycine max
ccacgcgtccgacggctttcagagaggccaggcgggcctccaaagcttcttatgacaggaattgatcttccccagccgggatttaggccggcggaaagggttgaggagacggggcggtggctggagaagtactgcaagaggtttggagtcccatttgagtacaattgccttgcacagaaatgggagactataagacttgaggacctcaaaattgataggagtgaagtaactgtggttaactgtttgtacagattgaagaacctttccgatgaaaccgtgactgcaaactgtccaaaggatcaatccaaacatcttcatgcacggggtcgtcaatggcacttacaatgcaccatttttcgtgacaaggttcagggaagcactcttccacttctcatcattgtttgacatgtttgaagttaacgtgcctcgtgaagatccatctaggcttatgattgagaaaggggtgttcggaagggatgcaatcaatgtgatagcatgtgagggggcagagagggttgaaaggccagaaacctacaagcagtggcaagttaggaaccagagagcagggttcaagcaacttccattggccccagagcatgtgaatagagtgaaggaaatggtgaagaaagacatcataaagattttgtggttgatgaggatggcaagtggggtttgcaaggatggaaagggcgaattctttttggctgtttctcttgggttcct

SEQ ID NO: 1469 - DNA, 941 bp, Oryza sativa
  misc_feature (789)..(789): n is a, c, g, or t
  misc_feature (794)..(794): n is a, c, g, or t
  misc_feature (866)..(866): n is a, c, g, or t
  misc_feature (928)..(928): n is a, c, g, or t
acggaattctatcagctccagaccaagccggttcgtgagaacctcccgtcgcaatcttcgtcgttcgcgtcttcgaacggcagcagtgttactttctcagaaggattcgagtcgttgctgagcccggctggtgtcttgcctgatgttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccaccttgtgagggatttgatggacaaggtcttgctatgcaatggtgagacatgctcaaaaggtgttaaggagttgcgtgaggctctgcagcatgatgtggcgaaacattcaggcggaggccatggcaaagggtccagccatggcaagggtcgtggaaagaaacaacccaagaaggaggtggttgacctggagacccttctcatccattgtgctcagtctgtggccactgatgacaggcgcagtgcaactgagctcctgaagcagatcaggcagcatgctcatgccaatggtgatggtgatcagcgtttggcacactgcttcgccaacggcctcgangcgangctggcaggtactggtagtcaaatttaccaagaactacacgataactcggcttccatgcactgatgtgctgnaagcgtaccagctttatttggcagcttgcccatttaagaagatctctccattacttttgccnatcaaacaatttt

SEQ ID NO: 1470 - DNA, 1106 bp, Oryza sativa
tttttttttttttttttccacttcaaggcaattattatttaaaaaaccattttcacacacatcaatgggcaaaaatgtttgaccctctgttgcaacatggatcatgaatagaccaaataagttggccgaaaagatagttctcaggttgacaacagcacaagactagccaaaacccagttcaacattttgagcatattacaatgttactgtctgccacagtgcagtaagcacctagtaaaaacagagtaactggtgtcaattacaaccggatcaactgactggattgatcgcaagaaccggtgacgctgcagcgaacatcatccggaccaggacctaagtctattttctaagtggtagtgtggcactaagctgcaacatgacaacagaagcaactaattaacatcacataaaaacatggatatctacatgcatgcttggttatcttatggcttcaacaacttgggctaccaattctccctcatagcctcaagtcattgggtccatcaaaccaacaccaacaccatcgatcttcatacatgacatactgccactagccatcttattgaaatacctagatcttatatttgtcgcgatgccaaaaaaaaaaactactaaaaataagagagagcatcatttggcgtccatgttgagatggcatagagtattcgtcccttccatccttgcaagagccattggtgatctatatctatcacgaagtccttgtggtagcagtccttgaccttgttccgcactacctgaacaatttctggattcaatggcagttgcttgaagccagcccgttgattccgcacctgccattgcttgtatgtctcagggcgctccacccgatctatgccctcacacgcaatgacattcagagcagctcgtccaaagatgttttgctcaatcagcagccgctgttcgctttcccttggggtacttgcatccagaacatcgaacaaggccgagtaaaagaacaaagcctcccggaaccgtgtcacaaagaatggtgcactgaatgagccattcactattgcatggatgaacacatgaggctgcatcttccggatgttgctgagcacaatatcccttgggctgtcgatcac

SEQ ID NO: 1471 - protein, 1363 aa, Oryza sativa
MVIELPFDNQYTTTETEQPHDGSSCSSQQQLSLYNYSPSDPQLFSQPTTGSRTYLSGAVTIPGICNDKSNLGQQQFQIDAALSLGYQRIRSSDALCYISRVLMEDVDERVDLHQGEAALQAAEKPFYDILGQVYPPSLNRLALHSANEPDTPDESSSRNNYHNRYHSSHSSFNMLQPLPTPLSPYSYGRSLFLPNQHLVSTAWTSTFGIPGFQIRRGAEEAKRFVPIIDKLVIDLDTDRGLSISKMTTKAKVGDKKRYAIFELTDQRHSPYTTDLDILEGRNSKRYAITYCEIIRNDMFDRVLLCYGVENFAEASNLRKIMTKQARKNSLNGQTRGSAQRKLRGMKQLKKDVVDLRNLLIHCAQAVAADDRISASELVKKIRQHSSPDGDSNQRLAFYLVDGLEARLAGIGSQVYRKLMASRTSAESLLKAYSLYLSACPFERASFAYANQTILDASKGQQPRKVHIVHFGICTGFQWPSLIQRLANEEGGPPKLRITGIDMPQPGFHPCEIIEETGKRLADYANLFKVPFQYQGIASRWETVQIEDLNIDKDEVLIVNCMFRMKNLGDEMVSMNSARDRVLKIMRMMNPRVFILGIVNGSYSSPFFITRFKEVLFHYSSLFDMIDANVPRDNEARKMIEGGLFGQEALNIIACEGAERTERPESYKQWQARCLKAGFKQLPVDPATLKEIINMKKGIYHEDFVADEDGAWLLQGWKGRVIYAISTWKPNESYLDQCLPEFGGYPCQKYDLHSRILMEEDIDEKISIKKGQDALQATEKPFYDILGKAYPSSSKETAINGDSQADYPDNGSSSYHEQACSGSFVSDLLGSQDAHSITTDWSSEFDRLALQFRRGVEEAKRFIPNIEKLVDDPEKNGLYACKQTTETTEQKGKHENKIRNHPHDPHVEHIELMEARNSKHMAISTSETIRDEMFDSILLCNRQLPGEVANLRGMMAKEASDNPKKFQSKGYGKGQRKPHSSKKKQKEAIDLSVLLIQCAQAIASNNHPFASELLRKIRHHALPDGDGSQRLANCFADGLEARLAGTGSQMYEKLMAKQTSTRDMLKAYHLYFVACPFEMVTYYFSNKTIIDALEGKTTLHIVDFGILFGFQWPCLIQRLAKREGGPPKLRITGVDVPQPGFRPHERIEETGKRLAEYANMFNVPFQYHGIASRWETICIEDLSIDKDEVLIINCMSRMRKLGDETENIDSARDRVLHMMKRMNPQVFILGVVNGLYSSPFFLTRFREVLFHYSSLFDMLDNNVPRNHEARILVEKDLFGNDALNAVACEGAERIERPESYKQWQMRILRAGFKQRPVNQAILNRSVHYKEFYHEDFVIDEDSGWLLQGWKGRIIQALSTWKVET

SEQ ID NO: 1472 - DNA, 1278 bp, Zea mays
cttttttttttttttggtgacagagattttaggccccttctattagtttttttaggagctcctctccatttctagaaaaagcccatcaagaagcttccccgttattagatttttctaggagctgttggaggcccaccatagagggcctttagtcatgggtcagcatgttgtgcaacccatgtggataggccatagagaacacgtcccttccacgtgtgtagcaaccacccctggtcctcgtcgatgccgaagtccctatggtacttgtccttcaccttgtccctcaccaccttcacgacgtcagcctgcagctggagctgcttgagccccgcccgacggttccgcgcctgccactgccggtaagtctcggggcgctccactcggtcggcgccctcacacgcgatgacgttcatggcggcgcggccgaagatgtccctctccagcagcagcctctccgggctgtcccgaggcacggtggcgtccagcaggtcgaactgcgccgagtagtggaacatcgcctcgtgccgaattgtcgggaagtaggtcgtgccgtagccgccactgacgacgccgtggatgaacacgtcaggccgcatccggcggatgttgcagagcacctggtccctggcggtgggacgacgacgcccactaggcccggcggcggcggcggaggagctgatctcgacctcgatctcgtccgtgagcagcctgaaatggcagaggctgatcacgacgagcacctcggcagctgggtcgatgcccaggtcctctggagacaccgcctctcgcttggccgcgatgccccggaactcgaacggcacgcccagctgacgtgcgcaatcgctgaggcggcgcccggtgtcctcgatctgctgtgcggggcgaaagccaggctgcggcaggtcaatgccggtgatcctgaccagctccggcggtccgccctccctggcggcgaggccgcgcagcagcccgggccactggaagccgtagccgaggccgtagtcgacgatgtgcagccggcggcgcctgccggcgagcgcgaaagcgtcgtggatggtcttgttggcgaaggcgaacgccaccctcttgcagcagcaggtggtcatgtagaggcggtacgccctgaggaagtcggcgacggaggtgcggcggagcatgagcgactggtacaagcggctgcccgtgccggcgaggcgcgcctccaggccgtcggcgaagcagtgcgccagcctctgcgcagcgtcgcccgtgggcgaggagtgccgcccggacgcgtgg

SEQ ID NO: 1473 - DNA, 1492 bp, Glycine max
  misc_feature (1474)..(1474): n is a, c, g, or t
  misc_feature (1489)..(1489): n is a, c, g, or t
ctagctattcggctcgagcaagagggtcaaaagaatcttggcaaatagtaatgcaaatgcaacatgttctagtgagaaaatcacagaccccaagagggtcaaaagaatcttggcaaatagacaatctgcgcaaagatcaagagtgaggaaactgcaatacatatctgagcttgagcgaagtgtgacttcattacaggccgaagtttcagtgttgtctccacgggttgcatttttggatcatcaacgtttgcttctgaatgttgacaatagtgctttgaagcaaagaatcgcagcgctggcccaagacaagattttcaaagatgcacatcaagaagcactgaagagggagatagagagacttaggcaagtttatcaccaacaaaacataaagaagatggacaatgctgcagggtcaccaccatcccaatccccaccatctccatcaccaaaaccacgatgtgaaactcacactgaaaaggaacagcttatcaatgtttgaagtttgaatttgaaccctccatttgaagactcactcactcaccctttatagactatgatcaaattaacatatcaaccacctagcttgttcaaaaaaatatcaaccacctagtgtatgctagtttagatgatctgtgattcctttcaatattaaaaaagaaattgcagaattttgaaaataggagaaaaggagaaaaaaaatatgtacaaaacttgaatgcatttataggtgattttggtattattatttttttatcagaatctgagttttatctcgataatctgtgtaattcatcaaatgccaacacaaatgccaacacagattaagtaaaaccctaattttgattagaaaataacaccaaaatacctattaaagtgcaattaagttttgtgattagaagaaaaaaaaaatgttgtgtgactgcttgtagttgtaatgtaatgaatgtcatcacgtactgttgggtagagagagggtgagaatttttattaggcaatcgatgatttgatgaagggaaatgttgttaaatgagaagagggtcatcacattacattataatgtggtgtggtgaggccacattggtggtggtaggcttttgctatcaaactgagacagtcacgtgatgtgtttactttaaagaaaagggggaccactcaagttgcatgattgagaatgcagggaaacacatgtgcaccagtgacatcaaagagagggtggaagaaaaaaacagttgtgtctgctttaactagattctttcagttattttttattatttcttattattatttgttttcttcttgattattttcttttaatttaatttttattttttcttgggttttttttcttccaatattcaagttggaaaacaaagactagtgggcgtgtgtgttgggatggatgaaaggaaggtatgtcattatcagtgaaagtctcatggctcttctctgagttttgttgcactttgtgttactncttttaaggcatgtnatt

SEQ ID NO: 1474 - DNA, 957 bp, Glycine max
  misc_feature (885)..(885): n is a, c, g, or t
  misc_feature (941)..(941): n is a, c, g, or t
acgaggttgcttattcaatagcgatttcagcgctgtacgttgccgataaaatttttgagctgagatattgtcgtgggtccctttaggctcattttgtttcctctatcatttttggagtatttgatttgatctcccgtccgctggctaggtgtttttgtatcgatgtttatatatatatatatatggacacagacattgcatgtatatatatatatatatgcgtagattatcataaaacacatgtaagttttgtgtttgttggtttatatatatagttctctctttcattcttgttcttcttcattcatcttttcatcttcttgtctgagagttgtgttgattgattggtgtgacccaaaaaatggctcaattgccaccaaaaattccaaacatgacacccaattggccagacttctcttctcctcaccaaaagatgccttccctcaaaaccatgtcacctaaccaaaacccttcatgggtggatgagtttcttgaattctccgcggcgagacgtggggcccaccggcggtcggtgagcgactccatcaccttcttggaggcaccattgctggaccaccatcattgcaaaggtggcagtgttggtggtggtggcggtagcggcgacaacgagttcgagaggtttgatgatgaacaattcatgtccatgtttagtgatgaggcttcagggaataataataataataataataataataataataataataataccatgatggaaaacgcgttatcctcttccaacccttctacaccttccgatcacaacagcatcaatgatgagaaggaaatgaacaacaaggaagaggaagggaagaagcaagtgaagaatgagtccgaggaggatgaggatgaaagccaatgcanacaagatatcacgcaacttgcccaacatgatgatagtaaaaacaatagtgatgcanatgcaacatgttctag

SEQ ID NO: 1475 - DNA, 1471 bp, Glycine max
gttcttcttctccttgtggccttcttccctctaacattccctgtggtttctctgaacatatttatataaaggttgtcctgtagccttagaggctcatttggtttaatttgcctatgtcatatcatatgtactccttttttcatttcctctctcatttttggagtatttgatttgatgtgcatatatatacacacacattacaggtatatatatgcttagataatcaaaaaatatataccaagttttgtgtttggtttatatatatagttctctctttctctctctttcattcgtattcgtcttcttcatcttcatcgtttcatcttcttgtcacagtgtgttgattaattggtgtgactcaaaaaatggctcaattgccaccaaaaattccaaacatgacacccaattggccagacttttcttctcttcaccaaaagatgccttccctccaaaccacgtcatcaaaccaaaacccttcatgggtggatgagattcttgagttctcagtggcgaggcgcggggccccccggcggtcggtgagcgactccgtcactttcctggaggcaccattgctggaccaccatcattgcaaaggtggcagtgttgttggtggtggcggcggcaacaacgagttcgagaggttcgatgatgaacaattcatgtccatgtttagtgatgaagcttcagggaacaataacaataataataccatgatggcacacacgttgtcctcctccaacccttctacaccctctgatcacaacagcatcaatgatgagaaggaaatggaaaataaggaagaggaagacaagaagcagttgaagaatgaatcggaggatgaggataaaagcctatgcaaacaagatatcacacaacttcccaacaatgatgacagtaataatactagtaatgcaaatgcgacatgttccagtgaaaaaatcacagaccccaagagggtcgagagaatcttggcaaataggcaatctgcgcatagatcaagagtgaggaagctgcaatacatatctgagcttgagcgaagtgtgacttcattacaggccgaagtttcagtgttgtctccacgggttgcatgtttggatcatcaacgtttgcttctgaatgtcgacaacagtgctttgaagcaaagaatcgccgcgctggcccaagacaagattttcaaagatgcacatcaagaagcactgaagagggagatagagagactgaggcaagtttatcaccaacaaaacataaagaagatggacaataatgctgcagcgtcaccaccatcccagtccccatctccatcaccaaaaccacgatgtgaaactcacactgaaaaggaacagcttatcaatgtttgaagtttgattttgaaccctccctttgaagactcactcaccctttatagactatgatcaaacatatcaaccacccagtgtaagctagtatagatgatctgtgattcttttcaatt

SEQ ID NO: 1476 - DNA, 1254 bp, Glycine max
tccacgcgtccgtccacgcgtccgattatgttgttttatgttcgtgtggctttcttgcctctgacaacattcccctgtgattgctgggaacatgcacatacatatatatttataaaagggttgtgttagagcctagaggctcatttgtttccatttcttcttctcgcgcattgacacatccttgttgtgctgcatgccttatgcaatatatttgcacatacaataatgtgtgcatatatacatatatatgtatatatatcatttgttagggacatgttaatgtactacaacaaaaacattaacatcatctgaggttaatttgcattttgcaacaacagttactgatttggcgtgtttgaactttgaattcaaatgacgcaattacctccaaagatcccaaacatgtcaccaagttggccagatttctcttcacaccaccagaagatgcaattgccacctctttaattcggcggctgcaacactaacaattatcagcacaaccagaacccttcttgggtggatgagtttcttgacttctcctcggcccggcggggcgctcaccggaggtcggtgagcgattccatcacctacttggattcaccagtgaagtgtggagggaataaaaacaacaacaacaatgagaacgagtttgacaagtttgatgatgaacaattcatgtccatgttcacggatgaagtagtgctctctggggtccccttgccaccaccaaccaccttgtcctcctctaacccttcaagcccttacgatcagaacttcatcaatgatgagaaggagaagaaggaggaggaagaggagcaccaccaccaccaccaattgaaaaatgaagcagatgaggttgaaagccaatgcaaacaggaaattatgcagcttccaaatgacaccaatacttgttcttccagcgagagaattactgaccccaagagagtcaaaagaatcttggctaatagacaatctgcacaaagatcgcgagtgaggaagctgcaatacatatcagagcttgagcgaagtgtaacttcattacaggccgaagtttcagtgctgtctccaagggttgcatttttagatcatcaacgattgcttctaaatgtcgacaacagtgctctcaagcaaagaatcgctgcccttgctcaagacaagatcttttaagatgctcatcaagaggcactgaagagggagatagagagacttaggcaagtttattacccacaaagccttcagaagatggaaaatgct

SEQ ID NO: 1477 - DNA, 498 bp, Glycine max
cacatcacgtgaaagttttctagttagcatgaagggacattcattcattcatccatctacagcactattccttgtctcttccccctcaactgaggagctgctccttgttgtccttgcatcccaatggttgagacactgctatcggctgctgatgatgatgaagttgcattggttgttgttgtggctgtgatgttggtgtggtttgttgaagattgctgttcatcttttgtaggttctgttggtgatagatttgccttagtctctctatttccttctttaatgcttcttggtgagcgtctttgaaaatcttgtcttgggccaaagcagcaatgcgttgcttcaaggcactattgtcgacattaagaatcaaacgttgatggtccaggaatgcaactcgaggtgacaatgctgatacctccgtctgcaaagttgttacgctcctttcaagctcagaaatgtattgcagctttcttacccttgacctctgagctgattgcc

SEQ ID NO: 1478 - DNA, 427 bp, Glycine max
ggtatacatatatataatagcatttgttcgggacatgttaatgtactattgcaacaacaacaacattaacatcatctgaggttaatttgcaactacacttcctggtgtatttcaattaattcaaatggcgcaattacctccaaagatcccaaacatgtcaccaagttggccagatttctcttcacaccaacagaagatgcaattgccacctcttaataacaacggcaccatcaccaacaactatcatcagcacaatcagaacccttcttgggtggatgagtttctcgacttctcctcggcccggcgcggcgttcaccggcggtcggtgagcgattccatcacctacttggattcaccaatgaaatgtggaaggaattaaagcaacaacaacaatgggaaccagttttacaaggttgatgatgaacaa

SEQ ID NO: 1479 - DNA, 379 bp, Glycine max
  misc_feature (356)..(356): n is a, c, g, or t
ttcttcattcatcttttcatcttcttgtctgagagttgtgttgattgattggtgtgacccaaaaaatggctcaattgccaccaaaaattccaaacatgacacccaattggccagacttctcttctcctcaccaaaagatgccttccctcaaaaccatgtcacctaaccaaaacccttcatgggtggatgagtttcttgaattctccgcggcgagacgtggggcccaccggcggtcggtgagcgactccatcattgcaaaggtggcagtgttggtggtggtggcggtagcggcgacaacgagttcgagaggtttgatgatgaacaaatcatgtccatgtttaatgatgaagcttcanggaataattataataataataat

SEQ ID NO: 1480 - DNA, 300 bp, Oryza sativa
agaggattttggcaaacaggcagtcggcgcagcggtcaagggtgagaaagttgcagtacatctctgagcttgagcgcagcgtcaccactctccagatggaggtgtcagcactgtcacctcgtgtggccttccttgatcatcagcggtcgctgctcaccgtcggcaacagccatctcaagcaaagaatcgccgccctcgcacaagacaagatcttcaaagatgctcaccaggaggctctgaagaaggagattgagcggctacgccaagtgtaccaccagcagcagatcaaggccaccggag

SEQ ID NO: 1481 - DNA, 547 bp, Oryza sativa
  misc_feature (503)..(504): n is a, c, g, or t
ctcgggtggcgtttctggatcagcagcggacgatcctgaccgtcggcaacagccacctcaagcagcggatcgcggctctagcacaggacaagattttcaaggatgctcatcaggaggcgttgaggaaggagatcgagaggctgaggcaggtataccagcagcagaacaccaagttgtccggtggtctggccgctgaccacgcacatgtccatggcggcccgccgcctgtgcgagcagagaaggagctcatgagctagctgatcaatttgcctactgtcccctgtgcagtctgccttagcattaactttggagggaacattgcatcatgaacctgtggatgttttcttcttcttcttttttttttgtttttttattcttttacattgacttgtgtattcttgattcggttgttgattggagttctggtttacaatgggaattgtgggagatgtcaataagaaaatgtgaactgcaataagattaactgtgatttttgaaagccnnaattaataataataaaaatatttaaatttaattatataataaa

SEQ ID NO: 1482 - protein, 346 aa, Oryza sativa
MAQLPPKIPVAAPGHHQHWASAGGAGDAAWADEFAEFAASRRGAHRRSLSDSVAFVEVAPAGCGAGGEFDRLDDDQLMSMFPDEGGSSAPGSDNGGSDSDGGGDKHAAAQSDDGQHAAGEPTQEQAAATSPTELIRDPKRVKRILANRQSAQRSRVRKLQYISELERSVTTLQKWRQFETDRWTQPHWLAGNSTQCGEEMSESNEVSVLSPRVAFLDQQRTILTVGNSHLKQRIAALAQDKIFKDAHQEALRKEIERLRQAVLACYRLTAPDLLCMIWFPLLGERNHRRRKTCAAYRYRGTPLLLQFQGQVAQRAIQHLHYSEFAVYGSGSAMINHATCGVLVSRY

SEQ ID NO: 1483 - protein, 324 aa, Oryza sativa
MAQLPPKIPTMATAWPEFGGGHHHHAAHGHHHQRSPSMGAFLAAPLPPFPLPPPAPANGGAQQQQQQQQHQPSWVDEFLDFSATKRGAHRRSVSDSVAFLDPVSDDNAGVGAHDFDRLDDDQLMSMFSDDLQPPPPQQQPAAPAASASSPSDHNSMNDEKQDKGETDEAQSECDGATPGQPASPATVDPKRVKRILANRQSAQRSRVRKLQYISELERSVTSLQTEVSALSPRVAFLDHQRSLLTLGNSHLKQRIAALAQDKIFKDAHQEALKKEIERLRQIYHQQSLKNAESQPADAAPVRGRDNADLIGSEGAAAAAPCPHS

SEQ ID NO: 1484 - DNA, 326 bp, Zea mays
agcccacgcgtccggtttccggcgttgcgccaccgttcccgcgtgttgcgttgattcctcgggtcgaaccaacgcgcggcgcggggtcccggtcgcggccatggcgcggctgccgcccaagatccccaccgtagcgccggcgtggccggagttcgggggcgggcaccaacagcagcgcagcccctccgtgggcacgttcctcgccgccgcgcccatgcagccgtcgtgggtggacgagttcctcgacttctccgccgccaagcgcggcgcgcaccgccgctccgtcagcgactccgtggccttcctcgagcccgaacccggccccg

SEQ ID NO: 1485 - DNA, 1490 bp, Zea mays
  misc_feature (35)..(35): n is a, c, g, or t
  misc_feature (67)..(67): n is a, c, g, or t
  misc_feature (71)..(71): n is a, c, g, or t
  misc_feature (96)..(96): n is a, c, g, or t
ggtacctcgaggcggccgggaattcccgtccgtcntcatcccctcgcctcggcacaagctacccggngggnccggacgagtggtgccgtggcggtnctcgtagctactgcactgcatcactataaagctaagctccaggccccgcgcccccccgcgatcgcgagatctagcgagcgagcgcgcacactgctggcggcaccaggctacgacgatcgagagagccgccgtgccagcacattgtccattgtccgcgcggcgggggatcgggcggacgcgcacataatatggcgcagctgccgcccagggtcccgaccgcggtgcaccgctggccggagggcggccaccacggcgcggcggcgtgggccgatgacttcgccgagttcgctgcgtcgcggcggggcgcgcaccgcaggtccctgagcgactcggtcgccttcgtcgaggtggcgcccgcggccggcgagttcgacaggctcgacgacgaccagctcatgtccatgttccccgacgaggccgccgccggcggcggcggcggcgggtcgtccgcggcagggtccgagaacaacggcggcagcagcgacagttacggcgataggcgcggcggcggtggccctgcggcgggaggcaccagcaccaccaccagctgcaatggcttcgatggtggcgagcacaacgaagccgcggacgcgcaggcgacggggcaagctgccgccgccgccgccgcctccacggagctgatccgggaccccaagagggtgaagaggatccttgccaaccggcagtcagctcagaggtcgcgggtgaggaagctgcagtacatctccgagctcgagcgcagcgtcacaacactgcagaacgaggtgtccgcgctgtctccccgtgtggcatttctggatcagcagcgtaccatactgaccgtcggcaacagccacctcaagcagcggatcgcagctcttgctcaggacaagattttcaaggatgctcatcaagaggcgttgaagaaggagatcgagaggctgcgccaggtctacgagcagcagaacctcaagatgtcagccggcgctgctgcctctgaccatggcccgccaccggtgcgcgcggagaaagagctcatgagctagctacccagtcgatccacgcgtgcccgctgtgcagtgcagcccgcccgccttatcattaattaacatggagggaacattgcatcatgatttctctttttttcggattatgtggatgttttcttctttctttctttcttcttccattgacacgtgtgcgttaattctttgtatgttgattttgggatttggttcactgtgcaaattgtggtaaagtcatcagggaaactgatctgttgtgtaaatcacttttttgaagcattacattcctgggaatctggttacccatgatttttttgtggtctttctttttttcccctttagtagtgtgattagataccacaatatttggcaggtttgagttcgatgtaa

SEQ ID NO: 1486 - DNA, 990 bp, Zea mays
  misc_feature (61)..(61): n is a, c, g, or t
cattgggtacctcgaggccggccgggatcgcgagatctagcgagcgagcgcgcacactgcntggcggcaccaggctacgacgatcgagagagccgccgtgccagcacattgtccattgtccgcgcggcgggggatcgggcggacgcgcacataatatggcgcagctgccgcccagggtcccgaccgcggtgcaccgctggccggagggcggccaccacggcgcggcggcgtgggccgatgacttcgccgagttcgctgcgttgcggcggggcgcgcaccgcaggtccctgagcgactcggtcgccttcgtcgaggtggcgcccgcggccggcgagttcgacaggctcgacgacgaccagctcatgtccatgttccccgacgaggccgccgccggcggcggcggcggcgggtcgtccgcggcagggtccgagaacaacggcggcagcagcgacagttacgccgccgcctccacggagctgatccgggaccccaagagggtgaagaggatccttgccaaccggcagtcagctcagaggtcgcgggtgaggaagctgcagtacctctccgagctcgagcgcagtggcgcttccctgcagaacgaggggtccgcgctgtccccccgcgtggcgtttctggaccagcagcggaccatactgagcgtcggcaacagccacctcaagcagcggatcgcagctcttgcccaggacaagattttcaaggacgctcatcaagaggagctgaagaaggagatccagaggctgcgccgggtctacgaccagcagaacctcaggatgtcagccggcggcgccgccgcttctgaccatgggccgccaccaccggtggtgcgcgctgagaaggagctcatgagctagccagccagtccatgcgtgcccgatgtgcagtccgccttatcattaacatggaaggaacattgcatcatgattttttttttcagattctgtgaatggtttcttccttcctttttttggg

SEQ ID NO: 1487 - DNA, 728 bp, Zea mays
ccacgcgtccggttgttcctaagcgcgccaagaggaccctggcgaaccggctgtccgcgcagcggtcgcgcgtgcgcaagctgcactacatctcggagctggagcgcagcgtcacgtcgctccagacggaggtgtcggcgctgtccccgcgcgtggcgttcctcgaccaccagcgctcgctgctgacgctggggaacagccacctgaggcagcggatcgcggcgctcgcgcaggacaagatcttcaaagatgctcatcaggaggcactgaggaaggagatcgagaggctgaggcaaatctaccaccagcagagcctgaagagcggcagggagcccgacgcggccccgtcggtccgcgacgacaaggacatgatcggcagcgaggggaccgccgcgcccggcccgccctcgtgatgaggaggaggtggttgggggcgacacgtccagacatccgagtcggtcgctgtagtcggggatggccctgtcgcccgccctgcagcccatcacagcgaggttgccgctgccgctgctaggattggtgtgtgtgtgccgtgtgcgtgtccgtgtgtgcattctttgggggtgtgtaacgtgatgtgatgtaaagagaagaggaactgcatcggtttggtttggtttggttatccttgcatgcatatgcatctgcatcctctcctgctgccttccaccacctcccctgaattgtaatttttggtcgagcattttggg

SEQ ID NO: 1488 - DNA, 627 bp, Zea mays
gggccggccaaggcgtcggggtaaatctcggacctggagcgcaccgtcacgtcgctccagacggaggtgtcggcgctgtccccgcgcgtggcgttcctcgaccaccagcgctcgctgctgacgctggggaacagccacctgaggcagcggatcgcggcgctcgcgcaggacaagatcttcaaagatggtgaccgccattgccggccgcccctgctcctcccgactacgaccctcgccgctcatcaggaggcactgaggaaggagatcgagaggctgaggcaaatctaccagcagcagagcctgaagagcggcagggagcccgacgcggccccgtcggtccgcgacgacaaggacatgatcggcagcgaggggaccgccgcgcccgggcccgccctcgtgatgaggaggaggtggtggggcgacacgtccagacatccgagtcggtcgctgtagtcggggatggccctgtcgcccgccctgcagcccatcacagcgaggttgccgctgccgctgctaggattggtgtgtgtgtgccgtgtgcgtgtccgtgtgtgcattctttgggggtgtgtaacgtgatgtgatgtaaagagaagaggaactgcatcggttcggtttggtttggtt

SEQ ID NO: 1489 - DNA, 1650 bp, Zea mays
tcgaggccggccgggccgggaccatttttcctccgttccattcttctctcctcgcctcccctcgcctcccctcttgaaccctccgccgctccgaggaaaatccgatttgaattgaaaatcatccggagacagagatcttttcttcctcgaagctatcttctctgtcgactcgatccatagctgctcgcgtccctgttcctcgccggctggcaagtggcggcgacgggacgaggtcttcatcgcctcttcgcgagcgacgatcacccactagtttggtcggtctgaggcacatgatgatggccaacgcgaagctccacaagcaggccctgctgccgccgcggagccccttcccgacggcggcgccgtacgccgaccgcggcccaatcgcgcggccgcaggttggctccacgcaccaccgccacggccaccaccagcgcacgtcgtccgagagcttcatcgaggagcagccgccgtcgtggctcgacgacctgctcaacgagccagagacgcccgcggcgcggcagagcggccgggctgggcaccgcaggtcgtccagtgactcgtttgcgttgtttgacggtggagctgctggtgctggtgcttacgccaatggtttcgaggggatgggggagaggaggtgggcaacctgcgccgtggggtggtgtgcaggagtactatgccaagctggccccgattgggagggcacatggccggccgtgggagcaaggcatgccgaattcggcgggcttcaggcatggtggtggcctgccgatgcccacaaaagataaggttggtgggcatcatgggccaccgaaagtgtcgagggagcatgaccatggcatggacaagagaactgatgatgctggccatgatcaaaaggttggagccaaggagggtgtgccgccgaagcatgcacagtcagaggcggacaacaagcgtgctaaacagcaatatgctcagaggtctcgtgtccggaagctgcagtatattgcagagcttgagagtagagtccaggcattacagtcagaaggggtagaagtgtctgctgaaatggagttccttagccagcagaatatcatgctagacctggaaaacaaagccttgaagcaaagagtggagagtctagcacaggaacaacttattaagcgttttcaacaggagatgtttgagcgggaaattggtcgtctcagaacaatatatcagcaacagcagcaacaacaggctcctgctcttgttcgtagtaacagcagggaccttgatgtgcagttcgccaacttgtctctgaaacacaaagaccccaacacgggccgggatgctctctctgggcctcttcgtacttagttctttccatccttccgttcttgtgggttctatcagtggccaccactgtgtctgtcatctccaccaagaaaggagaagtgcacttggattgtgtgaaaaacaccggaaaaaggctaatagctatggatctgatgtttattatttcgggatatgcacctggcggtcatcctcagctcgcgtccattggtgatgctcgaccagtcggcggtgtttagggggttttgtttttagctagatgcttttcaagcatcattgtaccatttttcatgctagggttctaatctgttactacccccgttttcctgaact

SEQ ID NO: 1490 - DNA, 919 bp, Zea mays
  misc_feature (846)..(846): n is a, c, g, or t
  misc_feature (848)..(849): n is a, c, g, or t
  misc_feature (851)..(854): n is a, c, g, or t
cccacgcgtccgatctcggagcttgaacggagcgtcaccagtctccagatggaggtgtcggcgctgtccccaaaagggtcaagaggatattggcaaacaggcagtcggctcagaggtcacgagtgaggaagctgcagtacatctcggagcttgaacggagcgtcaccagtctccagatggaggtgtcggcgctgtcccctcgcgtggccttcctcgaccaccaccgctcactgctcaccgtcggcaacagccatctcaagcaaagaatcgcggcgctcgcccaggacaagatcttcaaagacgctcaccaagaggcgctggagaaggagatccagcggctgcgccaagtgtaccagcagcagcaggtcaaggtggccaccaccggcggcgccgacatcgccaccgccgcctcgccgtcgatgcaggccaggcaagagctgctcgcgtgcgagggcgctgctattcgatagcggaggcggcggcggcggcggcggcgttcacgcccctgttactgttagtagcttaattaacttttgtgcagtctgatcaatacgtgttggcttgtttgtttgctgcttcttaatttaattcgtatgtgatgtattctgctcaccctagcaaaaaaaaaaaaaaaaatgcatcgatgccaagttgtgaatgaattgtactattcagttatttggaccggcttagtcggaatatagtgagacggagtttgttggtgtgagttatccgttcttaatttattgttgtttagattgattttatttaaaaaaaaaaaaaaaaaaaaaccaagaaaaaaaaaaaaaagaaaaaaaaaaaaaaaaaaaaaaaaaaaaaaaaaananntnnnnaaaaaaaaaaaaataaaaaaaaaaaaaaaaaaaaaaaaaaaataatgggggggggcctttttagg

SEQ ID NO: 1491 - DNA, 1175 bp, Zea mays
  misc_feature (1170)..(1171): n is a, c, g, or t
  misc_feature (1173)..(1173): n is a, c, g, or t
cccagcgtccgccccgcgtccgcagctagcagaagcacagtcgagcactccaccatccagcttcgcatcccgcaagttcccagtcagccgagcagccagcggcggtgccaagaaggccgagctgcgagctccactccccacacctcagaagaaaaaggtgatggcgcaactgccgccgcgggcgccgagcgccgcgccgcaggaccactggccgccggcggcgggggagttcctgggcttcgccgcggccaggcgcggcgcgcaccgccgctccgcgagcgactcggccgcgttcctcgaggccgtgcccattgacgacgacgtcgtcacgcgcggcggcggcggcggcgacgacttcgaccgcctcgaccacgaccagctcctgtccatgttctccgacgtcgacgtctccgtctccgtctccgtctccggcagcgccggggagagggcgcagctcatggacgcggggggtgcggacgacggggtggcggactcgtcgccggctgccgcggacggcgtcgctgagcccaaaagggtcaagaggatattggcaaacaggcagtcggctcagaggtcacgagtgaggaagctgcagtacatctcggagcttgaacggagcgtcaccagtctccagatggaggtgtcagcgctgtcccctcgcgtggccttcctcgaccaccaccgttcacttctcaccgtcggcaacagccatctcaagcaaagaatcgcggcgctcgcccaggacaagatcttcaaagacgctcaccaagaggcgctggagaaggagatccagcggctgcgccaagtgtaccagcagcagcaggtcaaggtggccaccaccggcggcgccgacatcgccaccgccgcctcgccgtccatgcaggccaggcaagagctgctcgcgtgcgagggcgctgccattcgatagcggtggcggcggcgttcacgcccctgttactgttagtagcttaattaacttttgtgcagtctgatcaatacgtgttggcttgtttgtttgctgcttcttaatttaattcgtatgtgatgtattctgctcaccctagcaaaaaaaaaaaaaaaaaatgcatcgatgccaagttgtgttggaccggcttagtcggaatatagtgagacggagtttgttggtgtgaaaaaaaaaaaaaaaaaaannanag

SEQ ID NO: 1492 - DNA, 624 bp, Zea mays
cggacgcgtgggcggacgcgtgggcggacgcgtgggcggacgcgtgggcagcgctgtcccctcgcgtggccttcctcgaccaccagcgatcgctgctcaccgtcggcaacagccacctcaagcaacgaatcgcggcgctcgcccaagacaagatcttcaaggatgctcatcaagaggcgctgaagaaggagatcgagcggctacgccatgtgtaccagcagcagcagatgaaggtggccaccaccggcggcgccgacatcgccgcggcggcttccatgcaggccaggcaagagctgctcgcgtgcgagggcgctgccattcgatagcggatcgagggcggaggcgttcaactggcagtgccacaacaacaacaccagcaccgaactttgtgccgggttcctccttttctcagtcagacaagttgttcgtcgtgcgtgggaaatacacgtcgcctgttagtagcctattgattttatttctgtgcagtcttaattaattcgtatatgtgatgtattcgtcctcctccacccagagcaaaaaaacaaaaagaaggcccccccgtgctgggatggagacttgttgtgaatgaatgaatgaatgtatttggttatttggccgggcttg

SEQ ID NO: 1493 - DNA, 1154 bp, Glycine max
ggttttccccccgagggaagaggcggctcgaggagaaggacgaggaggttgaggatttgagtttcgatggctccgggttgaactatgattctgatgacttgactgagagcaattataataatgtttctgagggtaatactgggaagaatggtggggttagttccaacgcgaacagcaccgtcatcaccggtttggatcaaaaagggaagaagaagggaatgcctgctaagaatttgatggccgaacgacgccgtaggaagaagctcaatgatagactctacatgttgaggtccgttgttcccaagattagcaaaatggacagggcttcaattcttggggatgcaattgagtatctgaaggagcttctgcaaaggatcaatgatctgcataacgagttggaatcgacaccagtgggttcttcactcactcctgtctcaagtttccatcctttgacgcctactcctcctacgctgccaagccgaatcaaggaagaactgtgccccagctcattgcccagccccaatggccaacctgctagggttgaggttcggctgcgcgaaggaagggctgttaacatccacatgttttgtgcccgcaagcctagtctgttgctctcaaccatgagggctttggataaccttggattagacattcagcaggctgttatcagctgcttcaatggatttgctatggatatttttcgagccgagcaatgcaaagaaggtcaggatgtccatccggagcaaatcaaagcagtactcttggattcagctggctacaatggcatgatgtaactagttttgacaagaaacaaactggtagctgctatttcacagtcaatttggcaagttaaatcagaatcagtttttactttgttatgttcacaattcaagtgtacgatactagctctggtaacttgagttaaagttgaggtagaagaaattttcacatgaattttacccccggcagcggcagttactatttggtacctttcacttgctcatgtcgaaccgaatcttgatgctactacttcgacttcaattagttcagggacatttctgaaggcgcgttttgacgtgaagtttgtatttatgtttgtcgaacctattgtcctctttatacagttttcgcccaggacaaaactttaaagcaaa

SEQ ID NO: 1494 - DNA, 673 bp, Glycine max
gatagactctacatgctgagatccgttgttcccaatattagcaaaatggacagggcttcaatccttggggatgcaatcgagtatttgaaggaacttctgcaaaggatcagtgagcttcacaatgaattggagtcaacaccagcaggtggctcttcaagctttcttcatcatcctttgacacccactactctaccagcccgtatgcaagaagaactttgtctcagctcgttgccaagccctaatggccatcctgctaatgctagggttgaggttgggttgcgcgaaggaagaggtgtaaacatccacatgttttgcgaccggaaacccggactcttgctctctaccatgacggctctcgacaaccttggactagacattcagcaggcagttatcagctatgtcaatggatttgctatggatattttcagagctgagcaacgcaacgaaggtcaggatgtccatccggaacaaatcaaagcggttttgttggattcagctgctggcttccatagcatgtcctaattgcaaaaaacaaactactactgaaaataccttttcaattagtcaatttagcaatcttaatgtttttaacgctcaaaattcaactgtactatatacaggctcttttaacttctgctcagttgaattaggagaaaatttattttaccaatta

SEQ ID NO: 1495 - DNA, 961 bp, Glycine max
caaaaaagaaacgaaaagaaataaaacgatttattacatctcttaataataaagacaacagcataagttcgctttcgtcagaagcagaattgaacaaaatatcaaagctaactcctaaaactacagatttaactaacctatttgatctgggcctaaacagttcaaaggagaagaagaagcaatgcatttacaaactgcaagctacagcaactacggttggctcctctatcagggggaagcatttatcaagcattccaatcacatcataccatggaagccagcagaatccgagagcaccgctttaatttgctcagggaggacatcctggccttctctgcattgctcagctttgaacacatctaaagcaaagccattaaaacagctaataacagcctgctgtacatccaatccgaggttatccaaagccttcatggtagaaagcaaaagacctggtcggcgggtgcagaacatatgaatgttgacagttctcccttcccttactctaacctcaacctttgcagcttggtttttagggcttggcaaggtgccaggatacagttcctccttgacccggcagggaagggttggcagggtgggtgttagaggctgaaagcttgtagaagaagaaggtgtcagcgacgagccaggtggagttgactctagctcgtgatgaagatcattaatccgcggcagcaactccttcaagtagtcaattgcatccccaagtattgaagcccggtccatcttgctaatcttggggacaacagacctgagcatgtacaacctatcattgagcttcttccggcggcgcctctccgccatgagattcttggcgggcagccccttcttcttccccttgttatctccaccattctcactcagcttcaacccattgctctcattctgctcatcagactcatagttcaacccggacccacgcgtccgcggacgcgtgggtcga

SEQ ID NO: 1496 - DNA, 426 bp, Glycine max
ggggcccaacccacccttttccagaagagagccgcgctcaggaagaacatgaacatgagtgacaataagaagaggaaggagaaggatgaggtggtggttgaggatgtgagtttcgacgggtctggcttgaactacgattctgacgacttaactgagagtaattataatgaccctaaggagaagaatggtggtgggggggttagttccaatgccaacagcaccgtcaccggtttggatcagaaagggaagaagaagggaatgcctgctaagaatttgatggcccaaccacgccccccgaagaagctcaatgacagactctacatgctgaggtccgttgttcccaagattagcaaaatggacagggcttcaattcttggggatgcaattgagtatctgaaggagcttctgcaaaggatcaatgatctg

SEQ ID NO: 1497 - DNA, 1517 bp, Oryza sativa
  misc_feature (828)..(828): n is a, c, g, or t
cagagcgctgcgaggcaaggaggcgagcaagaagcggcggcgaggttgccatggacgaggcggaggcggcggcggcggcggcgaagatggacgagctggcgggaggaggaggaggaggcggcggcgactggtcgtacctcgcggcggacgcgctggcggcggcgtcgttcacggcgttcccgttccaccaccaccaccaccaccaccaccgcgacgtgctctcggcgtcgaccccgtcgtcgctgctcctcaacatggacgcggccaccgccgcggccatgttcgacttccaggcggccttcccgtcgtcctccgtcccgccgccgccgcccacgacgacggcggcgctcccgccgttccacgacttcgcctcctccaacccgttcgacgacgcgccgcccccgttcctcgcgccgccggggcagaagctcgggttcctggggccccccggcggcgcgttcggcggcgggatgggggtgggacgacgacgacgagatcgagcagagcgtggacgcctcgtccttgggtgtctcggcctcgctggagaatgccgcgcccgtggcggccggaggaggcggcggcggtggcggcggcggtgggaggggcaagaagaaggggatgccggccaagaacctcatggcggagcggcggcgcaggaagaagctcaacgaccgcctctacatgctgcgctccgtggtgcccaagatcagcaagatggacagagcttctatccttggtgatgcaattgagtacttgaaggagctcctgcagaggattaacgatcttcacaatgaacttgagtctgcccctagctcttcgcttactggnaccatcatgcggctgagcttccacccatcaacacccacattgcagacgtttcctggccgcgttaaggaggaactttgcccaacctcatttccaagccctagtggtcaacaagccacggtcgaagttaggatgagggaaggtcatgcagtcaatatccacatgttctgcgcacgcaggcccggcattctgatgtccacattgagggctctcgacagccttggcctcgggatcgagcaggcggtcatcagctgtttcaatgggtttgcaatggatgttttccgcgccgagcaatgcagggatggtcctggactcgggcctgaagaaattaagaccgtgctcctgcactctgctggccttcagaacgcaatgtaatcagcaagtcagaaagcagtcaagaccaatgcactgggatttgatcagtgatcatttgcatcagatgatctggtttatcaaaaagttatagtaagtatggcatatatgctgtttatctaggagaactgatgagatgaggctcgccatctagagacatgtgtgatgatgatgatgtaactgggtttctttctttctgttgtcgttttttttttctgaatgttgtttgtgatgtaataggatctttgtcccattgaaaccatgtccattatcatgatgagaatatgaacccagtgtttttggatgaaaaaaaaaagaaa

SEQ ID NO: 1498 - DNA, 484 bp, Oryza sativa
  misc_feature (32)..(32): n is a, c, g, or t
  misc_feature (39)..(39): n is a, c, g, or t
  misc_feature (46)..(46): n is a, c, g, or t
  misc_feature (78)..(78): n is a, c, g, or t
  misc_feature (150)..(150): n is a, c, g, or t
cggagtcggagagagacacaagccaacctcgnaactcgnaagcagnagcaaacgcgaagcagaagcaagcgccatggnacgccgagaatggccatgggcgagagcttcgcctactactgggagacgcagcgctaccttggagtccgaggnagctcgacagcatgtacctgccgacgcaggatgactccaactacgagtcgagctcgccggacgggtcgcactcgtcgtcggcgccggcgccggcggccgtgggcggggacgcagccgccgcggtggcgggtagcggtggcgggatgacgacgatgatgatgggcggcggcggcggcggtggcgacgacgccggtggcgcgaacaagaacatcctcatggagcgcgaccgccgccgcaagctcaacgagaagctctacgcgctccgcagtgtcgtgcccaacatcaccaagatggacaaggcgtcgatcatcaaggacgcgatcgagtacatcca

SEQ ID NO: 1499 - protein, 412 aa, Oryza sativa
MASLLGLLFSSLLFSERCEARRRARSGGEVAMDEAEAAAAAAKMDELAGGGGGGGGDWSYLAADALAAASFTAFPFHHHHHHHHRDVLSASTPSSLLLNMDAATAAAMFDFQAAFPSSSVPPPPPTTTAALPPFHDFASSNPFDDAPPPFLAPPGQKLGFLGPPGGAFGGGMGWDDDDEIEQSVDASSMGVSASLENAAPVAAGGGGGGGGGGGRGKKKGMPAKNLMAERRRRKKLNDRLYMLRSVVPKISKMDRASILGDAIEYLKELLQRINDLHNELESAPSSSLTGPSSASFHPSTPTLQTFPGRVKEELCPTSFPSPSGQQATVEVRMREGHAVNIHMFCARRPGILMSTLRALDSLGLGIEQAVISCFNGFAMDVFRAEQCRDGPGLGPEEIKTVLLHSAGLQNAM

SEQ ID NO: 1500 - DNA, 280 bp, Zea mays
  misc_feature (200)..(200): n is a, c, g, or t
  misc_feature (203)..(203): n is a, c, g, or t
ggaagaagcttaatgaccggctctacatgctccgctccgtcgtgcccaaaatcagcgagatggacaaggcctccattctcggcgacccgatcgaatacctgaaagagcttgctgggaagatcgacgacctccaaaacgagctggagtcaccaccatccccagcttccacggcctcgctgccttcgacgcccacgagcttncgncctctgacttccacgcttgccgccctaccatctcgcgtgaaggaagagctgtgcccgagcgcgttgcctagccctac

SEQ ID NO: 1501 - DNA, 849 bp, Zea mays
  misc_feature (777)..(777): n is a, c, g, or t
agatttaagggaagcaggatattctattgctgggagtagaacttgggcggcatggatcagcttgacgagcaatcgttcctggacgagctcatgtcgctgcgccgggaggaggcgccgtcgccggctccgtggcaggcgtatccgggcagcggcatgatgacgacgagcgacctcctcttctacggcggcgagggcaccaccgaggcgagcagcggcatggactttgccgggccgtttcagcagcccatggcgccaccgccggccacatctccgcaccggccgcacgagaagttcaacttcgactgcctcagcgaagtatgcaacccttacggcagctgcgtcggcggcgtacctaagcctggggtcgtccacgcggctggccaggcgtatgccctccaggatgccatggcgcagaacggcacgagtggcggcaagctgcatcacggtggtggcaggcgtcgtcgtccccggcgccgttcgtgttcgcaggtgtcgccggggagagctcggagatgaccaggggcgccttctccggcgcccacgctagaagcaagctcaacggtggcactacgtccaagaacctcatggcggaaaggcggcgccggaagcgtctcaacgaccgcctctccatgctccgctccatcgtgcccaagattaccaagatggataggacctcgatcctcggggacaccatagactacgtgaatgagctaaccgagcggatcaaacccttcgagggagagatcggcgccacgcccggaggatctgaacctgctngacaccacgaagaatttctccagcgggtacagtgaggagatgccgatgaggaatccaccaagtttgtcatcg

SEQ ID NO: 1502 - DNA, 1264 bp, Zea mays
  misc_feature (1261)..(1261): n is a, c, g, or t
ggtgggttctttgcgccgctgccggcctcgggcttcaacgacgccgggatgagctgggacgacgaggacgagatcgaccaaagcgtcgacgcctcctcgatggccatctcggcctccatggagaatgctgcgggcgcggtggcgggggcaagtggcgccggcggtggcagcgggagaggcaagaagaaagggatgccggccaagaacctcatggcggagcgccggcgtcgcaagaagctcaatgaccgcctctacatgctgcgctcggtggtgccgaagatcagcaagatggatagggcttctatccttggcgacgcaattgagtatctgaaggagctcctgcagaggatcagcgatcttcacaatgaacttgagtcagctccgagctcttcgcttgttggaccaacatcagctagcttcaacccatcaacaccgacattgcagacatttcctggccaggtcaaggaagaactttgcccgggctcattcccaagccctactggacaacaagccacagtcgaagtcaggatgagggaagggcatgcagtcaatatccacatgttctgtgcgcgtaggccaggcatcctgctgtcgacaatgacggccctcgacagcctaggcctcgacatcgagcaggcggtcatcagctgcttcaatggctttgcgatggacgtgttccgagctgagtgcgcggatggtcctggaatggtgcctgaagaaattaaggccgtgctgatgcacaccgccggcctccacaacgcaatgtagccggtccgaaaacgggccaccgccaggatgacgacgatcctcctcctttctactaagggcttcggttcggaagcggcataagattaagctgtggtggccattggttttctggggcaagtgatgaattttaagatgatgaggctcgccatctcgggcatgaggcatgagtgatgatgtaactatgggattcttttttttcttctcattagcctaatgtcggattttctcctctctgatacacttgtggtgtaatagaatctatgctgcgtgttgaacaatatatggtggtgaatggtgatgcggtagctagcatcaaactcagtgcctgttggtcagagatcgatggtgcaaagagagacgagttcattcatcagcgtccagcaatgattttgactggctatgggtccgtccgtccttgattcgaatcaaatgaattgaatcctctggcttcttgttccccaaaagttgtgggatgttgggggtattaatattnggg

SEQ ID NO: 1503 - DNA, 976 bp, Zea mays
  misc_feature (3)..(3): n is a, c, g, or t
ggnagggtaagaggaaggggttgccggccaataacctcatggcagtatcgcccgtcgccggtaagaagcttaatgaccggctctacatgctccggtccgtcgtgcccaagatcagcaagatggacagggcctccattctcggcgacgcaatcgagtacctgaaggagctgctgcagaagatcaacgatcttcagaatgatctggagtcgtccccttccacggcctcgctgcctccgacgcccacaagcttccaccctctgaccccgacgctgcccactttaccgtctcgcgtgaaggaagagctgtgcccaagcgcattgcctagccctacttctcagcaaccgagggttgaggtgaggatgagggaaggccgggcagtgaacatccacatgctgtgcgctcgcaggcccggtctcctgctctctgccatgagagcgatcgaaggcctcggcctcgatgtccagcaagctgtcatcagttgcttcaatgggttttccttggacatcttcaaggccgagctgtgcaaggaaggccctgggcttctgccggaggagatcaagtccgtgctcctgcagtccgctgggttccatggcggcgtgatgccgtgagctaggacaacaagaccgctgaaaaagagacagagagagagagaaaagaaagaacaatgtagctaaggggaagtttacatgaactggtgtttccagtctcagggttggttttcgtcttttaacagtttgagaccgttacagacctgctagtcttcctttaattagtctgatagagtagaaaataatgccggtgttctccttcctggtctgttctagttcttggtacatgcttttgccctgttcagttagctagctctatctcatgaaattccgaatcgaaatcaggtgccagtcaaatccgtgtcaggctctgttcggttgttatggatttgagctctggattgattcctaaaaaaaaaaaaaaaaaa

SEQ ID NO: 1504 - DNA, 489 bp, Zea mays
cgctgtcaggccacagattcgtcatccgactccgatgaggctgcatcctgtcgtcctcgactgttgactgctgtcgaggtatgctgcgcccgccatggagaatcagtgaacttttaccagagcgtcgacgcgtcctccatggagaatgctgcgcccgcggcggcagcgggggaggcaagaagaaagggatgccggccaagaacctcatggccgagcgccgccgtcgcaagaagctgaatgaccgcctctacatgctgcgctcggtggtgcccaagatcagcaaggcttctgtaacacgggcgcttaagaaaggcactacactcgattctgtcatagagatgctgaagggggttacacctgagcttttcttgccccattgttcttttcacatactataatccaaatctgaaacgtggtgtgggaaacttcatgtctattatgatattatcaaacaagctggcagacatggtaaacttccattttgggttg

SEQ ID NO: 1505 - DNA, 1325 bp, Glycine max
  misc_feature (831)..(831): n is a, c, g, or t
  misc_feature (842)..(842): n is a, c, g, or t
cacaatcacatatataaatattatatatataacacacaaagttacaaaccaaaccctaatcaccttatttccaacccttctcattatttttttcttctctgttgactcaaaaacaatactatatctatcactcttaccattaatcaatcatctccctccgatcttaatttcttccatataacgagagagagagagagagagttaattagttttcctgcaacttcaacttttgttatggccaaccggtggtggaccgggtcggtgggtctagagaactctggccactcgatgaaaaaaccggatctggggttttccatgaacgagagtacggtgacggggaaccatataggagaagaagatgaggacagagaaaacagcgacgagccaagagagggagctattgacgtcgccaccacgcgccgccctaggggacgtccaccgggctccagaaacaagccgaaaccgccgatattcgtcacccgagacagccctaacgcgctgcggagccacgtcatggagattgccgtcggagccgacatcgccgactgcgtggcgcagttcgctcggaggcgccagcgcggggtttccattctcagcggcagcgggaccgtcgtcaacgtcaatctccggcaacccacggcacccggcgccgtcatggcgctccacggccgcttcgacatcctctccctcaccggctcctttctccctgggccgtcccctcccggcgccaccgggctcacaatctacctcgccggaggccaggggcagatcgtcggcggcggggtggtgggcccgctcgtgggcggcggccccccgttttgggtaatggcnggctacgtttntccaaatgctacgtacgaaaagattgcctctagagggatgatgatcaggaacacggcggcggcggaggctctccgccgggaattaccggcggtcccggcgaggcctcgtcgtcgatttcggtttataacaataacgttcctcctaatttaggtctttcgaatgggcaacatctgaaccatgaagcttattcttcttctccttgggttcattctcctcatgccagacctcctttctaattcaacgtgctagctagctagagaggaacgtgttacatatattattattacatagaaggatgataatattatgatatgatataatgatatagtgtgtttgtatatttaatttacttgcgatctcgtctcacctggacagtgaccatgccgttgcttctttctgtaatttcttcagttttaccccagtgatcactttttagttttcactcttgccatctctgcttctatatatttccttcctttcta

SEQ ID NO: 1506 - DNA, 734 bp, Glycine max
cccacgcgtccggaaaatatctagctaagccctttgtttcttataagctatgtgggtttgacttcttttttttttttttgctctcttgcaatttcaacaagtgaaagaaaactcggaagacaaaaaccaaaaatccaaaactaaaccactatcagctacatagtcttcgaagaagcaactgtggcaaatccttggtggacgggtcagggagggttatctggggttgaccacccaggaacccattcacctggcctaggcaaacgcccctcagaccttggaatcagcgaaaacagtggtgggcacaatagagaagaagatgaagacaatagagatgaaccaaaagagggtgcagttgaggttggaacccgcagaccaagaggaagacctcctggatccaaaaacaagccaaaaccacccattttcgtgacaagggacagcccaaataccctgaggagccacgtgatggaggtaactggaggagctgatgttgcagaaagtgttgcccaattcgcaaggaggcgtcagcgtggggtttgtgtgctcagcgggagtggctcagtggccaatgttactcttagacagccttctgctcctggtgctgtggtggcacttcatggaaggttcgagattctgtccctaaccgggactttcctacctggccctgctcctccaggatccacaggactcaccgtgtatctggccggaggacagggccaggtagtgggagggagtgt

SEQ ID NO: 1507 - protein, 266 aa, Oryza sativa
MGLPEQPSGSSGPKAELPVAKEPEASPTGGAAADHADENNESGGGEPREGAVVAAPNRRPRGRPPGSKNKPKPPIFVTRDSPNALRSHVMEVAGGADVADAIAQFSRRRQRGVCVLSGAGTVANVALRQPSAPGAVVALHGRFEILSLTGTFLPGPAPPGSTGLTVYLAGGQGQVVGGSVVGSLIAAGPVMVIASTFANATYERLPLEEEEEGSGPPMPGGAEPLMAGGHGIADPSALPMFNLPPSNGLGGGGDGFPWAAHPRPPY

SEQ ID NO: 1508 - DNA, 1409 bp, Zea mays
ctgagcccccctgcttattagagttggagtccgaggtgtgctgtgcatcctctccgtatgcaggtaatcgcccgcccaagaaggtttctgagcggaaaggaataggaaagtcccgacgagaagtgcactctatctctttttatatagggactagggagagaggctggctcggtagctcagagacatcctccagtccagctgattttctcgccgcgccgtgttcaatacggctacgaaaatagtagggctggcaaaccggtggccggccggcagcgcggcggccgaggagatggggagcctcgacggcggccactcgctgcagcagggccgccaccacggctacgcccactcccagtcccacgtcggcgcgggtcccgacagcagcaacaacaacaaccgacgaggacgacgcgtcgcccccgccgccttccggggcgggaggaggtcctcgccggccgcgcgggaggcccccggggtccaagaacaagccgaagccgcccgtggtggtgacgcgggagagccccaacgcgatgcgctcccacgtgctggagatcgccagcggcgccgacatcgtcgacgccatcgcgggcttctcccgccgccgccagcgcggagtctccgtcctcagcggcacgggcgcggtcaccaacgtcacgctgcgggagcccgcgcggcccacggctacgaaaatagtagcgctgcgcggccggttcgagatactgtccatgtccggggctttcctcccggcgccggcgccgccgggggccacggggctcaccgtgtacctggcgggggggcaggggcaggtggtgggcgggagcgtcatgggggagctcatcgcttcgggccccgtcatggtgatcgccgccacgttcggcaacgccacctacgagaggctgccgctggaccaggcagacgccgaggagggcgccgtgctgtccggctcgtccgagggcgccaccgcgcagcagctggagcagcagcagagcagcgggggtcccgtcgtgccgccgtccatgtacgccgtcccgcagacgccgccgcacccgcacgacatgttcgggcagtgggggcacgcggctgtgacgcgcccaccgccgacgtcgttctagctagcgctagatgcacatgcaccagctgcgacctgcaccggccgcccgcccgccgtataccctctccacctttctagttagatttccacttcttcactagctactactatagctactactctagtttgttacgttagctctaccatggcatgcatgtgtgatcgttttcccatttcttctagctctcttccatctggagcgtgtggaatcaatgtacaattcctatttgcgaataccggaatccatcaatgtttacttaaaaaaacccaaaaagcgcggccgctcgcgatctagaac

SEQ ID NO: 1509 - protein, 336 aa, Oryza sativa
MAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPPGQQPAASQSSGVTGGDGTGGAGGMSLYNLAGNVGGYQLPGDNFGGWSGAGAGGVRPPF

SEQ ID NO: 1510 - protein, 323 aa, Oryza sativa
CGGDGEERVVEEEGHRSTGKLAAGKWWERPDDTAMAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPQGSNRRRHSPPA

SEQ ID NO: 1511 - DNA, 939 bp, Glycine max
ttcccttctaacctcccattccgttttctctgcagtactcaattgatccctttgtttttctattcgttctgagagctttgtgtgtatggccggcatagacttgggttcagcatcacattttgttcatcatcgccttcaacgccctgaccttgaagacgatgagaaccaacaagaccaagacaacaccgtgaccaacgtgacgttgagacagccagctgcggctggtgccgtcgtcacgctgcacggaaggtttgagatcctctctttgtcaggatcgttcctcccacctcccgctccaccaggtgctacaagtttgaccgtgttccttggtggaggacagggtcaagtggtgggaggaaatgttgttggtcctttggtggcttctgggcctgttattgttattgcttcatcttttactaatgtagcatatgagaggttgcccttggatgaagaggaatctatgcagatgcaacaagggcaatcatctgctggcggtggtggtagcggtgaccatggtggtggagtcagtaataactcttttccggacccgtcttctgggcttccattcttcaatttgccactaaacatgcctcagttacctgttgatggttgggctggcaactctggtggaaggcaatcttactgatccagagtctttgggggcacaaaggtgagaagttgaattgatctcatatatattggtcttctctaatctttcctctgaatattgcttgtgaagaagtactgatttttctattgaagaatcgttttgtttggctaggtttgttgtaaggacgatcagtttctaggaacaactgtaaaacgttttctcttggttgctggagttattagactagactgttgtgcattaaccttgagttgaataaatcataggctcaaatcaataacaaaaatatatattttggatttttaaaaaaa

SEQ ID NO: 1512 - DNA, 659 bp, Glycine max
tcgcccacgcgtccgtacggctgcgagaagacgacagaaggggccactttatttgtctctctctttcccttccaacctcatcccattccgttttctctgcagtactcaattgatccctttgtttttctattcgttctgagagctttgtgtgtatggccggcatagacttgggttcagcatcacattttgttcatcatcgccttgaacgccctgaccttgaagacgatgagaaccaacaagaccaagacaacaaccttaacaatcacgaagggcttgacctagttacaccaaattcaggtcctggtgatgttgttggtcgcaggccaagaggaagacctccaggttcaaagaacaagccaaaaccaccagttatcatcacaagagagagtgcaaacacccttagggctcacatccttgaagttagtagtggttgtgacgtctttgaatcggtcgctacctatgcaaggaagcgacaaagagggatctgtgtccttagtgggagtggcaccgtgaccaacgtgacgttgaggcagccggccgcggctggtgccgtcgtcacgctgcacggaaggtttgagatcctctctctgtcaggatcattccttgcacccccagctgcaccaggcgctacaagtttgactgtgttccttggaggagga

SEQ ID NO: 1513 - DNA, 1596 bp, Glycine max
ctgtcgcgtgggaaacaaatggctgcattgtgagttctttgtccccttcaacctcatttcaattctctctctcccccattcttacttcacccgcgccccctcccccgcccgctcccgtcccttttctttctctgcactccatctttctttccaaaacccacccttttctattcctcttcctcttcctccttttcccttctttttatttccttacactcacaacatttcccttaaaataaacataaacaaaccagcactgttcttgacccccaaaaaaaaaaaatctctactatttattaactatattaattcctccataatataatcatttgttttccttgttttctgttttctcttataatatataaccttcttttatctattttttctgttttgcaccttgtgattgtgagttatatctatttatatttatatatcattctctctcttttttttggatgtgtctatggctggtttggatttaggaagcgcctcacgctttgttcaaaaccttcacagaccagacttgcacttgcaacaaaatttccagcagcaccaggaccagcagcaccagcgtgatttggaggagcagaaaactcctccgaatcacagaatgggggcgccgttcgacgatgatagcgatgatagaagcccgggcctggagctcacttcaggtcctggcgacatcgtcggacggcgcccgcgtggcaggcctcctgggtcgaagaacaagcctaagccgcccgtcataatcacccgggagagcgccaacacgctgagggcgcacatcctcgaggtcggaagcggctccgacgtcttcgactgtgtcaccgcgtatgcccggcggcgccagcgtgggatctgcgtcctcagtggcagcggcaccgtcaccaatgtcagtctccggcagcctgcagctgccggtgccgtcgtcacgctgcacggcaggttcgagattctctccctctctggctcgttcctcccgccgccggctccgccgggagccaccagcctcacaatctacctggccggcgggcaggggcaggttgtcggaggaaacgtcatcggagaattaaccgcagcagggccagtaatcgtcatcgcagcgtcgttcaccaacgtggcttacgagaggttacccttagaagaagatgaacaacagcagcaacaacagcagcttcagattcagccacctgcaacgacgtcgtctcaaggaaacaacaacaacaataaccctttccccgacccttcttcaggacttcccttcttcaatttaccactcaatatgcagaatgttcagttaccagttgagggttgggctgtaaaccctgcttcacgtccacaacctttttgagagttcatgaagatgttgacggaggatttatatcacaaaaggctttatattattttaaggtcagcaaattaatattcatggactacaacatatatataaactatatgttttttcttcttcttcatgttattttgtttttttcttatgttgttaatggatataatatgacatgataattattatgtagtctgattttcatctccttggaattttatatacttatttcccctgttaaaaaaaaa

SEQ ID NO: 1514 - DNA, 1129 bp, Glycine max
tttggatttaggaagcgcgtcacgctttgttcagaatcttcacttaccggacttgcacttgcaacaaaattaccagcaaccccggcacaagcgcgattcggaggagcaagagactcctccgaacccgggaacagcgctggcgccgttcgacaacgatgatgacaaaagccagggcttggagctggcttcaggccctggggacatcgttggacggcgcccacgcggcagaccttccgggtccaagaacaagccgaagccaccggtgataatcacccgggagagcgccaacacgctgagggcgcacattctcgaggtaggaagcggctccgacgtcttcgactgtgtcaccgcttatgcgcggcggcgccagcgcgggatctgcgtcctcagcggcagtggcaccgtcaccaatgtcagtctccggcagcctgcggctgccggagccgtcgtcaggctgcacggaaggttcgagattctctctctctccggctcgttcctcccgccgccggctccgccgggagccaccagtctcacaatctacctcgccggcgggcagggccaggtcgtcggaggaaacgtcgtgggagaattaaccgcggcagggccagtaatcgtcatcgcagcatcgttcaccaacgtggcttacgagaggctccccttagaagaagatgaacagcagcatcaacagcttcagattcagtcacccgcagcgacgtcatctcaaggaaacaacaacaataaccctttccctgacccttcttcaggacttcccttcttcaacttaccactcaatatgcagaatgttcagttaccacctttttgagggttcatgaatctgataatatgagactgatgaagatcatgttgatggaggatttatcaccaaagggtttatattattataaggtcagcaaatattcatggactagaacatatatataaactatatgttcttcttcttcttgttagtatgttttttttttcttctgttgttaatgggtatcgttatgataggacatgattattattattatgtagcgagtttcagtctgactctcatgtctttgggattttatttacttatttcccttgtccattattagaatatggaaccctgtattatttaatt

SEQ ID NO: 1515 - DNA, 657 bp, Glycine max
  misc_feature (477)..(477): n is a, c, g, or t
cccggagaagacgccaaacaatcagcagaagatgggccacatcaccagggcgatgtggtggggcggcgcccgcgggggcgtccggcggggtccaagaacaagccgaagccgccggtcatcataacgcgggagagcgccaacacgctccgcgcccacatcctcgaagtcgccaacggctgcgacgtcttcgaaagcgtagccagctacgcacgccgccgccagcgcgggatctgtattctcagcggcagcggaacggttacgaatgtgagcctccggcagccggcgtcggcgggggcggtggtcacgcttcacggcaggttcgagatactgtccctgacgggatcgttccttcctccgccggcgccgccgggggcgacgagtctcagcatatacctcgccggaggacaggggcaggtggtgggtgggagttgtggtcggagagtttgatcgctgcgggaccggtgattgtgatggcgngcgtcgttcacgaacgtggcctatgaaaaggttaccgttggaggaagaagagaacaggttgagatatcttggtgttgctggtaataatagtaacccctttcctgatccttcttcgggacttcctttcttcaatttgccaatgaatgttcagttgccctgtggatgcctgggccgggaaac

SEQ ID NO: 1516 - DNA, 233 bp, Oryza sativa
  misc_feature (185)..(185): n is a, c, g, or t
  misc_feature (224)..(224): n is a, c, g, or t
gccggactagatatataaaccttgtggcgatccgatcgtgttcgtccatggccgacgaggggtcgtcgcgcgccgagctgatcgaggcttcgccggcgccggcgctggaccttccgtcgccgccgcggaagccgcggggccggccgctggggtccaagaacaagcccaagccgccggtggtcgtnacgcgggagagcgaggcggcgatgcggcccgtcgtgctngagctcggc

SEQ ID NO: 1517 - DNA, 1190 bp, Oryza sativa
  misc_feature (1181)..(1181): n is a, c, g, or t
tttttttttgtttttttttttgagcaaccactgccgatcttgatacgcacagtaattttacattcttcaaactctgaagaaaatggaacgataagatcacacgagtacttatgcattacatagcacattaattaacatggtaaatgattaattaacctactcaaacaactagggaaagaagtggaaggctaactagctaggtagagagacattgattaaccggtgccagtgctagaacgatgtcggcggcggccgagccaccgctgcatgcccccactgcccgaacatgtcgtgcggcggcgtctgctggacggcggcgtacatcggcgggggcacgacggcgcctccgctgctctgctgctccatctgcgcggcggcgccctccgacccggacagcacggcgccctcctcgccttcctggtccagcggcagcctctcgtacgtggcgttgccgaacgtggccgcgatcaccatgacggggcccgacgcgatcagctcccccatgacgctcccacccaccacctgcccctgcccgccggcgaggtacacggcgagccccgtggcccctggcggcgccggcgccgggaggaaggcgccagacatggacaatatctcgaacctcccccgcagcgcgacggcggcggccccagtccccgcgggctgccggagcgtgacgttggtgacggcgccgctcccgctgagcacggagacgccgcgctgcctgcggcgggagaagcccgcgatggcctcgacgatgtcggcgccgctggcgatctccagcacgtgggaacgcatcgcgttggggctctcccgcgtcaccacgacgggcggcttcggcttgttcttggagcccggcggcctccccctcggccggcggcccgccgaccccgtagccgagccaccgccgggcggcggcgacgcctcctcctcctcgttgctccctcccgcgccgccgccgtgggagtacccctgatgctgctgcagcgagtggccgtcgatgctccccatcccctcggccggatcgccggccggccaccggtttgccagccctactattttcgcggtcggaaagtcgcaccaacaatctagcttctccacgccaatcgctgaagccagcgtcgctcccgtctccaagcaaaagcaaagcaagcaagcgaacccacccacttaattagccgcanacacgtccg

SEQ ID NO: 1518 - DNA, 246 bp, Oryza sativa
ttttccgcccgctctacgtctccacgggctccgccgtgtcgtcgccgcgcggggcgttggagatggcggcggcggcggcggcgatggggatggggctgtcgtcgctccgggtcgtagtggttcacgccgcgattgagctctcccgccggttcactcacctgcgggggcggcggggggggcggctcgtggcctgagccggctagcgtgccgcttgtatggctgcccagtggggccgggaacgtacac

SEQ ID NO: 1519 - protein, 2623 aa, Oryza sativa
MSNEKVPSNAPIAPQEGNAPQNSGSNKHPGASSEETWRTPSDPFPMEITQVAPRDDDPDYIPIEQAMVVRRRSKRKAGRNRTEQEVEMDTATSAPERTETSTSAGGSGKKRRGERSKNKLPKETYNVIALDQDGKPIEPPIVRSKFSNACGTLVRTRCPINVKLWETVDDNIKTLLWNELQKYFVFPPGSEVRGRDYALKKMGDRWRQWKSDLNRDYVQKNLPPFTDYGHISQADWDTFVADRTTAEALALRKKMSELAKKNKYPHRLGSSGYAGHVDQWREIEQRFAAAGKPLLVDPMVERSKNWVWARSTGQVSDEGDILFETPDIEEVTTNLQQIVEKERSGQFVPRRERDQLTAALGTAEHSGRVRGLSSKTSWKVGFPQDAPSYKKRDKYKEQLSDKIYAQVKEHFYSLAAENPTAFPRLFPDSQQPTQSAQQTTNVPSSVGSVQTSTFPVDSITGPTPCSLVVPIGRAGKTKEVATGLAIPGRQFHNTAIPEDYARVQVAKVHSDHVSLELDIPAPEGIELLGDAVNQFILWHRRDIILSAAVLAAGSSTPSSSQAMTAAAPAPPSPPEPPSPRHPPSPPPLRSPARQPTPPPSPSQQPPLPTPQPVQASPTSPTKQHAPPAPPSVQTSPPTPQSALVEEVHIPDGTTSEPKSNTLEPRRIIPKLISTYDPKEIDKDKEKFMFSAFRNSEKRKELAHVLSDSQKSVLAAQDEVQSWLSADVPETYEYGKPFLPTYLMNKLPWEMRVMHEWYMKASRKGLGFISVAVPEGAFMSGPNGIFFISFQDLYALYKLDKMDVNLVAAFCLMQFHEADRTGAKVGYVDPTRICKTQHTIELRQDCEQLVGKTPEEKEEYVKTLHKRKKLEVATYLAIAMLAHADKDVLMVPYQFTDHYILFLVYPKDQLIISLDPAHYDKETFMEFLTILNLAHKYYRKRGGPVHIPSQKKLSVRTGWPCYKQPPGTNLCGYYVCEMLRVNGRYKTTSNRIPEIPYIAQRFNHTTILNVAADLCRFIRRDVCNARGVTPESASFADTGYDPPPKKWKGICQVGPSFEAISCNRKFIGARWYIDDEILSSISDNEVLSPRDVEGHGTHTASTAGGNIIHNVSFLGLAAGTVRGGAPRARLAIYKACWSGYGCSGATVLKAMDDAVYDGVDVLSLSIGGTKEDVGTLHVVANGISVVYAGGNDGPIAQTVENQSPWLVTVAATTIDRSLPVVITLGNGEKLVAQSFVLLETASQFSEIQKYTDEECNANNIMNSTVKGKIAFCFMGEMLNNKQQTSYPDVTTAVAAKGGRAPDIAAPGVSILAAAQIPYYKGVSYHFDSGTSMACPHVAGIIAVLKSIHPKWSPAALKSAIMTTDYSIPLAGVHQRSGEQVSGTSAFDVLHREKAAIRHCDFTMADFADALRPDKFTGVHFKRWQIRVTLWLTAMKCFWVSTGKPEGVLTAEQQKQFEEATTLFVGCILSVLGDRLVEVYMHMTDAKELWDALNTKFGATDASNDLYIMEQFHDYKMADNRSVVEQAHEIQTMAKSFGTALKHKRQEYSVEGLIASLDVEEKAREKDAASKGDGGQSSANVVHKAQNKSKGKYKAQQTTNFKKQKKNNNNPNQDERTCFVCGQVGHLARKCPQRKGMKAPAGQTSKSANVTIGNTGDGSGYGNLPTVFSVNQSTNWWVDTGANVARGSTVLMGNGSHASVHGVGTVDLKFTSGKIVQLKNVQHVPSIDRNLVSGSRLTRDGFKLVFESNKVVVSKHGYFIGKGYECGGLFRFSLSDFCNKSVNHICGSVDDEANVWHSRLCHINFGLMSRLSSMCLIPKFSIVKGSKCHSCVQSKQPRKPHKAAEERNLAPLELLHSDLCEMNGVLTKGGKRYFMTFIDDATRFCYVYLLKKKDEALDYFKIYKAEVENQLDRKIKRLRSDRGGEFFSNEFDLFCEEHGIIHERTPPYSPESNGIAERKNCTLTDLVNAMLDTAGLPKAWWGEVLLTSNHVLNRVPNRNKDKTPYEIWIGRKPSLSYLRTWGCLAKVNVPITKKRKLGPKTVDCVFLGYAHHSIAYRFLIVKSEVLDMHVGIIMESRDATFFESFFPMKDTHSGSNQPSEIIPSSIIPPEQTEHTHELVSEEDVSEAPRRSKRQRTAKSFGDDFTVYLVDDTPKSISEAYASPDADYWKEAVRSEMDSIIANGTWEVTEQPYGCKPVGCKWVFKKKLRPDGTIEKYKARLVAKGYTQKEGEDFFDTYSPVARLTTIRVLLSLAASHGLLVHQMDVKTAFLNGELDEEIYMDQPDGFVVEGFGVNYAYPCVYYRHGGGQGVILCLYVDDILIFGTNLEVINEVKSFLSQNFDMKDLGVADVILNIKLIRGENGITLLQSHYVEKILNRFGYIDSKPFPTPYDPSLLLRKNKRIARNQLEYSQIIGSLMYLASATRPDISFAVSKLSRFTSNPGDDHWRALERVMRYLKGTVELGLHYTGYPAVLEGYSDSNWISDVDEIKATSGYVFTLGGGAVSWRSCKQTILTRSTMEAELTALDTATVEAEWLRDLLMDLPVVEKPVPAILMNCDNQTTCEKTIEVCQEIKKLRSYNVGLHPNSEKPGRSLHEGTITKCDRQCIEGDGFETHVSYTMVVTQSM

SEQ ID NO: 1520 - DNA, 433 bp, Oryza sativa
cagcctacaggaggcctacagcggcagcacccaccagggcaggcggggaggcaggcagtcgttcatccacatccaccgccgccgtctcccccgccgcttctcacccattcctctccaatccggccgcgccggcgccgcatctggtccaccaagaaccccttcaaagaatccccacaaccctctagggaaagatcgcgagaattcctctcaatcgccgcttggatggggtgcgggcagtccaagatcgaccaggaggaggcggtgtgccggtgccgggaccggaggaagctgatggccgacgccgtccaggcgcgcaacgccttcgccgccgcccactccgcctacaccgttctcctcaaaagcaccggcggcgcgctctctgacttcgcccaaggcgagacgcccgacctggtggcctctcacgcccacctcg

SEQ ID NO: 1521 - DNA, 423 bp, Zea mays
  misc_feature (8)..(8): n is a, c, g, or t
agcgcctncacgatctcgacgagaggatgcccaatcgcgaaaccgccgccctattgcaatggcgcccaaggccgagaagaagcccgccgtcgagaagcctgcggaggaggagccggcggcggagaaggccacggctgggaagaagcccaaggctgagaagcggctccccgccggcaagtacgcaggcaaggagggtggctagaagaaggggaagaagaaggcaaacaagtcggtggagacgtacaagatctacatcttgcaggtgctgaatcaagtgcacccagacattggcatctcgtccaaggccatgtccatcatgaactccttcatcaacgacatcttcgagaagctggcggcggaggcggccaatctggcacggtacaacaagaagcctaccattacgtccagcgagatccagacctg

SEQ ID NO: 1522 - DNA, 975 bp, Zea mays
  misc_feature (4)..(4): n is a, c, g, or t
cggncgcgtgggctcaaaattagtattttagtaatgttcttacggtgggtccctcgcgacccgccggcagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtggaacttgaggaggaggaggacgacgagaaggatctcgaggcaatgcgacgggccgaggaggaggagcgccgcgagcaggaggccgagacgaagactcgccgccgccggggacggcccaagcgccgccgcgacccggggagcgaggatgaggagcccgaggagctagagctgcaaacggaggatccccgtgaggaggagatcacggaggcggtgcccgtagctgtaggggacccggtcaagatcactggcaaggggaagaagcagaagaagcactatgcttccttcgagtacgagggcaacagcttcgagctggaggaccccgtgcttctcacgcctgaggacagcaatcagaagccctatgtcgccatcctcaaggatataacagaaactgatgggagcctatatgtaactggccaatggttttatagaccagaagaggctgacaaaaaggagggtggattctgggtagcacgagatacacgagagctattttacagttttcatactgatgatgtgcctgcagaatcagtatgcacaaatgtgtgggtcatttcattcctcagcaaaacagattccagtcgaagcagcatccggggattattgtcagaaggtctatgatgcagttg

SEQ ID NO: 1523 - DNA, 1733 bp, Zea mays
  misc_feature (1659)..(1659): n is a, c, g, or t
accggccagtgataccgcactcctccccttaaagccctagccatggggtcctccaggccgggcggggatctggctgcctcggtcgatttctaattctcctcgcgagcccaaaccctaaacctaaacctttcacccgccgccgccgccaccaccagcactgccactccgccaccaccgtcccgaagccccctcccagcgccatcgacttcatctcggattgaagcaatgtcgtcggacgatgaggtcagggaggagaaggagctcgacctctcctccaacgacgttgtcaccaagtacaaggctgccgccgaaatcctcaacaacgctctgaagattgttgtgtctcagtgcaagccaaaagtcaagattgttgacctttgcgagaagggcgactctttcataagagagcaaactgggaatgtttacaagaacgcaaagaggaagattgaaaggggtattgctttcccaacctgtgtatccgtcaatgacacagtttgccacttctcaccgcttgcaaccgatgatgccgttctggaagaaaatgacatggttaaaattgatatgggctgtcatattgatggctttattgctgtggtggcacatacacatgtaattacaaatgggcctgtcacaggaagggctggtgatgtgcttgctgctgccaacacagcagcagaagtcgcaatgcggcttgtgagacctgggaagaaaaataaggatgttactgaagcaattcagaaagttgctgctgcttatgattgcaaaattgtggaaggtgttcttagccatcaactgaaacaatttgtgattgatggtaacaaagttgtgctcagtgtctccaatgctgatacaaaggttgatgatgctgaatttgaagaaaatgaagtatatgcaatcgatattgtcaccagcactggggaggggaagcccaagttattggatgagaaacagaccaccatctacaaaagggccgtagacaagaattatcacttgaagatgaaagcgtcaaggtttattttcagtgagatcagccagaagttcccaatcatgccttttactgctagggcattagaagagaagcgtgcgcgtttaggcttggtggaatgcatgaaccatgaactattgcagccgtaccctgtacttcatgagaagccaggcgatcttgttgcacacataaagttcactgtgctgctgatgcccaatggatcagataagataacatcacatcctctacaggagttaaagcccaccaaatccattgaagacaatgcagagataaaggcatggcttgctttggggacgaaatcaaagaagaagggtggtgggaagaagaagaaaggcaagaaaggagatgcagcagaagcagatcccatggaggaggcgacaaacggtgctacaagccaagaataattctgatttttggaattactgccaccagcttttttcttgtttcttcgctgcatctgatggtgttatattacattcagttgtggaaaaattgagtactatttctagcttctaagaaatgaagcatcctattatcgcatcaaaaagaaaaaaaataatcgacaaggcatgcccagtgttcgttctctgcgccccgtgacgacgctcgtcacttggatttttcggagttcctcccagcccggaaatttcttncctggacattgccaactgctgagatgtagcatccggatacaaatgttcgaattacgtatacaatgttactgtgt

SEQ ID NO: 1524 - DNA, 2773 bp, Zea mays
agacgccgcccctccgaacagctgaaggcctgaagcaccctcactttccccactccggagctgcacgggcacgcacgcagtttatccaacgccactgggcctcaacaacaacaatctcccaacgccgccgcttccgccgcatcaagcgctagaactaggaacccctcccaaaggatctcaagaagacaaggacaccgtcgagtcgccgccagtcgctcgatggggtgcgggcagtcaaagatcgatcaagaggaggcggtgtttcgatgccgggagcggaagcggctgatggctgacgccgtggcctcgcggaacggttttgccgccgcccacactggctacactgtccgcctgaagagcaccggcggcgcgctatccgatttcgcccaaggcgaggcgccggaccctagcctggtgtcctcccatacccaccacgctccggctgtggcgacgtcatctgtctcgactccgccaggcccctccgcagcttccgtcaacagcccctccccgccgccgccgccattcgccgacttctctcattctagcctccaaagatcctcatccacccccaacattcctatgccggagccgagggccgcagccaaaaaccgccctcctgccgatgcttctatccgagaggaggatgaggatgaggatgaggaggaacaggatggacatatcaagatcgatagcgatgacgacagtgacgacgacagtgacgaagacgacgatcaccatgagcatgacgatgttagtgggggtgacatggggcatggaccacaatcaagccggattttgatgagtagtgtgggatcttctccagtaacaccacctccgcctccaaggttgaaccacaccccaccaacgcttgccacagcaacgccaccgcccccggtgctggagtcacagatggctacctgggactacatctttggcccaactcccaccccaccacccaccctagagcagcctgctgctgatactttgtggatggaaaggcgtgataaggagccagtggctgaggtgaaggcacctgtggcaaaaacagttgttagtaagccagctgctactgaggaaaggccaccagagacggccgtagagaaggataaagcaattgaggagatgatggctaatctaccgccatcaaaacctattgtgaggaagccacccaaagcacctggcccatcacaagaagcagcacactaccagcatgcctcttcgatgggtgcagttgaaattcggaaggggaaggtaatggtggcatcaggaactgccagcttgctacagattgttacacggcttgatgataactttcttagagcttcagagagtgcgcatgatgtgtcaaaaaaactggaggccacccggatgcattatcactccaaccatgctgacagccgaggacatatcgaccactctacaaaaattatgcacgttatcacatggaaccgctccttcaagaacttacctgaccatgaggacctgaacgataattttgagattgatgatagatttgaaactcatgctgcagttctagatagaatgcttgcttgggagaaaaaactgtatgacgaagtgaaggctggggagcttatgaaaaccgattatcagaagaaggtgtctctattgcagaagcaaaagaaacggggtgttaaacttgaaaccttggagaagacaaaagctgctgttagccaattgcacacaaggtacattgtagacatgcaatccatggattcaacagtttcagaaataaatcggcttcgggatagacagttattcccaaagttaatggaccttgttgatggaatggccaagatgtggagttctatgtaccgccatcatagaagtcagttcctgatcatttctggaataagaggtttcgagattcctcctattccaagggagacaactgattctcattacatccagacttgtgagctacgtgacattgttagggagtggcatacgcagtttgagaaattgatggacaatcagaaagcatacatcagagcactcaatgcatggctgaagctcaatctcatcccaattgagagcaacataaaggagaaggtctcctcccctccaaggctggtggatccacccatcaagcacctgctgcatgcctggcatgacgagctcgaaaggcttccgattgagcttgcaaaaactgccatcaaaacctttgctgaagtcataagcactatcgtgcatcttcaggaagaggaagtaaacctaaggaggcggtgtgatgaaactcgtagggatctgaaccgaaagaaggcacagtttgaggactggcatcaaaagtacttggagagacagacagcagaaactcaaaacatagatcctgtcgaggataggaaacgcaccatcgaggaactagagattcggctgagagaggaggaggggcaccatcttaggcatgccaggcaggtgcgggagaaatcacttgcaaacctccggacacacctgccagaacttttcaggaacatgtccgattttgcttacttttgcaaagacatgtacaacaatcttagaaaaactgctgcgctgtccaaagatgaagtctaaggctgatgatatttgtgcgtgtgtatgtatactcgacaagcagtagaatgtttgctggtaacttgtcctgatgccgtctagaatacataatagtcggcattaattatgtttgtaaattggaatggacattccggactccccattgtttatttccatgctatgtactgcattggtgcgtggataaaaatctttgaattgctct

SEQ ID NO: 1525 - DNA, 452 bp, Zea mays
tttgtcgccgcttccgccgcatcaagcgctagaactaggaacccctcccaaaggatctcaagaagacaaggacaccgtcgagtcgccgtcagtcgctcgatggggtgcgggcagtcaaagatcgatcaagaggaggcggtgtttcgatgccgggagcggaagcggctgatggctgacgccgtggcctcgcggaacgggtttgccgccgcccacactggctacactgtccgcctgaagagcaccggcggcgcgctatccgattttgtccaaggcgaggcgccggaccctagcctggtgttcttccatacccaccacggttcggatgtggcgaactaatttgttttgaattcccccgggcccttccaagctttcgtttacaagccctttctcgcggccggtgtcatttggcggactttttttattttatgcctccaaagattctctattccccc

SEQ ID NO: 1526 - DNA, 990 bp, Glycine max
atcaattaaaaaggctcgagacagaggagaggagaggagaaggcgatgcaacccacatccggcggcggcgggctggcaaggttccgttcagctccggcgagctggttagaatcagttctgttgaaggaagaggaagaagaagaagaccccttaagcttcactcaactgctttccactatcgatgatgctccctctcattctcaacaccaactctatggtgccgctctctcaaacaaggataaaacacctgaaatcttcatgttagaagattccgttccttgcagagtgagggctaagcgtggctgtgctactcatcccaggagtattgctgaaagggtaactcactcactcttttctctctacttaactaactcctttactttctgttatcttttctcttttcgccttaggttcgcaggactcgtatcagtgaccgcatcagaaagctgcaagaacttgtgccaaacatggataagcaaacaaatactgcagatatgttagatgaggctgtagcgtatgtcaagtttctacaaaagcaaattgaggaactgtcagagcaccaacggaggtgtaaatgcgtggttcaagagtaaattgctgattgttccatgcagtgcttggctttttacgatttacttatgaattattatcagaatttttttatgttctgatgaagatcaaccataccacactctggatgctaattaaatttaatatctcctgataacttaaaagatgcatatattatacatgttaggggtgacattgccaagttcgagacgaataaattacaaatagaattttaccctagagtgttataattgtgttgtagtgttgtacaactcttaagatacacaaatctgccaagttaatagctacttggacttaagatatatacataaccatatgtgttattttattaaaaaaaaaaaaaaaaaaaaaaaaaaaaaaaaaaaaaaaaaaaaaaaaaaaaaaaaaaaaaaaaaaaaa

SEQ ID NO: 1527 - DNA, 745 bp, Glycine max
atcaattaaaaaagataaacagaggagaggagaggagaaggcgatgcaacccacatccggcggcggcgggctggcaaggttccgttcagctccggcgagctggttagaatcagttctgttgaaggaagaggaagaagaagaagaccccttaagcttcactcaactgctttccactatcgatgatgctccctctcattctcaacaccaactctatggtgccgctctctcaaacaaggataaaacacctgaaatcttcatgttagaagattccgttccttgcagagtgagggctaagcgtggctgtgctactcatcccaggagtattgctgaaagggttcgcaggactcgtatcagtgaccgcatcagaaagctgcaagaacttgtgccaaacatggataagcaaacaaatactgcagatatgttagatgaggctgtagcgtatgtcaagtttctacaaaagcaaattgaggaactgtcagagcaccaacggaggtgtaaatgcgtggttcaagagtaaattgctgattgttccatgcagtgcttggctttttacgatttacttatgaattattatcagaatttttttatgttctgatgaagatcaaccataccacactctggatgctaattaaatttaatatctcctgataacttaaaagatgcatatattatacatgtaaaaaaaattaaaaaaataaataaaaaaaaaaaaaaaaaaaaaaaaaaaaaaaacccaaataaaaaa

SEQ ID NO: 1528 - DNA, 706 bp, Oryza sativa
  misc_feature (28)..(28): n is a, c, g, or t
  misc_feature (30)..(30): n is a, c, g, or t
  misc_feature (92)..(93): n is a, c, g, or t
  misc_feature (132)..(132): n is a, c, g, or t
  misc_feature (186)..(186): n is a, c, g, or t
  misc_feature (206)..(206): n is a, c, g, or t
tctgaacctcccggtgcagccgccggcnantgagctcgtcgggcttgctgcggtacagatcggcgccgagcacgctgctcgccgagttctgnnacgacttcctctccgggtacccgatgagctccgggtggnaggagtcgtcgctcatgtcggacacgaacatctccggcgtgaagcgcagcgcgnactcgtcggagccgtcccanaacggcggcggcggcggcggcctggcgcaccagtggatcccccggccgaggacactcgtcggagatggcggccatcgagaagttcctccagttccaggacgcggtgccctgcaagatccgcgccaagcgcggctgcgccacgcacccgcgcagcatcgccgagcgggtgaggaggacaaggatcagcgagcgaatcaggaagctgcaagaactcgtgccaaacatggacaaggtactgatgagtactacacctctctctctctctctctctctctctctcttccccaataggcaatagaacagtgtttggttagcaaatagtagcagtagtagcagcaaatctgcaaatgtgcagtacaaggaccactccaaaattaacctgtccgaaacctgaaacgtatccgttttcctgcagcaaaccaacactgctgacatgctggatttggctgttgactacatcaaggatcttcagaagcaggtcaagggattaaacgacagcc

SEQ ID NO: 1529 - DNA, 592 bp, Glycine max
  misc_feature (529)..(534): n is a, c, g, or t
  misc_feature (542)..(542): n is a, c, g, or t
  misc_feature (544)..(544): n is a, c, g, or t
  misc_feature (546)..(548): n is a, c, g, or t
  misc_feature (558)..(558): n is a, c, g, or t
  misc_feature (560)..(564): n is a, c, g, or t
  misc_feature (571)..(576): n is a, c, g, or t
gaatagagcaagctggggagaactgatagcatcacaaacaactaccctgagaacaatagcctcacaactgtatccaaacttgaaaagagcaaaatgcacatgagaactatgtgatgtgatagcatgaacaagaattaggaacttattgcaattaagatatcaaaagatggctgaactagttctgcgaagctgatgcttaggcttaggctcaggtggtggaactgatggcaatgccctctccatctcattcagtcttctaagcctttcattctcctcttctaatcgtgaaactttaatctccagttcttgtgtgtatgcctgtcttcttgcccgtgaccgagcagcagattccctatttttaatcatcctcttctgcctcctctccacagttttctccaccacaataccagagacacccctttttcgacccagagtttgtgtatcagacaacgcaccctttaaagaagccggtgtctcagagtatgctgcatccaaaaccagattcactccaacctggaaaggctgctgnnnnnnggctgccntncnnncatacattcncnnnnnaccgaannnnnnagctgctggtattgca

SEQ ID NO: 1530 - DNA, 1201 bp, Glycine max
ccacgcgtccgccccgcgtccgctcattagttcgaactagaagtctagaactgtctactgtttcaaccgtttccaaaatttctttattcattaatgatttttttttatttgaaggggaaaagaaaaaaaaaaaaaactcaaatcaccctttttgcttgatagtgtaatgagcaatgttgtctcagcagggaatgttcagctgttcagttttcatgaccaaaagtggttttgtttgtgctgaggtttctgtaggataaaaagtttgggtttttatttctctaatgtacagtggtgataatgatggaaatgacatgcatgatgattattatttgatggcttttatcttttgctttgctctcaagtgccatcctatgttggtgtgtggagcatctattctgtattactttgattcccttgaaatctgatctggcttatctttttttttttccttcttttgggaccaattttcacccactatttccaccctccacttcaaatttacttgctttgtgtttgtgagtgcctgttatcaaatctccaaaagctcaaagaaactggtattgtgttcggcataaggaattaggattgatttcagggtgtattctgtacctttttcatttttatctttgttttttcatttgtgctttctgaagagctttggagatgtatgatatagaattgtaggtttgtgttgttagggttgagaaaaatgggatctcagggtggggcagtgcaagagccaaagactactacccctttggctaggcaagggtccttgtataatctgacccttgatgaggtgcataaccaacttgggaatttggggaagccacttggcagcatgaatcttgatgagttgctgaagagtgtgtggagtgctgaagctggtggtggtggtgaggcttctggctgggactttggtgttggtgatgctactaacatgccgcatggcaaggctgctgcttccggctcctctctgaatcctcaggggagcctaactttgtctagggatcttagcaggaaaactgttgatgaggtttggaaagatatgcaactgaagaaggtcactaatagggataaaaaaatccaggaaaggcaagctacactgggtgagatgactctggaggacttcttggggaaggctggagtggttgctgaagctttgcctaccaagggtgggggctatgtcaggggtcgattc

SEQ ID NO: 1531 - DNA, 827 bp, Glycine max
ccacgcgtccgcgaccacattacatcatacaacaatacatgcactcacaacacacacacattcatacatattactgaggtttttcttttgttttttagacactctcaatctcattttccccttcactcatcagatcgctgtctctctctctcttacacacacaaggttctgattttattggggcatatgattgaagattttgatctgttgcttttaccctttcagtggtaaaagttatgaaatacagattgaattcttaactctgataattggttactggggattcgaactatggggtctcaaggtggtggtgataataatggaaaacattcccaactccagcctttggtgcggcaaaattcaatgtatagcctcacacttgatgaagttcagaatcatttaggtgacttagggaaaccactgagtagcatgaaccttgacgaacttctaaaaaatgtgtggaccgttgaggcaaaccagtccactggtgtggacattgagggtacagctcaaactagacaagctgcgctgcagcgtcaggctagtctttcattaactagtgctctaagcgggaagactgttgatgaggtttggagggatatacaacaaagcaaagataacaaggataagaagtctcaggagagacagtctacattgggagagatgactttggaggatttcttggtaaatgcaggggttgtagccgaagcatctactaggaagaatactggtgctacagtcggcgttgattcaaatgtagtggcgccacagtttcctcagcatggtccttggatacagtatccacaaccacaatatcaacatccaca

SEQ ID NO: 1532 - DNA, 1514 bp, Glycine max
acctctcaaggcatgattaaaagggctatattgtggatggtaaaactacaatattttacatttttttctaaagaaccttcacagaggagttataaagaacttaacaattaaaagcaaggcattggatgcaaatgcatcacatagctattcttgacatactggattcaaccacacagtaatccacaaggagaattccctgatactcaaatatacaaaccgctacaactaggtacagatctcagaatggagctgatgctattcggcgaagttgatattcaggttcaggagggggggcacatgacaacatctgctctagctcctttcgtttcctcagcctttcattttcctcttccaggcgcgagactttattctccaattcatttgggtatgcctgtttccttgctcttgaacgggcagcagattcccgattttttatcatccttttctgtctcctctcaacagtcttctctatcatgtcctcagaagtgctcttttttcttccaggagtctgcgtatctgacattgttcccatcagagacgatggcattgccatctgattatctgcaaacgaaacatctaatgaagctccagcccccatgtgtaatggctgtaccataccttggctaggcatatacatccccattaaactttgtggtggatgctgatattgtgcttgtggatattgtatccactgtgcttgtgaaggaaactgtggtactgccacgtttgaatcaactccagctatagtactggtatttgttctattagaagatgcacctgcaacaacacctgctttcaccaagaaatcctccaatgtcatttctcccaaagtaggatgtctgtcttggaacttcttctcccctacgattttgttttgttggatatctctccaaacctcatctacagtcttcttgcttagtgcaccggttaatgacagactagcctgacgctgcagagaagcttgactagcttgtgctgtgccctcattgtccataccaatggtctgacttgcctcagcggtccacacattttttagaagctcatcaatgttcatactagttagcggcttccccaaatcgcccaattgattctgaacctcatcaagtgtgagactgtacattgagttttgccgcaccagaggctggagtggtgactgtttcccattactgtctccaccaccaccatgagtccccatagtttgggtccccatttaccaattatcactgttaaaattcacttcacacctcacactcaacttttttagtaccccttctgtcgtcacaacttatccaaatcttcaaatcctttttttgtgcgtgttggagagagacacaccccgatctgaaagtggagtattagtgattgaagcaatgggttttggagcgaaaacaagaaaagaagaagcgtcgggtaatgcacaaaggttttcacaacacaagtcggagtctgtgtgtgtgtaagttcgtgctttggtcgcagaaaaacaatccaaggtgggttgtgacttgtaaacg

SEQ ID NO: 1533 - DNA, 684 bp, Glycine max
aaggaaactgcggtactgccacgtttgaatcaactccagctatagtaccagtatttgttctattagaagatgcatctgcaacaacacctgctttcaccaagaaatcctccaatgtcatttctcccaaagtaggatgtctgtcttcgaacttcttctccgcaatgattttgttttcttggatatctctccaaacctcatctacagtcatcttgcttagtgctccagttaatgacagactagcctgatgctgcagagcagcttgactagcttgtgatgtgccctcattgtccataccaatggtctggcttgcctcagcagtccacacattttttagaagctcatcaaggttcatactagttagcggcttccccaaatcacccaattgattctgaacctcatccagtgtgagactgtacattgagttttgcctttgggtccccatttaccaattttcactgttcaaaattcacttcacatctcacactcaacttttttagtacttcaagactgaaagcaacttttccaaatcttcaaatccttttcttctttttttgtctgtcggggagagagacacacaccgatctgaaagtggagtgtgagtgatagaagcaatgggttttggagcgaaaatcagaaaagacgaagaagcgttgtgttcgtgagtgtctgtgagcggacgcgtgg

SEQ ID NO: 1534 - DNA, 1065 bp, Glycine max
attaaaagggctatattgtgaatggtaaaactacaatattttacatttttttctaaagaaccttcacagaggagttataaagaacttaacaattaaaagcaagtcattggatgcaaatgcatcacatagctattcttgacatactggattcaaccacacagtaatccacaaggagaattccctgatactcaaatatacaaaccgctacaactaggtacagatctcagaatggagctgatgctattcggcgaagttgatatttaggttcaggagggggtgcacatgacaacatctgctctagctcctttcgtttcctcagcctttcattttcctcttccaggcgcgagactttattctccaattcatttgtgtatgcctgtttccttgctcttgaacgggcagcagattcccgattttttatcatccttttctgtctcctctcaacagtcttctctatcatgtcctcagaagtgctcttttttcttccaggagtctgcgtatctgacattgttcccatcagagacgatggcattgccatctgattatctgcaacaacacctgctttcaccaagaaatcctccaatgtcatttctcccaaagtaggatgtctgtcttggaacttcttctcccctacgattttgttttgttggatatctctccaaacctcatctacagtcttcttgcttagtgcaccggttaatgacagactagcctgacgctgcagagaagcttgactagcttgtgctgtgccctcattgtccataccaatggtctgacttgcctcagcggtccacacattttttagaagctcatcaatgttcatactagttagcggcttccccaaatcgcccaattgattctgaacctcatcaagtgtgagactgtacattgagttttgccgcaccagaggctggagtggtgactgtttcccattactgtctccaccaccaccatgagtccccatagtttgggtccccatttaccaattatcactgttaaaattcacttcacacctcacactcaacttttttagtacttcaagactgaaagcaaccggacgcgtgg

SEQ ID NO: 1535 - DNA, 626 bp, Glycine max
gacgtcctgccgcgtcgtagctcgattcgctcggctcggccgttcgttcgtgggatcagctgaacgttatcggatacacaaactccaggtcgaaaaaggggtgcctctggtgttgtggtggagaaaactgtggagaggaggcagaagaggatgattaaaaatagggaatctgctgctcggtcacgggcaagaagacaggcatacacacaagaactggagattaaagtttcacgattagaagaggagaatgaaaggcttagaagactaaatgaaatggagagggcattgccatctgtgccaccacctgagcctaagccaaagcaacagcttcgcagaactagttcagccatcttttgatatcttaattgcaatgaattcctaattcttgcccatgctatcacatcacatagctctcatgtgcattatactcccgcctcttcaagtttggttatagatgggaggctattgtttgtgatgctatcagttctccccagcttgctctattctactaatgtttacctcttatgtatattttgattacaacttaagctgctctataaatatacttactctaattttgggcccatttgtgggaattatgaaattataagtcttactttttattt

SEQ ID NO: 1536 - DNA, 509 bp, Glycine max
ccacgcgtccgggcgcgacatccagagcgccggcggcggcggcggcggccgtcagccctccatgggcgagatgacgctggaggacttcctctcccgcgccggcgtcgccgtcgatgccgccccgcattggatgcaccagtacccgcagcagcagcagcagtacgcgctgccgcggcccctgccgcttcccggcccggctctggacgccgcgtaccacggcgaccggcccggtgttttcctctcgcactcgcaggtggccgggcggaagcgcgccgccacggcggccgtggccggggacggcgtcgtggagaggacggtggagcggcggcagaagcgcatgatcaagaaccgcgagtccgcggcgaggtcccgggccaggaagcaggcgtacaccaacgagctggagaacaaggtggcccggctggaggaggagaacaagcgtctcattgagctcaaggtgctgaaaccactggagccactggagccgccaccggcggagcagaacaaga

SEQ ID NO: 1537 - protein, 357 aa, Oryza sativa
MASHAGGSGGGGGGSGRDAGSAHRGPMQGLARQGSLYGLTLNEVQSQLGEPLLIMNLDELLKSVFPDGADLDGGGGGGGIAGQSQPALGLQRQGSITMPSGAEQLFGNMDVVGGAAAAAAGTSDLNAGAQWLQQYHQQALEPQHPSIGAPYMATHLAPQPLAVATGAVLDPIYSDGQITSPMLGALSDPQTPGRKRCATGEIADKLVERRQKRMIKNRESAARSRARKQAYTNELENKVLRLEEENERLKKQKPTFILSSKVSRKQVTKAMRSATICVLCICILMILQCFASISAVDLGDAAASASGGEGLIRPRKLLQNAPAARSPPSRSAAAVEVEVNASLGKQKPSSKSNPRQN

SEQ ID NO: 1538 - protein, 409 aa, Oryza sativa
MASHAGGSGGGGGGSGRDAGSAQRGPMQGLARQGSLYGLTLNEVQSQLGEPLLSMNLDELLKSVFPDGADLDGGGGGGGIAGQSQPALGLQRQGSITMPPELSKKTVDEVWKGIQDVPKRGAEEGGRWRRERQPTLGEMTLEDFLVKAGVVTDPNDLPGNMDVVGGAAAAAAGTSDLNAGAQWLQQYHQQALEPQHPSIGAPYMATHLAPQPLAVATGAVLDPIYSDGQITSPMLGALSDPQTPGRKRCATGEIADKLVERRQKRMIKNRESAARSRARKQAYTNELENKVLRLEEENERLKKQKPTFILSSKVSRKQVTKAMRSATICVLCICILMILQCFASISAVDLGDAAASASGGEGLIRPRKLLQNAPAARSPPSRSAAAVEVEVNASLGKQKPSSKSNPRQN

SEQ ID NO: 1539 - protein, 366 aa, Oryza sativa
MASKAGGGGVARRGGGRMRSLGRQGSMYSLTLDEVQSQLGEPLHSMNLDELLRSVFPDGLAIADGAGATTSSQQHQPGSGLLRQGSITMPPELSKKTVDEVWKGIQAAPKRNAETGGGGGGGRRRRERQPTLGEVTLEDFLVKAGVVTQGSLKELSDVGNVDPVGRGVTATGTVDLAPGSHWIEQYKQQIASTDAHHHGQQGVQGAYFPNRLVPQPLNVGPGAILEPSYSDGQTSSGMIGGMSDSQTPGRKRGMSGDVADKLMERRQKRMIKNRESAARSRARKQAYTNELENKVSRLEEENVRLKRQKESDYLHYTRSNLVMENIEIHRSLINSNIIIWYDELYYFIGSVSSYNQEVFVMVIVCV

SEQ ID NO: 1540 - protein, 269 aa, Oryza sativa
MSCHGGGGGGGEGALSRQGSVYSLTLNEVESHLGEPLRSMNLDDLLRTVLPAAAAAAETAGRKTVDEVWRDIQGASTGRHHATPMGEMTLEDFLSRAGVAVDGAASAAGAHWLRGHYPPPPPPTTTTLQYVGGSGAVVDGVYNRVDGHGVAGFLSQVGVAGRKRGGGVDGVVEKTVERRQKRMIKNRESAARSRARKQAYTNELENKISRLEEENQRLREHKAVADFSTFPSCVDFLKAFLTQKLEPVMQIVPQPEPKQQLRRTTSASF

SEQ ID NO: 1541 - protein, 370 aa, Oryza sativa
MASKAGGGGVARRGGGRMRSLGRQGSMYSLTLDEVQSQLGEPLHSMNLDELLRSVFPDGLAIADGAGAGAGATTSSQQHQPGSGLLRQGSITMPPELSKKTVDEVWKGIQAAPKRNAETGGGGGGGRRRRERQPTLGEVTLEDFLVKAGVVTQGSLKELSDVGNVDPVGRGVTATGTVDLAPGSHWIEQYKQQIASTDAHHHGQQGVQGAYFPNRLVPQPLNVGPGAILEPSYSDGQTSSGMIGGMSDSQTPGRKRGMSGDVADKLMERRQKRMIKNRESAARSRARKQAYTNELENKVSRLEEENVRLKRQKESDYLHYTRSNLVMENIEIHRSLINSNIIIWYDELYYFIGSVSSYNQEVFVMVIVCV

SEQ ID NO: 1542 - protein, 219 aa, Oryza sativa
MSSHQGSGGVSRQGSLCGLALSEVEGQLHGVNLDDLLRTGGGGAGAGAAAAGRKTVDEVWRDIQGATGNGFLRPAGAAAGQMTLEDFLSRAGADSGSGGGGGADCARWARAHHHHVGRPVPRPLGLGAGPVLDALYHDGPVSGSKRAPAAGEGAAAEKTVERRKKRMIKNRESAARSRARKQAYTNELENKISRLEEENKRLRMHKVSKPVFVHHFQEP

SEQ ID NO: 1543 - DNA, 353 bp, Oryza sativa
aggagtacaacactcttgcaacagcacccaacaatttggagactgcagagaaaagggtgttcttactagctaaggaattttcaacatggcagttacagcttgaaccacctttaattccagggcagcttacttctactattaacatgattcagaagtcggccgagttaacccgccggagctgattctttggctcctggtgcgggacatactgtactaccggttcaggtgccttgagcatcctgagccgcttgttctcctcctcaagccgggagatcttgttctccagctcgttcgtgtacgcctgtttcctggcgcgcgaccttgctgtcgactcggggtttttgatcattccg

SEQ ID NO: 1544 - DNA, 609 bp, Zea mays
  misc_feature (6)..(6): n is a, c, g, or t
  misc_feature (10)..(10): n is a, c, g, or t
  misc_feature (16)..(16): n is a, c, g, or t
  misc_feature (192)..(192): n is a, c, g, or t
  misc_feature (196)..(196): n is a, c, g, or t
  misc_feature (241)..(241): n is a, c, g, or t
  misc_feature (261)..(261): n is a, c, g, or t
  misc_feature (470)..(470): n is a, c, g, or t
  misc_feature (521)..(521): n is a, c, g, or t
  misc_feature (542)..(542): n is a, c, g, or t
  misc_feature (561)..(561): n is a, c, g, or t
tttatntcgncaccangtgtgcggggccgcgggcgggggctgacaagggctgcgcgtctcacgtgttgtgatctttctgcccagagatgggcgatttgtcttcccttgatctgagtgacagtaaaacggagaccgggtagtgtggttcctgaaacctgttgatttatggggagccatacgagtcgatggcangctnggggatgtggaaaaagcatgggtagtagtgggggggccggggcancgcaacgcgggcagatgcanagtctggcaagacaaggggctctgtgtaaccttacccttgatgaggggcagagccatttgggagaacccctacacagcatgaaccttgaggagctgctgaagagtgtctttcctgaggacctggaccctgatggggggactaccagccaatatgagcagagttcgggcctcttgcgacagggaagtatcacaatgggggctgagctcancaggagaactgtggacgaggtgtggaaggacatccaggatgcgccaaacanaaatgtgggggagagtgggcngcggaagcgggagcggcanccaacgcttggagagatgacgcttgaggatttcttggggaaagctggg

SEQ ID NO: 1545 - DNA, 696 bp, Zea mays
gaaacagaacagcaggagacacctgggcaacacatacctgaataccttctcgtataaggaagctctcagacttagacatgtgtctagaagatgtacacactgacagacaccaaggaaatgatccgccaggacatgctacagcttgctagcgacctacatacactgacctaccgggccgggaaaaagctataccctcaatctatcaaatgtttctaatacaaaaggaaggaaaccatataaagtagaatccttgtataatgtacaaaaatcactatgagcattgtcagcgccgaaactcaaaaggcagccgaacccgttctcctgagttgatatttgggttctgggggaggagcagagctcagtatctcatccaactcctgctgtttctttagcctcttattctcctcttctagacggaataccttgttttcaagttcattagtataagcctgctttctcgctcttgatcgcgcagctgattccctattctttatcatcctcttctgccttctttcaaccaccttatccactacctcccctaaggcaccacgcttgcgcccaggtgtctgagggtccgaaagtgcaccaaatgatggcgaagtaatctggtcatcagagtaaattgaatccaaagtagcacctgtagcaatagacaatggctgagcgcgccactcactagccatgtatgaacctgcc

SEQ ID NO: 1546 - DNA, 1004 bp, Zea mays
actgcctatgccattcaagcccttcagatatccttcggcgacaaccccagctttcaccaagaaatcctcaagcgtcatctctccaagcgttggctgccgctcccgcttccgccgaccactctccccaacatttctgtttggtgcatcctggatgtccttccacacctcgtccacagttctcctgctgagctcaggcggcattgtgatacttccctgtcgcaagaggcccgaactctgctcatattggctggtagtgccaccatcagggtccaggtcatcaggaaagacactcttcagcagctcctcaaggttcatgctgtgtaggggttctcccaaatggctctgcacctcatcaagggtaaggttatacagagacccttgtcttgccagactctgcatctgcccgcgttgcgctgcaccggcaccaccactactacccatgcctcttccacctcccccagcctgtgatgcgattgtctggctccccataaatcaacaggtttcaggaacaacactagccggtctccgttttactgtcactcagatcaagcgaagacaaatcgcacatctctgggcagaaagatcacaacctacacgtgagacgcgcagcccttgccagcaccggagacggtgacgacatcgcctatcagctcaccacaggcgtcgaccactggcctgggcgcctggcgtcggtctggggctgcttcagtgcttcgaacgaaacaggaatgggtcaggcaacgaggcggaaggcgctaccttgtgtggcccgaccgaggcggagcgcctgagcagggcgcgggcggcaaaacaaatctttccctttcacttctcaagaggggcgccgccgcctagcatctgccattaggggaggaggtggaaggggaggaggcggccatgtgatgggtgtgcgaggaaaccatcggggtcgggggcctgagagagagatcttgtttagtgttaggcagcagggcctcgcccggcccgcctcgagggtcccaatg

SEQ ID NO: 1547 - DNA, 710 bp, Zea mays
  misc_feature (704)..(704): n is a, c, g, or t
tcgcccttttttttttttttttttttttcctaactccggttaccaaagaaagggctcccatacttctcgcgggtgcatccatccatctgttaagtcacaccatgtaaacaagctccgaccacctacatgtgtcctgaagattttacatactatactggtagcaaggcctcggacagcacatgctcggctcctgctagtctagagaaagggagggagggagagagcaaaccatcgagctaggataaacaaaaactcccaagctagcaaatgattctaaaccaaagagacaaaaaaacttacaagctacaggacttacaacctacagcaaaacaagatattctgcatacaatcagaaagtcgctgagccggttctcctcagttggtacttgggttccggaagaggctcagagaaaagtatattttccaactcctttaacgtggttagcttcttattctcctcttctaatcgagaaaccttgttttccagttcattagtgtatgcctgcttcctagcccttgaacgagcagctgactccctattcttgatcatcctcttctgccttctctccaccaacttatcagccacatctcctggggaaccacgctttctaccaggcatcggagaatcagaaagtgcacccatcatcggtgaagaaatgtggccatcagagtatgactccaaaatagcacttggtccaacatcnagggac

SEQ ID NO: 1548 - DNA, 876 bp, Zea mays
  misc_feature (18)..(18): n is a, c, g, or t
ggtaccctcgcaggcttnccgggacacggtcccgttctgcctggtgcctgcaacctgccttttcttcttccgtcgccacccagcgtgctctctctccctctttctctctctctcgtggcggcgcctgggcagccgtcgctgccgcctgcgctaggtgccaggtcttcttcgggcccttcgccggcgacgagtaccaccaggttgtacatgtgtacacccatgtgctttactgggtcggaccctactcatcctccacactaaggccatctccatagactgcactgtttagactccactgtttagagagtggagatagggagtgagatagagagtggaatagggaggatgctggagatagcctaaggttgccactgagtgtgtgcatgattcagaggcaatgtcatcacaaactggaggtggcaaagagagtgacgccggccctgggcaacacaggcagatgcaaagtttggcaagacaagggtctttatacaaccttaccctcgatgaggtgcagaaccatttgggggagccattgcttagcatgaattttgatgagctcctgaagagcgtgtttcctgatggtgtagattcagatggtgctgtcacaggcaagcctgatcggacctcgagcctgcagcgacaggggagcatcctgatgcctccgcagttgagcaagaagactgttgacgaggtgtggaagggcatccagggtggaccagagaccagtactgtgggtgggatggtctgcagaggcgagagaggcatccaacacttgggggagatgacacttgaggacttcttggtcaagctgggggttgttactgaaggacttgtgaaggatccagctgattttccaagcatatggatacagctggc

SEQ ID NO: 1549 - DNA, 1090 bp, Glycine max
aaactcaaacttttttttttctatttctcttcagctaaagtaggagcttcctcatcatgcacataaaaactagatttacatttacaataaaacataaagacacaagggagcatagaagattgaaaagaaaaaataaataaatatttttcttttaggaagacgctgacattcatttgtaaagcagcccaacgaaatccccttaattatggcgagcaaacttctttcaggctaatgggttttaattacatctctcagaaacttgagaaataattctgagaatgttggactatttgcatttccgtagttgtttggcatgagttatcgtcgttgatcaaggtctctcgtggtcttgatgcccaaagagaactaagggcacgaagacgtccatagtactctccaataacaataaagcatcgtgctgcttgacgaactgtgagtaatcgacatagctgatgaagagtttgctgcctcaaattatcagcctggcgaacaaaaccttcaagattggcaagcttgctcatggcaacgaccatttgttgaacaccatcaaccactgggcctccagctatggtgtccacaagtgactgctgcaactgctcaagtccctgagagagtgcttcttctgcttgctgtgaggaatgcctcaagccatacatccccattatttgttgctcagctagtggctccaactgttgaatcaacatcgtgatgagatcagagggtctaaaaccaccaatccagaggaagcaacgttcagcttgggaagtccacatgccattgataaggtggaacacatctgatttagcagccacaaccttgagcctgaaaatttcatcatagtgagaaagatatccatccaccatcactctcatatcactatctgataacggtgcttgcaacccgttcctcagctcccccattagcctgtgatcttcttctaaccatcttgcatattccatgtcaaacattgcggctccagagcttacagtacttccaacacctccataatccacgaacaagccctgagagcgtgctctttgaagttcttgttctatctgggtaagctttaatctacttgactctagctgct

SEQ ID NO: 1550 - DNA, 1861 bp, Glycine max
  misc_feature (5)..(5): n is a, c, g, or t
cggtnccgattcccgggtcgatatgggacatatgcacacacttcaagttttgatattctacaactttgtgatgaattgagtttcttctactttgtgagaaacttttagtttcaacttcagagaaggtgagaatggtctaagaagaagccttgcatggcgagccaaagaataggagaaacgggtttgtctgagtcaggaccttcaagtcaccatatcccttatggagttcttcatgggattaatacttcatcatcagccctaatcaatcaagggtcagcttttgattttggagagctggaagaggctattgttctgcaaggaattaagataagaaatgatgaagccaaagcatctttattcacaggcaggccttcagccacactggaaatgttcccttcatggccaatgagattccagcaaacctcaagaggaggttcaaagtcaggagaggaaagcagtgattcaggatcaggagtgaacactctttcaagcaaaaatgagctccaatttgaaacagaatctccaataagcataaaagcatctccttcagatcatcatcaggcttttgatcagcaccttcaacaacagcagcagcagcagcaacaacaacaacaggagacagcaacagcaggcacatcatcacagaatcaatcagcagccaaatcacctcaagaaaagaggaaaggagctggttccacatcagagaagccacttgatgcaaagacactgagacgtttagctcaaaacagagaagctgccaggaaaagccgtctcaggaaaaaggcttatgtgcagcaactagagtcaagtagattaaagctcacccaccttgaacaagaccttcaaagagctcgctctcagggtgtgtttatgggatgtggtggtgctggtggcagtttaagttctggagctgcaatgtttgacatggagtatgcaaaatggttagaggatgaccagcggcacatagcggagctccggtcggggctgcagacgccgctgtcggacggcgaactaagagtgattgtggatggatttctgtctcattatgatgaagttttcaggctgaaaggggtggctgctaaaacagatgtgtttcatcttattaatggcacatggacttcaccagctgagagatgcttcctctggataggtggttttaaaccatcagagctcatcacaatgttgataccacagttagagcccctggcggagcagcaaattatggtcatatgtgaactcgggcattcgtcactgcaaacagaagaagctctcagtcaaggtcttgaacagcttcagcagtctcttgttgacaccattgccggcgggcccatcgccgacggtgttcaacagatggtggcagccatgaccaagcttggccaccttgaagaatttgttgctcaggctgataatttgaggcaacaaacccttcaccaattatgtcgattgctgacagttcgtcaagcagcaaggtgttttcttgtgattggagagtattatggccgtcttagagcccttagttctctttgggcatcaagaccacgagagtcattgatcagtgatgataactcatgccaaacaaccactgaattgcaaatggttcaatcttctcagaatcatttctcaagtttctgaaatacattgtaattgaaacctggtgcaagtggatttctttgggctgctttagaaagaatggaaaagagtgtcagcatcatcaaagaattaatatcttttttttttcttctttcaatcttcctctcgtgtctcttatgttttgtaataattaaatggaattcgagttttatgtgaatgacgaggaagctcttctactttagctaaaaggagtagaggaatttaatgatat

SEQ ID NO: 1551 - DNA, 2064 bp, Glycine max
ccggaattcccgcctcgccccccccgtcgcttgcgatcggtttcttcttctgggtgtgttgcttaaatctgtggaaagttcatttttttttccgattttcatgtgaccagggtcttttggggctaataaggtttgtggagagagaagatgatcgttgtgctgagcatgattattgatgggtagcagaagtagaacggtaaacgttaacactaaggacactaacaaggttctgaacgggatgccaagctacgctcctccattgccttcttctaattccatagccatggaagcaactaatgttcatccttcccgcatttctgaatttggaaccctggagcaatctcttggatttcgcgttgaagataccattaatcttagcagaaatccgatgtttaatcaaatgaaatcaaatagccaagctctaggtgctgatattcaatttggtgctttaaataagtcaattgcaacatcagatataaacctctctgctgctattgctgggtctcaagcattggtattccaaaaagattcgcaaccaactctggcttcaacatctgctggtcgtgagaactggggagagaccaacttggctgatgctagccctaggactgatacttcaacagatgatacagaagacaaaaatcaaaggcctgaaaggggtgaatccagtggatcaaaagataaatcagatcaaaagacattaagacggcttgctcaaaatcgtgaggctgccaggaaaagccgactgaggaaaaaggcatatgtgcaacaattagagagcagtaggttgaaactgacccaacttgagcaggagctccagcgagcacgccagcagggaatatttatttcaagtactggagatcaggcacagtcaatgagtggaaatggcgctatggcatttgatgtagagtacgcacgatggttagaagagcataatagacaaaccaatgagctaagggctgcaataaattctcatgctggagatattgaacttcgaaccattgttgacaatttcatgacacaatttgatgatatcttcaggctgaaaggtattgcagcaaaagctgatgttttccacattctgtcaggaatgtggaagactccagctgagaggtgtttcatgtggattggaggctttcgctcatccgaactactcaagcttcttgaaagtcagttggagcctttaaccgagcaacaattgatgggcatctacaacttgcagcagtcatcccagcaggctgaagatgctctttcccaagggatggatgcattgcagcaatcactgtctgagacattggctaatggttcacccagcacatcaggctcctcgggaaatgtggcaagttacatggggcaaatggctatggccatgggaaagcttggtactcttgatgggtttcttcgccaggctgacaatctgcggcagcagacattacaacaaatgcttcgaatattaacgaccaggcaatcagctcgagctcttctcgccatcagtgattatttctcacggctgcgagctctgagttctttgtggcttgctaggccaagggagtgaagcatttcacagccccattagtggacttctttcatgcctgactcccttaaacaccgatgatcattgaatcttgtgctctgaatgagttcaatggaagctggtgtcttttgacaatgaattcctcttgaagcctagttgtgatgctataaacattaaatgctatgatttttctactctgccaactgctggtgtggtgcaacatttttctttaagcttttgtggttttaaaatagtctcaataatttgattatataggtgtatgatagatagaagctgttgaagggaaaaatgtagaaatagtgtatctgtatttttaggttatagctgttcattgtatttcagaaatcagcttttatttgagggggtatttacctctctttagtttcatttcctgcttaatggtttgtggttggttgcacataaggctccatggtgtatgtatttatacgttctcttttggtatattagaaagacattactaactaaaaaaaaaaaaaaaaggcggccgc

SEQ ID NO: 1552 - DNA, 1824 bp, Glycine max
cggacgcgtgggcaaataatgaccaatcataatcttccaggctgagagctatacagaggagagcacaattgattcttttcatgtttctgactttggagcatttgatcagtcatatcgaataggggatgctgttgacctcagtggaaacccagtttacaattcactaaaagtaaacagccaaacaatttctccaggttctgttcacattagtagtcttggtcaggtgagtttttctagttcttttcatccaatgaactccctgctttggtgaataaggcgaagttttagctggttacagtatgtcatattttctagttttctttattttctctttaatatagttgccaacttcacttgaaaaaagcccattgacgaatcaaatagagccgcataggttacgattacagaaggttcaatcatcaaatcctggcacaatattagttggtaatacagataaccaggaggagtctgccatggctgatgccagtcctaggactgatatttctacagatggtgacactgatgacaagaatcagccgtatgatagaaatgaagcccttgctgctgtttccgactctagtgacagatcgaaagacaaatcagatcagaagactctccgcaggcttgctcagaaccgtgaagctgccagaaaaagccgcttgcgaaagaaagcgtatgtccaacagttggaaagtagtcgtttgaagctgacccaactagagcaagagcttcagcgagctaggcagcatgggattttcatatcaagctcgggtgatcaagcacatacattgagtggaaatggggcaatgcaatttgatgcagaatatgcaaggtggctggaagagcagaatcgacaaattaatgagctgaaagctgctgtaaactctcatgcaagtgacactgaacttcgcatgatcgttgatggtatattggcacattatgatgagatttttaggctgaaaggtgttgcagctaaggctgatgttttccatttgttgtctggtatgtggaaaacacctgctgagaggtgttttttgtggcttggtggttttcggtcatctgaactcctcaagatatatcaatatcgatacaagaataagaatctgcttgggtggtggtagcgaagtgccaaaagaacaattaaattgtgctctatctaaagccctgagtctgctggttagtcaattggagcctctcacagagcagcagctgatgggtattaccaacttgcagcaatcctcccaacaagcagaagatgcattatctcagggcatggaagcattgcaacagtcccttgcagagacattgtccaccggagcacctgcctcatctggttcatcagggaatgtggcaaattacatgggtcaaatggccatggccatgggtaagctagggacacttgaagggttcattcaacaggctgacaatcttcgccaacaaactcttcaacaaatgcaccgtatactgacaactcgccaatcagctcgtgcactccttgctatacatgactacttttcgcgtctgcgtgctctcagttcactctggcttgctcgccctagagattgatgggcgcggtaaatagtatggcaaattaattttcatggatccatcactagcaatacttggtcatcataactcttgacaagttttcttgttgttttgttgtactctttgtatcactgatgttagtgcttcattgagtcagtctagaaacgaaattggtgacaagaagtatgaatattactaataatattgtccattgtaattgttgaagggctttgttttttccatacaaaaaaaaaaaaaaaaaaaaaaaaaaaaaaa

SEQ ID NO: 1553 - DNA, 1716 bp, Glycine max
ccacgcgtccgcggaaattggactgatcctttctctctctctctctctctttctcctcaacgcctcttcctttcaatttaatccaacaataataattattcgcaaaaaaacgttgaacagataccatcatcatcacccacatcatcagaatttcaagctatacagagggaagcgcaattgattctttttgtgtgtttgactttgatcaatcagttggatatcgcatagaggattgtgttgccttgaggggaaactcagtttttgactcactaaaagtaagtagccaaacaatttctcggggtcctgttgaagttgattcctttgataagttagttaccaacttcactcaataaaaacccattaacaagccaaacagagcgacaaagattgcaattacaaaaggttcaattatcaaatctggtcagtggggatacggaacaccaggaagagtctgccatggctgacgccagtcctagaactgatatttctacagatgttgacactgatgataagaatccacggtttgatagaagtcagtcccttgttgctgtggtttctgactccagtgacagatcaaaggataaatcagatcagaagactctccgaaggcttgctcagaatcgtgaggcagcaagaaaaagtcggttgagaaagaaagcttatgttcaacagcttgaaagtagtcgcttaaagttaacccaactggagcaagagcttcagcgagctaggcagcagggaatcattatatcaaactcaggtgatcaagcacattcaatgagtggaaatggggctatggcatttgatgtagagtatgcaagatggctggaagagcagaatcgacaagttaatgagctaagagcagctgtaaattcccatgcaggtgatacagaacttcgcatgattatcgatggtataatggcacattatgatgagatatttaggctgaaggccgatgcagctaaggctgatgtcttccatttgttgtctggaatgtggaagacaccagcagagaggtgttttctatggcttggtggttttcggtcatctgaactcctcaagctcctggtaaatcagttggaacctctgacagagcaacagttagtgggtattaccaacttgcagcaatcttcccaacaggccgaagatgcattgtctcagggcatggaagcattgcaacagtccctttctgagacattatccactggatcacttggctcctctggttcatcaggcaatgtggcaaattacatgggtcaaatggctatggccatgggtaaactagggacacttgaggggttcattaagcaggctgacaatttgcgccagcagactttgcaacaaattcaccgcatattgacaactcggcaatcggctcgtgcactacttgcaatacatgactacttttctaggttgcgtgcccttagctctctttggcttgcccgcccaagagactgatgggtggtaaatagtgtcattaattttcatggatctggcaccagaatcatttgtcgtaggtttttcactcttgcaattttactgtgttgtagttttcatattactgatattagtgtttcagtaagttataattcagaaactgaattggtgacatgacaagggtatgtattttgtttattactactaatgtgataatattgtccattgtaacacagttgaagggatttagattatttttttacaaaatagctgcgatgcgat

SEQ ID NO: 1554 - DNA, 1722 bp, Glycine max
gcgcgcgtcgccgcctcgtaagctcggcgtgaggcacgaggcctagaaattggactgatcctttctctctctctttcttcccaactcaactcaagtcctcttcctttcactttaatccaacaataataattattcgcaaaaaaaaaaaaaaaaaacacgttgaacagataccatcatcattcatcttcatcacccacatcatcagaatttcaagactcagtttttgactcactaagtaagtagccaaacaatttctcgggttcctgttcaagttgattcctttgataagttaccaacttcactcgataaaaacccattaacaaaccaaacagagtgacaaagtttgcaattacaaaaggttcaattatcaaatctggtcagtggtgatacggaacaccaggaagagtctgccatggctgacgccagtcctagaactgatatttctacagatgttgacacggatgataagaatccacggtttgatagaagtcagtcccttgttgctgtggcttctgactccagtgacagatcaaaggataaatcagatcagaagagtctccggaggcttgctcagaatcgcgaggctgcaagaaaaagtcggttgagaaagaaagcttatgttcaacagctcgaaagtagtcgcttaaagttgacccaactggagcaagagcttcagagagctaggcagcagggaatctttatatcaaactcaggtgatcaagcacattcaatgagtggaaatggggctatggcatttgatgtagaatatgcaaggtggctggaagagcagaatcgacaaattaatgagctaagagcaggtgtaaattctcatgcaggtgatacagaacttcgcatgattatcgatggtataatggcacattatgatgagatatttaggctgaaggccaatgcagctaaggctgatgtcttccatttgctgtctggaatgtggaagacaccagcagagaggtgttttctatggcttggtggttttcggtcatctgaactcctcaagctcctggtaaatcagttggaacctctgacggagcaacagttagtgggtatcaccaacttgcagcaatcttcccaacaagcagaagatgctttgtctcagggcatggaagcattgcaacagtccctttctgagacattatccactggatcacttggctcctctggttcatcaggcaatgtggcaaattacatgggtcaaatggctatggccatgggtaaactagggacacttgagggattcattaagcaggctgacaacttgcgccagcagacgttgcatcaaattcaccgcatattgacaactcggctgtcggctcgtgcactacttgcaatacatgactacttttctaggttgcgtgcccttagctctctttggcttgcccgcccaagagactgatgggggtaaatagtgtgtcattaattttcatggatctggcaccagaatcctttggcataggttttttactcttgcaattttactgtgttgtagttctcacattactgatattagtttcagtaagttattatctagaaactgaattggtgacatgacaagggtatgtattttgtttattactactaacgtaataatattgtctattgtaacacagttgaaggaatttagatgattttatacaaaaaaatggttgggatgtgaaaaaaaaaaaaaaaaaaaaaaaaaaaaaagcggccgctctacaggatcca

SEQ ID NO: 1555 - DNA, 1893 bp, Glycine max
ggtggaagatttgagcagaagaagacatgtagagattggaatcatccgtgtccctctctctcatctctctttctctctcttcccttggtttccttactaattactttaacccaataatccaataactacatacaaagttgaacaataccaccatcatagcgcatcatcatcagaattccaaggggaattgttgatgtggtggtgagaatgatgtatggggagtagaactacctggagggttgttggtgttgaagatgacaagggagctgaaagaggaatgccgagcttcaattctgagttacccaattccaattcatgctatacagaggggaacacaattgattcttttcgtgtttctgactttggagcatttgatcagtcatatcacatagaggatgctgttgacctcagtggaaacccagtttacaattcactaaaggtaaatagccaaacaatttctccgggttctgttcacattagtagccttggtcagttgccaatttcactcgaaaaaagcccattgacaaatcaaacagagccaccgcataggttgcgattacagaaggttcaatcatcaaatcctggcacaatattagttggtaatacagataactgggaggagtctaccatggctgatgccagtcccaggactgatatttctacagatggtgacactgatgacaagaatcatccgtttgatagaaatcaagcccttactgctgtttccgactctagtgacagatcgaaagataaatcagatcagaagactctccgcaggcttgctcagaaccgtgaagctgccagaaaaagccgcttgcgaaagaaagcgtatgtccaacagttggaaagtagtcgtttgaagctgacccaactagagcaagagcttcagcgagctaggcagcaggggattttcatatcaagctcgggtgatcaagcacatacattgagtggaaatggggcaatgcaatttgatgcagaatatgctaggtggctggaagagcagaatcgacaaattaatgagctaagagcagctgtaaactctcatgcaagtgacactgaacttcgcatgattgttgatggtatattggcacattatgatgagatttttaggctgaaaggtgttgcagctaaggctgatgttttccatttgctgtctggcatgtggaaaacacctgctgagaggtgttttttgtggcttggtggttttcggtcatctgaacttctcaagctgctggtaagtcaattggagcctctcacagagcagcagctgatgggtatcaccaacttgcagcaatcctctcaacaagcagaagatgcgttgtctcagggcatggaagcattgcaacagtcccttgcagagactttgtccaccggagcacctgcctcatctggttcatcagggaatgtggcaagttacatgggtcaaatggccatggccatgggcaagctagggacactagaagggttcattcaacaggctgacaatcttcgccagcaaactcttcaacaaatgcaccgtatactgacaactcgccaatcagctcgcgcactccttgctatacatgactacatttcgcgtctgcgtgctctcagttcgctttggcttgctcgccctagagattgatgggtgcagtaaatatgtcaaattagttttcatggatccatcaccaggaatacttggtcatcataggttttactcttgacaagttttcttgtgttgattgttgtagtctctgtatcactgatgttagtgcttcattgagtcacatagtctagaaacgaaattggtgacaagaagtatggatgtgtctactaataatattcaccattgtaattgaagggctttgtttttttccatataaatatagttgggcccatatgatatattttttg

SEQ ID NO: 1556 - DNA, 2172 bp, Glycine max
gatttgagcagaacaagacatttagagattggaatcatccgtgttcctctctctcatctctctttctctctgttccctcggtttccttactttgaagtttaatccaatccaataatccaataactacatacaaagttgaacaataccaccatcatagcgtatcatcatcagaattccaaggtggatttgcttcatcttttactccggcttcatgctgcatgagtaaaggccgttatgttatgctcatggtggatttttgtgcaactgggactaggggaattgatgatgtggtggtggtgagaatgatgtatggggagtagaactacccaggagggttgttggtgttgaagatgacaagggagctgaaagaggaatgccgagctccaattctgagttacccatttccaattcatgctatacagaggagagcacaattgattcttttcatgtttctgactttggagcatttggatcagtcatatcgaataggggatgctgttgacctcagtggaaacccagtttacaattcactaaaagtaaacagccaaacaatttctccaggttctgttcacattagtagtcttggtcaggtgagtttttctagttcttttcatccaatgaactccctgctttggtgaataaggcgaagatctagctggtatacaggatgccatatttcctagttttctctatttcctctttaatataggggccaacttcacttgaaaaaagcccattgacgaatcaaatagagccgcataggttacgattacagaaggttcaatcatcaaatcctggcacaatattagttggtaatacagattaccaggaggagtctgccatggctgatgccagccctaggactgatatttctacagatggtgacactgatgacaagaatcagccgtatgatagaaatgaagcccttgctgctgtttccgactctagtgacagatcgaaagacaaatcagatcagaagactctccgcaggcttgctcagaaccgtgaagctgccagaaaaagccgcttgcgaaagaaagcgtatgtccaacagttggaaagtagtcgtttgaagctgacccaactagagcaagagcttcagcgagctaggcagcatgtgaggggattttcatatctagctcgggtgatcaagcacatacattgagtggaaatggggcaatgcaatttgatgcagaatatgcaaggtggctggaagagcagaatcgacaaattaatgagctgaaagctgctgtaaactctcatgcaagtgacactgaacttcgcatgatcgttgatggtatattggcacattatgatgagatttttaggctgaaaggtgttgcagctaaggctgatgttttccatttgttgtctggtatgtggaaaacacctgctgagaggtgttttttgtggcttggtggttttcggtcatctgaactcctcaagctgctggttagtcaattggagcctctcacagagcagcagctgatgggtattaccaacttgcagcaatcctcccaacaagcagaagatgcattatctcagggcatggaagcattgcaacagtcccttgcagagacattgtccaccggagcacctgcctcatctggttcatcagggaatgtggcaaattacatgggtcaaatggccatggccatgggtaagctagggacacttgaagggttcattcaacaggctgacaatcttcgccaacaaactcttcaacaaatgcaccgtatactgacaactcgccaatcagctcgtgcaactccttgctatacatgactacttttcgcgtctgcgtgctctcagttcactctggcttgctcgccctagagattgatgggcgcggtaaatagtatggcaaattaattttcatggatccatcactagcaatacttggtcatcataactcttgacaagttttcttgtgttgttttgttgtactctttgtatcactgatgttagtgcttcattgagtcagtctagaaacgaaattggtgacaagaagtatgaatattactaataatattgtccattgtaattgttgaagggctttgttttttccatacaaatatagttgggccatatgatatattttaagggttgtttcagtcgccatagtttacccttggatctgagttcatacaaaattgttgagtttattctttt

SEQ ID NO: 1557 - DNA, 401 bp, Oryza sativa
  misc_feature (352)..(352): n is a, c, g, or t
  misc_feature (367)..(367): n is a, c, g, or t
cggacgcgtgggcggacgcgtgggcggacgcgtgggcggacgcgtgggctagagaccagcagggtcaggcttcagcagatcgagcaagaactccaaagagcacggtcacagggcctgtttcttggggggtgcagagcagcaggcgacatgagttctgtaaaatcgtttgcaggcgcggccatgttcgacatggagtacgcgcgctggctggacgacgacagcaagcggctgaccgacctccgtggcggcctgcaggcgcacctgctggacaccaaccttggcctcatcgtggaggagtgcatgcagcactacgacgagctgttccagcttcaaggcggcgctcgcgcgcctncgcgtcttccacctncttaccgggacgtgggctacccccgccgagcgct

SEQ ID NO: 1558 - DNA, 495 bp, Oryza sativa
  misc_feature (453)..(454): n is a, c, g, or t
cggacgcgtgggggaaaactgttagatgccaagactgaaaggcgattggctcagaacagagaagctgcaagaaagagcaggctgaggaaaaaggcttatgtgcagcaacttgagactagccgcataaggcttcagcaaatcgagcaagagcttcagagagcacgctcacagggcttgtttcctggaggatgcagtgcacctggagatatgagctcgggtgctgtaatgtttgacatggattacacccgatggatagacgacgacagcaaatgcatggcagagctccagggcgcgctacaggcccagctccccgacggaaaccttggtgccattgtggaagaatgcatgcgccactacgacgagctcttccaccttagggccgtgctcgccagcttccgcgtgttccacctgatgactggcatgtgggcggcgccggcccgacggtgcttcctnncttttggggcgttcggccatcagaaattctcaaaatgctga

SEQ ID NO: 1559 - DNA, 654 bp, Oryza sativa
  misc_feature (618)..(618): n is a, c, g, or t
ggaacaagggagccagtgaccagcattgcattgcacctcaacaaatttttgcctcttccttttcctagtgatgttgctttctcaatactttaataatagaacattacaacccctctccctctcccaccctctctttctaacatcacttttggccggagtttacatcctccaggagaagctctcaaaatcctgagtactgattctgctgaggctgattatgcatcggttgcagctcggttcctgtgggactgacgctctcggtgccaatgaagttctcgcgaggacgtgaagaccagaggttgctgagagcacggaggcggcggtaatactccccaatggagaggaaacaccgagccgcctgccgggttgttagaatccgccgcagctgatgcaacgtttgttgcctcagattgtcagcctgctggtagaagctctcgaggctggcgagcttgtccagggcgatggccatgaggctcatgtagttgggcacgccggggccgtcgttgagcgtgccggcggcgacggtgtcggcgagcgactggtgcagctgctgcagcccctgcgcgagcgcctcctccgcctgctccgacgactgctgcaggctgtagatccccagcntctgctgctccgtcagcggggccagctgctgtatca

SEQ ID NO: 1560 - DNA, 1985 bp, Oryza sativa
tcgagcggccgcccgggcaggtcgcctcgcctctctctcttccttctgaccaacccgacctcggcgcccccccccatttctctctctctctcttcgcgttgccgtctcgaccccgcctccaccgccgaagccgcccgaggcggcggccgccggcagctgggctcctccgaatccgaacacggcgggggctctcccctcgctccccacggcggttggcacctgctggctctcgatccaacgtgtacagctaatttgatctgttggcgccttagctagaaaggtggcgactctggcatctcagtgatcatagggcatttgaaggtggcctgcatccctgttacaagtaagggacaacaaagcaatttgttgtctctttatttggagctgggaagaacccggcatggcagatgctagttcgaggactgacacatcaacagtcctggataccgacgataagaatcagatggtagacgggcaaagtggagctattgtgccttctaattcatctgatcggtctgacagatctgacaagcccatggaccaaaaggtgttacgccggcttgctcaaaatcgtgaggctgcaagaaaaagtcggctgagaaaaaaggcatatgtacaacaattagagagcagtaagctgaaacttgcaagcttggagcaagagatcaataaagctcgcccacaaggaatttacatttcgagctcaggagaccaaactcatgctatgagtggaaatggagctatgacttttgatttagaatatgcccgttggttggaggaacaaaacaagcagataaatgagctgaggactgcagtaaatgctcatgcaagtgacagcgacctccgtctcattgtagatgggataatggcgcattacgatgagatattcaggctgaagggtgttgccgcaaaggctgatgtgtttcatatactttcaggcatgtggaaaacacctgctgaaaggtgcttcttgtggcttgggggttttcgttcctctgagcttctaaagcttcttgtgaatcagctcgagccattaactgagcagcagttgttgggactatcgaacctccaacagtcctctcagcaggctgaagatgctctatcacagggaatggaagcgttgcaacaatccttggcagatacgttggccgggtcccttggtccatcaggatcttcagggaacgtggcaaactacatgggtcaaatggctatggccatgggcaaacttgggacccttgagaatttcctccgtcaggctgacaatttgcggcagcagactttacatcaaatgcagcgaattctgacaatccgacaagctgcccgtgctctacttgcaatacatgattacttctcacgtttgcgtgccctgagttctctctggcttgctaggccacgggagtaacaacacatagggtgcatcaccgttaatgcttcatgaactgatctgggaggaacggcggagcgggactgattgcggatgcatttgcagaagattggtggctcagttccctcggcacaagttgtattgacaccttttggtttcatgttgtacctgatgttgtacaagtagggtaaagcttgtaacttgtaagttatggtgaatttatgattggcagattgtacaattgtattagcaataaaataaaaggtagataaaggctggaagaatacccagcgatcttacagtggtcggaaacgaaaagcaaaggggacatctcgcacgggatggtcgattgttctaactgaatagataagcacttaagcagggcctttcttttatgacaaccgaaatataggtgaaatggaaactatgggtagaacatgttctgctgattgtttggtcatcctatactcattatcttggtgtctatattatgtacatgcacacaagtgggcgctagtaccactgttttgagctttgtagatttatacctgtcctaatcagagtatactgtatttataaaacaactgccttttttttttca

SEQ ID NO: 1561 - DNA, 1092 bp, Oryza sativa
  misc_feature (19)..(19): n is a, c, g, or t
cagcagtttgaaaagcagnaagttgaagtttgttcagatggaacaggattatccacagagttcgttcccagggcttactgcttggagctccaggtggaaacaccagctcaggtgccgcaatgttcgacgtcgactacgcccggtggctggaggaagacagccagcgcatggctgaactgcacggagggctgcacgcacatctgccggacagcgacctcagagccatcgtcgacgacacgctaacccactacgaccacctcttcaacctcaagggcatggcggccaaggccgacgtgttccacctcatcaccgggatgtgggcgaccccagctgagcggtgcttcctctggatgggcggattccggccctccgagctgctcaagacattgacaccccagctggatcccctgactgagcagcaagtggttggtatctgcaatcttcaacagtcatcgcaacaggcagaggaagctctctcccagggcttggatcagctgcatcagtcattagcagaaaccgtggctggagggtccccgttggatgaccccaacgtcgggagtttcatgggtcacatggctattgccctcggccagctatcaaatcggggaggttttggcatacgggctggtaatttgaggcagcagactatccatcagatgcacaggattctgacagtcaggcaggcagctcgatgtttcttggccattggagagtaccataatcgcctccgtgccctgagctcactttgggcttctcgccctcgagagtaaaccccatgcctgatactggtggcagatgaaggcaattgtggggagctaagcattgcagcacatccatctgagagccaatattcagccttctgaaatcctgtttcaaatgtattttgcaactaaccttcaaagtagggagcaaaagcttgttttttaaatgaaatctagcactctagcagatatgtgagaaactcagaagagagttgggaaacaatggaaggctccagctgcactagcaaaattttcagatggaatgaatgggattgcatgattttcagttactgatcataaagcaagtagttcacgtcctttcctggatgat

SEQ ID NO: 1562 - protein, 423 aa, Oryza sativa
MPFAAEFDMLAFNNPIELLSNAYVLCMGPTHRSIKLGTTRKQYKQLGFPIKKAGKVCLWHVFLEPGQLALAAASDSDRSKDKHEDQKTLRRLAQNREAARKSRLRKKIHGKWKSFAKILWGITCKNRLGMGIGCWSGHGRELQGYIGMQDLQSRTVPSNSGQLQAYVQQLENSRLKLTQLEQELQRARQQGIFISSSVDQTHSMSGNGALAFDMEYARWLEEHNRQINELRSAVNAHAGDNELRGVVDKIMSHYEEIFKQKGNAAKADVFHVLSGMWKTPAERCFLWLGGFRPSELLKLEPLTEQQLSGIANLQQSSQQAEDALSQGMEALQQSLAETLAGSLGSSGSTGNVANYMGQMAMAMGKLGTLENFLRQADNLRQQTLQQMQRILTTRQSARALLVISDYSSRLRALSSLWLARPKE

SEQ ID NO: 1563 - protein, 357 aa, Oryza sativa
MGAYDRPPPVGMWSHEQFKVDNGQATSASTIMEAEMKFENRLEEIPQVVLEEGRNVDQEASKPPDKVLRRLAQNREAARKSRLRKKAYIQQLETSRLKLAQLEQELQRARQQAVYANGSLREPNLGFTGPIDPGALGFEIKYSHWVDEQNRNTGELRNALLQGQTTDQDLELKLLVEAGLDNYNRLFEMKEEAANSDVFYIMSGMWKTPTERFFLWIGGFRPSEVLKNLRPQLEPLTDKQVVEVGGLQQTSMQVEDALSQGMDKLKQTIADSLTAADPFDSPEAYMVHMANAVEQLRSLVQFVTQADHLRQQTLQEMHRILTTRQAARGLLALGDYFQRFRALSSLWAARPRDSGIS

SEQ ID NO: 1564 - protein, 292 aa, Oryza sativa
MADASSRTDTSIVVDNDDKNHQLENGHSGAVMASNSSDRSDRSDKLMDQKTIRRLAQNREAARKSRLRKKAYVQQLESSKLKLAQLEQELQKARQQGIFISSSGDQTHAMSGNGALTFDLEYTRWLEEQNKQINELRTAVNAHASDSDLRLIVDGIMAHYDEVFKVKGVAAKADVFHILSGMWKTPAERCFLWLGGFRPSELLKLLANHLEPLTEQQLLGLNNLQESSQQAEDALSQGMEALQQSLADTLAGSLGSSGSSGNVANYMGQMAMAMGKLGTLENFLCQASIFTF

SEQ ID NO: 1565 - protein, 366 aa, Oryza sativa
MAPSSLLIIFFLLPTSRSSALQQHGVAVVGMAAHQGMAAATAADRFCLPRMAAAAAAASQVENWGDSGVIVSSPFTDDTSTDLDDSADKHHLHALVGGGDGGDDAGEQRGADSSAVSKERRGDQKMQRRLAQNREAARKSRMRKKAYIQQLESSRSKLMHLEQELQRARQQMSDDELCELVDAVMMHYDQVFRLKSFATKSDVFHVLSGMWMSPAERFFMWLGGFRSSELLKVLASHLEPLTDQQLMGICNLQQSSQQAEDALSQGMEALQQTLGDTLVSAAATVVSGGGGADNVTNYMGQMAIAMAKLTTLENFLRQADLLRHQTLQQMHRILTTRQAARALLVISDYFSRLRALSSLWLARPRD

SEQ ID NO: 1566 - protein, 519 aa, Oryza sativa
MEGGRLGGAAASASAAAAADARGGMSGFAAPQHAIVKHGPGSVTHCGGKWTFAELCQSEQIWVLDCYCMQWACKFATNATECHTNLNNVQPTQVTDFGALAQSAGFRIEDLANLSTNGLFNLKSNAHTIINDPLQFENYVKSISPSNITTTATVTVVDPQTLVPQKGAQLNLVTIRTGNVENWGESTIADTSPRTDTSTDPDTDERNQMFEQGQLAAPTASDSSDRSKDKLDHKTLRRLAQNREAARKSRLRKKAYIQNLESSRLKLTQIEQELQRARQQGIFISTSSDQSHSASGNGALAFDMEYARWLEEHNKHINELRAAVNAHAGDNDLKSTVDSIMAHYNEIFKLKGVAAKADVFHVLSGMWKTPAERCFMWLGGFRSSELLKLLAGQLEPLTEQQLAGIANLQQSSQQAEDALSQGMEALQQSLAETLASGSLGPAGSSGNVANYMGQMAMAMGKLGTLENFLRQADNLRLQTLQQMQRILTTRQSARALLAISDYFSRLRALSSLWLARPRE

SEQ ID NO: 1567 - protein, 399 aa, Oryza sativa
MGIYDRRHHPLAAGVWGDHPFIRPDTTASTSNAAAAAMVVAPPPLTEPKFESQLALPLQHGDDQDNAAALQESPRHASDSFEQEASKPRDKIQRRLAQNREAARKSRLRKKAYIQNLETSRMKLAHLEQEITRARQQSAYINRSSNPATLPAPIDSGVVTFEVEYAQWVEEQGRQTAELRASLQAAAEGPELRAVVEAALAHYDRLFAAKREAARRDVFFVMSGVWRTGAERFFLWIAGFRPSEVIRVLAPQLEPMTERQAADVQGLQQKARHLEDALSQGMDKLKQTLADSLLAEAVVVSTSCDASPPPPPPEEEEPSSSAAGDGGCYMAQMGSAMGRLSNLVAFVDHADHLRQETLQNMYKILTLPQAARGLLALGDYCQRLRALSSLWAARPREPA

SEQ ID NO: 1568 - protein, 480 aa, Oryza sativa
MASMAPPCPTPWLLQTSYHSGQQIYSQQVVDLMLHVLISLLNLHWPDTDSEQGGGGGGGAAYFGELEEALVHQVATLRRRAQQTATTTTSHHGHTTPFSTAAAAATATATARPPATLDIFPSWPMRRSSLPTPKDGCSNVTADTTDSESSSKNNGDQGAAAADMASQFDQIPQQQQKQHKKMAASSTHSDHRMTKTLDPKIMRRLAQNREAARKSRLRKKAYIQQLESSKLRLAQMEQDLERARSQGLLLGGSPGGNTSAGAAMFDAEYGRWLEDGGRRMAELHGGLHAHLPDGDLRAIVDDALAHYDELFRLRAAAAKADVFHLITGTWATPAERCFLWMGGFQPSDLLKTVAPQLDPLTEQQVVGICSLQQSSQQAEEALSQGLEQLHQSLAETVANGGSVVNEASLGSFMGYMALALGKLSNLEGFVIQADNLRQQTLHQMHRILTIRQAARCFLAIGEYHNRLRALSSLWASRPRE

SEQ ID NO: 1569 - DNA, 1571 bp, Zea mays
aattcggcacgaggcacacagccgccgtttcttttacttgcgctcggcacgcaggcgacggctgcggcgctcaggttggggttctcatcgacggcgtcagcggcttcccctcccgcctctcgccagtcgcttcgcgccctcgcctccggtcctccgcacactggccggtgaccctgcatagtattatctgattttcctggaggccacattttaaggactgaggttacaatggcagatgccagccctagaacagaaacatcaacagatgatactgacgacaataacgggcttgaaccaggcagaggtggtcttgttgcttctgactccagtgacagatccaaagacaaacatggagatcaaaagacattgcgtcgccttgctcaaaatcgtgaggctgcaaggaagagccgactaaggaagaaggcatatgttcaacagttggagaatagcaggctaaaacttacccaactagagcaagagctgcaaagagctcgtcagcagggcatttttatatctagttcagttgatcagtcacactccatgagtggaaatggggcattggcctttgatatggagtatgcgaggtggttggaagagcacaatcggcaaattagtgaactaagggctggtgtcagtgctcatgcaagtgatactgatcttcgaagtgttgttgataagatcatgtcacactatgatgagatttttaggctcaaaggcaatgcagccaaggcagatgtttttcacgtcttatctggcatgtggaagacaccggcggagaggtgttttttgtggctaggaggtttccgaccatctgaggttttaaagcttctttcgacacaacttgaacctctcaccgaacagcagctgtcagggataagcaaccttcagcaatcttcacagcaggctgaggatgctctttcacaaggaatggaggcccttcagcaatcattggccgaaaccttggctgggtctctttcgtcttctggatcaacaggaaatgtggcaaactacatgggtcaaatggccatggctatgggaaaacttggaacgcttgagaatttccttcgtcaggctgacaacctgcggctgcagactctacaacagatgcaaaggatcctgaccactagacagtcagctcgggcgctacttgtgataagtgattactcttcacgtctccgtgccctaagctctctctggcttgctcggcccaaggaatagcaagaacatgctatttgactgcaatacttttcacaatttggttttcaatggtcaggagatttgacaaggctgcgacagacttgattcggacatatctgcacatactatgacccaaatggaaggggatgttcatgtagcttaggctgcttagctttgtagttaagtgttgttgatgtatcattaccaactgctgtaaaattctcactctgtatgcccctgatttgcagcgaaccattagaatgcacattgatgttcacctgtcgacttttttgttcactcttaggaacactagcgtaaacataatgttctgcccagtatcatctaaccagggtatatggctgatcccccgcact

SEQ ID NO: 1570 - DNA, 1633 bp, Zea mays
atggccagtgaattgaatttaggtgacactatagaagagctatgacctgctacttacctttttttacagcagtgcatgttcgtctcatggtgctgcattcagtttacaatgtgtctgaaggatttgaagaccccacccccagatagtggatgggcttttttttacatattgtatgtgtcaacaggtaatcagaaggctggctcagaatcgtgaggctgcacgcaaaagccggctgcggaagaaggcgtacattcagcagctcgagagctgtaagctgaagctttctcagatggaacaggacatgcagcgagcccgtacccagggcctctttcttggaggagatccgggtgcaagcaccagttcaggtgccgccatgtttgacgtggagtacgcccggtggctggacaaccacagccggcgcctggccgagctgaacggagccctacacgcgcacctggcagacggtgacctcagagccatcgtcgacgacgccctcacccaccacgacgagctgttccagctcaaggccatggcggccaaatccgacgtgttccacctcatcactggggtgtggacgacccccgccgagcgctgcttcctctggatgggtggattcaggccctccgatctgctcaagacactgctgccccagctagatccactgacagagcagcaagtggtcggcatatgcagccttcagcagtcatcacagcaggcagaggaagctctctcgcagggcttggagcagctgcatcagtcgcttgctgacaccatggccggtgggtctctgactgacgacgccaacatgagcttcatgagccaaatggctcttgccctcggcaaactggccaaccttgaaggctttgtgatacaggccgataacttgaggcaacagactcttcatcagatgcaccggattctgacagttcggcaggcagctcgatgtctcttggcaattggcgagtaccacaaccgccttcgtgccttaagttccctctgggcttctagacctcgagagatactggtgaccgatgaaggcaattgtgagataagcatcgcagcacaaccatcccaaaaccaattttcaaccttctgactgacacatgttgtggaactaaccctcagcataggagcaagagaaaaatgactgggaagagaatgactgggaagagagattgtttggatgcacgtagcagatatctgagagctacagaggaaagctgggaaatagaagaagctctaaaacaaggagtgtttctggaaattctttagttttcaaaaaacactttctgaaaatgtgtgtacaagaaaattccaggaaggtgaaattgcttcattgactgcagtgggaaggggaaagagagaagctagaatctcatgtcgagtactccagtacaatgtgttcttttgtctggtctaaattcttgtaacagctcttcctatgatggaagaatccattcaacaattccacctatgattactggattgagtatgttgaataggttggttgaggctatctagtaatttttatgactatgtttatccattatctaggactatttggttactatattatataatctttatcatatatacatccatttagttcaccaaaaaaaaaaaaaaaaaaaaa

SEQ ID NO: 1571 - DNA, 1531 bp, Zea mays
ggctcgagggaggccctcatccacggtggtggcgccgccagcgccggcggcggcgtcgatccgggcgtgatcatcaagaacgacgtcgcgcaggcaaagtgggaattcgcagtcagtagggagcaccggcactgactcgagctcagctcagaacacaatgtctcagatggagttggtgtccccagcctcctctgcgccgcggcaggaggtcatgatggtgaccactgatgattacagctacaagccaggcctcgccgctgcgcccgctgctgccgccccgccgagctttcagcagcaccacccgctcccgctgcagctgcacggaggagagggagggggagaccatgacaagacggaacggcggctggcgcagaacagagaggctgcgaggaagagcaggctgaggaagaaggcttacgtgcagcagctcgagactagcaggatcaggcttcagcaggtcgagcatgagctccagagagcacggtcacagggcctgttcgttggagggtgcagcgccgccggggacatgagctctggcgccgccatgttcgacatggagtacgcgcggtggcttgacgacgacaccaagcggctggcggagctccgaggcgggctgcaggcgcacctgctggacggcaacctgggactcatcgtggaggagtgcatgcagcactacgacgagctgttccagctcaaggcggcgctcgcgcgctccgacgtcttccacctcctcaccggctcctgggccacccccgccgagcgctgcttcttctggatgggcggcttccgcccgtccgagctgctcaagatcctgataccgcagctggacccgctgacggagcagcagctgctggggatctgcaatctgcagcagtcgtcggagcaagcggaggaagctctcgcccagggcctgcaccagctgcaccagtccctggccgacacagtcgccgcgggcacgctcaacgacggcgccgccgcccccaactacatgaacatcatggccgtcgcacttgagaagctcgccagcctcgaaaatttctatcaacaggccgacaatctaaggcaccagacgttgcatcagatgcgccggatcctgaccactcggcaggctgcgcggtgcttcctctccattggggagtactacagccgcctcagagctctcagcaacctctgggcttcccgtccccgcgagtaagattcagacttgatcaactgcaaaaactggagtttattgttgatcaactgcactgtagttgttcccaactcccaagcatgccttaatcacatgtattccttcgggtttttttttgaaagatagaaccacttgttttcagatttcattaggccttgttcgtttgtgccggattggtgggtcggaacgattcctagccggattgcttctctaatttatataaactttgattagctggaacaattccgggtgcaatccgatagaaacgaacaagaccttatatgaaaagtcagaaatggacatggctgacactggcaaaaaaaaaaaaaaaaaaaaagg

SEQ ID NO: 1572 - DNA, 1991 bp, Zea mays
caattttgctcttttatatagtccatcgccaccgcccacagcgacttcctgctggtctcttgttggtcgtagaactagcagtggccatggtgcaaggcgaggagagttcttggaggatggagagggcagcgctgcctctcaaccagctggcgctcgcgtacggagtccaagcccacgccgccgccgccgccgccgcggctgcaccgccgacctgcttcctggacttccagcctgcggccgcatccgctgcctacttcgggttcggtgagctggaggaggccctcatccacggtggtggcgccgccagcgccggcggcggcgtcgatccgggcgtgatcatcaagaacgacgtcgcgcaggcaaagtcagcggcaggatatctcgcgggcgctggcaccggcaggccccccacgctggagatcttcccttcgtggccaatgaggcaccaacagcagctgcacagtgggaattcgcagtcagtagggagcaccggcactgactcgagctcagctcagaacacaatgtctcagatggagttggtgtccccagcctcctctgcgccgcggcaggagatcatgatggtgaccactgatgattacagctacaagccaggcctcgccgctgcgcccgctgctgccgccccgccgagctttcagcagcaccacccgctcccgctgcagctgcacggaggagagggagggggagaccatgacaagaggaagcatggatccacaagaaaagatggcaagttggtagatgccaagacggaacggcggctggcgcagaacagagaggctgcgaggaagagcaggctgaggaagaaggcttacgtgcagcagctcgagactagcaggatcaggcttcagcaggtcgagcatgagctccagagagcacggtcacagggcctgttcgttggagggtgcagcgccgccggggacatgagctctggcgccgccatgttcgacatggagtacgcgcggtggcttgacgacgacaccaagcggctggcggagctccgaggcgggctgcaggcgcacctgctggacggcaacctgggactcatcgtggaggagtgcatgcagcactacgacgagctgttccagctcaaggcggcgctcgcgcgctccgacgtcttccacctcctcaccggctcctgggccacccccgccgagcgctgcttcttctggatgggcggcttccgcccgtccgagctgctcaagatcctgataccgcagctggacccgctgacggagcagcagctgctggggatctgcaatctgcagcagtcgtcggagcaagcggaggaagctctcgcccagggcctgcaccagctgcaccagtccctggccgacacagtcgccgcgggcacgctcaacgacggcgccgccgcccccaactacatgaacatcatggccgtcgcacttgagaagctcgccagcctcgaaaatttctatcaacaggccgacaatctaaggcaccagacgttgcatcagatgcgccggatcctgaccactcggcaggctgcgcggtgcttcctctccattggggagtactacagccgcctcagagctctcagcaacctctgggcttcccgtccccgcgacaacttcatcgggacagagagcctcagccccacagcaacggaactgcaagccctgcaccaccagcagcagaaccagttcgccggattttgaggcctcacctggtgagggagggtgtaaaactttggccgcgagggtggtgttacaaagattagaggttttgagagggagatgcattgtaatgttctatcattaaagtactgagaaagcaacatcactaggcgaaaagggcggggagaaggaattgctgtagtgcgatgttgggtggctcacctgttcatatggctcttgaactgattgaagggttagcaccgcagaattttttgcgggtagcagcagaaaacaaagcagtggcagaagattctggctgctcacttgccagagagcact

SEQ ID NO: 1573 - DNA, 965 bp, Zea mays
gcagatcgcttgcgcagaaccgagaagctgcgcgcaaaagccggctgcgaaagaaggcttacatccagcagcttgagagcagcaagctgaagcttgcccaaatggaacgggacatgcagagagcacactcccagccccagggcgtctttcttggaggagctccaggtgcaaacgccagctcaggcgcggcaatgatcgacgcggagtacgcccgttggctggatgaccacggccagcgcaaggccgagctacaaggagctctgcaagcgcacttgcccgacggtgatctccaagcgatcgtggatgacaccctgacccaccacgacgagctgttcaggctgaaggcttcagcagccaagtccgacgtgttccacgtcatcaccggggcgtggacgacccctgccgagcggtgcttcctctggatgggtggattcaggccatcggatctggtcaagacgctgctgccccagctagaccccctgaccgagcagcaactggtaggcatatgcaaccttaagcagtcgtcacagcaggcagaggaagctctctcccagggcctggaccagctgcatcagtcactagctgacaccatggccaacggatcgctgatcgacgacaccagcatgagcttcatgggtcaaatggcccttgcccttggcaagctgtccagccttgaagtttttgtgatacaggctgataacttgaggcagcagactcttcatcagatgcgccggattctgacagttcggcaggcagctcgctgtttccttgccatcgccgggtaccagaaccgcctgcgcgccctaagctccctctgggtttctcggcctcgagagatactggttgcagatgaaggcgactgtggggagatgagcgctgcagcatatgcaggcatcccaaagccaatttccgtccttctgattcaggcatgactcggagctctaaccaaccttctgactcaggag

SEQ ID NO: 1574 - DNA, 1359 bp, Zea mays
ggctcgaggcttggcccagggagttgcaacctgcagcagctgctccttattactttggtgagttggaggaggcccttatccatggcacccgtacatctgttgatcacggcatgatcggaagtgatgtggacacagagcgtaagacagctggataccttgcagctaggccccccacactggagatcttcccttcatggccaatgagtcatctacagcagccatacagtggtaactcgcactcagtagggagcaccactgagttcgagctcaggtcagaacagtatgccacagaccgagctggtgtccccagggagcatgagggccgactctggacagcgtcaggagcttttgatggtgactgttgatgattacaactacgagcaaggactcggagccgcagcaaccacagctccaatctttcagcagcatgcagcaggccaagacaagggaaagcatggatccacaaggaaagacggcaggctgttagacgccaagaccgagaggcgattggcccagaacagagaagctgcgaggaagagcaggctgagaaaaaaggcctacgtacagcagctagagacgagtcggatcaggcttcagcaaatcgagcaggagctgcatggagcacgctcacagggtctgttcccgggaggaggtggtgcggctggagacttgagttcaggcgctgtgattttcgacatggagtacgcccggtggctagaagacgacgcctcgcgcatgacggagctccaggccgtgctgcagccccagatcatcgacgcgaacctgggggccatcgtcgaggactgcatgcggcactacgacgagctgttccacctgagggccatgctcgcaagatccgacgtgttccacctgatgaccggcctgtgggcgaccacggccgagcgatgcttcctctggatgggagggttccgtccttctgaaatcctcaagatgctgataccgcagctcgaccctctcgcggagccgcagctgctagggatgtacaatctgcaacggtcgtcggagcagaccgaggaggcgctcgtgcaggggcttcagcagctgcaccagtcgctggcggacgccgtgggcgctagtcctctcagcgacggcgcgaatgtcgccaactacaccgctctcatggccctggcacttgacaggctcgacaccctcgagagcttttaccgccaggcggacagcctgaggcagcagaccttgcaccagatgcggcggatcctgacgacccgccagacggctcggtgcttcgtctccatcagcgagtaccaccgccgcctccgcgccctcagctccgtctgggcatcgtcccgccctccaactcctccaagcgagggcgtcgtt

SEQ ID NO: 1575 - DNA, 1786 bp, Zea mays
ggctttgcttttaccccccaaccttttcgacaggaccctgcttgctctacagggttctcccggaggcagaaactctttgcttccgcctggctcgcgatgcttgtttgggtgcgcgggcctgcggcgaggtgaggcgacggcggcgccgggcggttgcatggtggccgatggagagtagacggggagggtcgtcggcggcggcggcggaagatgcgggcggggcgatgccgagctttgggccaacgcagcacgccattcgcgcaggcgcagatgtgaacagcatgcaaccttctcgagttactgactttggggcactggcacagtctgctggattccgaatagaagatcttgctaaccttaatgcaaatgctttgttcaatctgaagccaaattctcatacgattgacaacagtcctctccagtttggaaattacggaaagtctatttcttctcatataaatactacagaagcaacaacagctgcaacaagaattgaccctcagctgtcagcacagcaaacaggagcacaaccaattctggtggcgttaccaactggtaacatggagaattggggagagtcagctatggctgatagccctatgactgacacatctacagatccagacactgatgagaggaaccagatgtttgaacaaggacttgttgctgtccccacagcatctgattctagtgacaaatcaagggacaaactagatcagaagacacttcggcgtcttgcccaaaatcgtgaagctgccaggtaaagccgtttacgaaaaaaggcatacatccaaaaccttgagagtagcagactgaaacttactcagttagagcaagagcttcagcgggctcgtcaacagggtatttttatttcgacatcaggcttttatgttcatgttgtctgatctgtaggagctttggcatttgacatggagtatgcacgctggttggaagagcacaacaaacatgtaaatgagttgaggcttgcagtcaatgcacatgccggtgataatgatctccgtggtattgttggtagtgttatggcacactacgatgaatttttcaggctcaagggtgtggcagctagatcagatgtttttcatgtgctgtctgggatgtggaagacccctgctgagagatgtttcatgtggttaggtggcttccgatcatctgaggttcttaagttactggcaggtcacctagagcctcttactgatcagcagcttgttggtatatccaacctgcagcagtcctcccaacaagctgaagatgctctttctcaagggatggaagcattacaacagtcgcttgcagaaactctagcatctggatccctgggccctgctggaccttctggcaatgttgcaaattacatgggacaaatggcgatggctatgggaaaacttggcacccttgagaactttctacgacaggctgataatctacggctgcaaacacttcaacaaatgcaacgcatcttaaccacccgacaatccgcacgagccctacttgcaataagcgactacttctctcggctgcgtgctttgagttctctttggcttgcccgtccaagggaataaattcaattaactcataactaggataatttttttgtactgtttctagtatggccattagtttcttcagaacgctcatgtgtcagtgagatatttggatcatattgtaggccatcatggtttactggacaactttgtaacaattttggagagaaaaaactgagttgtaaatacatctggaataatctaagatcttatgaaggggaaaa

SEQ ID NO: 1576 - DNA, 2252 bp, Zea mays
cattgggaccctcgaggccggccggaccccggggccggccgcgccgggacgtgctgcagagcctgcagaggcttttcttccccccaccccacccatcgcgtgtgagtccacggtgtgatgtcacggagcggtggcggctttcccgattcactgtgcgggagaaatccccgtgcagccttcttccacctcctcctactctccgctattcgtcttcgctgatttctgccgctccaattccatcgcttccctgctttagaaccttctctgctagcttctccccgtcacagcttttggtgcctcgtcatcggcgaccaaaccgccggcgaccggataaactaagccagctccttcgctccgaaagtcgtctctcgtagagagcacttgctcacctgctccccgccccccctctactggcgctggacttgctcggagtggagatccatccggacctggttcgatttcttcatttcgggttcgattcggtttttctatcccagagcgaaagatcaatatcacctgacacaacataacgatttcgtggaagccgaggttgcttctctgctcagtgggtggataactggattgtggattttgctaactacatgctgggttatcagcctatcataaggaaagcaaagaagagacaacaaagcaatttgttgtctctttcttaggagctggcgagtactcggcatggcagatgctagttcgaggactgacacctcgactgttttagacatggatgataagaatcaaaggttagaaaatggacagagtggagctatggccctggcttcgaattcatctgatcggtctgacagatctgacaaacctatggaccaaaaggttttacgacggcttgcccaaaatcgtgaggcagcaaggaaaagtcggctgaggaaaaaggcatatgtgcaacaactagagagcagcaagctaaaacttgcaagcctggagcaagaactccagaaagctcgacaacagggaatcttcatatccagttctggagatcaaactcatgctatgagtggaaatggagctatgaccttcgatttagaatattctcgatggcaagaggaacaaaataagcagataaatgagctgaggactgcagtaaatgctcatgcaagtgatagtgacctccgtcttatcgtcgatgggataatggcacattatgacgagatattcaggctgaagggcattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcagcaattgatggggctatccaatctgcagcaatcttctcagcaggctgaggatgcattgtcacaaggcatggaagcattgcagcagtccttggcagaaacgctggctgggtcccttggtccatcaggatcttctggaaacgtggcaaactatatgggtcaaatggctatggccatgggaaaacttggcacactcgagaatttccttcgccaggctgacaatctacgacagcagaccttacatcagatgcaacgtatcctgacaatccgacaagctgctcgtgcgcttcttgcaatccatgactacttttcacgtttgcgcgcactgagttctctttggcttgctaggccacgagagtaacatcacccccgttggggtcactcgatgaactgatctgtgaatgtgggactgctggctgcaaactcgcaaagcatttgcagatgactggaggatcagtcctctctgtacaagttgtattaacatcttctggtctcatattgtgctccagtgttgtacaatttagggaaaagcttggattaacttgtaagttatcatgaatttgttattggcatattgtacaattgtattagcaataaaaatagaagtacataagtgctggaaggactatccagcgtctatattggttggaaacgagcagcagaagcttgtcatgtcgattgttttccttgaatagtcggttgaagtgttcttttgggggtctatagagaacaaagaaagcttcaggagaaatgtataggtattcaccagtctaccatagagtgtgtgcttcggggagctccttgtgatggtaaaatttgataacgaggatgagttctgtgacattaaaaaaaaaaaaaaaaaaaaaaaaaaaaaaaaaaaaaaaaaaaaaaaaaaaaaaaaagggcggccgc

SEQ ID NO: 1577 - DNA, 1821 bp, Zea mays
ctcgaggccggccggggtccgtctcataccatcccatcccatcccatcccatccccgtgcgccgagttcacggccgccaccaccaccaccacaaccgattgcacaaggccacgcggcttctggaagcttcccttcccttgccttgccttgcctctcaacccaaatcgccacggctccctccgcccgcagcgccctcggcacgaccgccggattcgcctctgggtggggttggttttgtctcccccaccaccctacccacccctctcctctcctccaaggcttggcttgcctcgtgtcgtgtgtccctccaccgcccgccatgccgacgaggcttgccccccaccgccgatcgcacacggtcatatgattgcaatgaatcctgacatggtactactgtcttggaaacaaatggagaatggaagtggtgcggttgtaccttctaattcttcagataggtccgacaggtctgataaacctttggaccaaaagacaatgcgacggcttgcccaaaatcgtgaggcagcaagaaaaagtcggctgaggaaaaaggcatatgtgcagcagctggagagcagtaagctgaaacttgcacaactggaacaggaactccagaaagctcgccagcagggaatcttcatttctagctctggagaccaaacccatgccatgagtggaaatggagctttgacttttgacatagaatatgctagatggctagaggaccaaaataagcagataaatgagttgaggactgcagtgaatgctcatgcaagtgacagtgatctacgacttattgtagatggcataatggcacactatgatgaaatattcaaggtcaaaggtgttgctgcaaaggctgatgtgtttcatatactttcaggcatgtggaagacacctgctgaaaggtgcttcctatggcttgggggttttcgtccatctgagcttttaaagctcctagcgaatcacctcgagcctctaactgagcagcaaatgctgggtttgaccaacctccagcaatcttcccaacaagcagaggatgcgttgtcacagggcatggaagcactgcagcaatctttggcagagactttggctggatctctcggtccagcaggttcttcaggaaatgtggcaaactacatgggtcagatggccatggccatgggcaaactcgggacgctagagaattttcttcgccaagccgacaacctgcgacagcagacgttgcatcaaatgcaacgtatcctaacgatccgacaggcttctcgtgctcttcttgcaatccacgactatttttcacgattgcgcgctttaagttctctgtggcttgctaggccacgtgaataacgaagggccgtcagtattttgagttccctctgccttacggtgctgctgcgtcgttcgcagcgatgcatcacagatctttggtggtactgtttttgttgtacaattacttttggccgctgcttggtccaaattgtactcaggtgggtgtacaagtaggtcaatataatcctgtaagttatggtgatttatgggtgtgttagcaatgcaataataattagagagggcaggatcagggtttctgttgtttgtactggttagagatttagtcctaatgtaacttcctgggacatggggggcggaatgggaagagagtaacaagaatcttcctttggttactgtagtatatgttggtattgttgcatcccatttgctcattttgctgttaggagaatgattattctgtccctttggggactttttgagcggccttgtttgtaacccccacatgattatggatatgactgctagttccttccc

SEQ ID NO: 1578 - DNA, 2154 bp, Zea mays
cattctttttttcgtgtgttttttttgtgtgatgtcactgatcgttgtttttttttttgttttttgtgttttagaaatccccgtgcagccttcttccagctttttctactctttgctactcgtcttcgctgatttctgccttaattccatcccttccctgcctagaacttgctttgcttcaccccatcacagcttttggtgcctcgtcatcggcgacctaaccgccggcgaccagataaactaagccaggcccttcgctccgaaagtcgtctctcgtagagagcacttgctcacctgctcctcgccctcctctgctggcagtggacttgcgcggagtggagatccatccggacctggttcgatttcttcatctcggttgcttctctgtccagtgggtggatcactggattgtgggttgtgctaactgcaggctggcttgtcagcctatcataaggaaagtgaaaaagagacaacaaagcaatttgttgtctcattcttaggagctggcgagcactcggcatggcagatgctagttcgaggactgacacctcgactgttgtagacatggatgataagaatcaaaggattattttacgaaatttcaacttctctctgtgggacatctaatggtacaggtcttggagagatgcatgtaaagtgttagaaaacggacagagtggagccatggtcccggcttctaattcatctgaccggtctgacagatctgacaaacctatggaccagaaggttttacgacggcttgcccaaaatcgtgaggcagcaagaaaaagccggctgaggaaaaaggcatatgtgcaacagctagagagcagtaagctaaaacttgcaagcctggagcaagaactccagaaagctcgacagcagggaatcttcatttctagttctggagatcaaactcatactatgagtggaaatggagctatgaccttcgatttagaatattctcgatggcaagaggaacaaaataagcagataaatgagctgaggactgcagtaaatgctcatgcaagtgatagtgacctccgtcttatagtcgatgggataatggcacattatgacgagatattcaggctgaagggcattgctgcaaaggctgatgtgttccatatactttcaggcatgtggaaaacatctgctgaaaggtgcttcttgtggcttgggggtttccgttcgtctgagcttctaaagctccttgtgaatcagcttgagcctctaactgagcagcaattgatggggctgtccaatctgcagcaatcttctcagcaggctgaggatgcattgtcacaaggaatggaagcattgcagcagtccttggcagaaacgctggctgggtcccttggtccatcaggatcttctggaaacgtggcaaactatatgggtcaaatggctatggccatgggaaaacttggcacactcgagaatttccttcgccaggctgacaatctacgacagcagaccttacatcagatgcaacgtatcctgacaatccgacaagctgctcgtgcgcttcttgcaatccatgactacttttcacgtttgcgcgcactgagttctctttggcttgctaggccacgagagtaacatcacccccgttggggtcactcgatgaactgatctgtgaatgtgggactgctggctgcaaactcgcaaagcatttgcagatgactggaggatcagtcctctctgtacaagttgtattaacatcttctggtctcatattgtgctccagtgttgtacaatttagggaaaagcttggattaacttgtaagttatcatgaatttgttattggcatattgtacaattgtattagcaataaaaatagaagtacataagtgctggaagcctggaaggatatccagaatctatattggttggaaacgagcagcagaagattgttatagattgttatgttgctttgaatattcggttgtaagtgccttttttggggtatatagaacaaagaaagattcaggagagatgtagggattcaccagaggctatcggggattgtgcttctaggagctccctggactatctctagcaagtctcatattaagctctactctgtaaacagtgatacattgaattgaacgtgctacggttatgatggtaacatgtaaaaaaaaaaaaaa

SEQ ID NO: 1579 - DNA, 3262 bp, Glycine max
ggctcgagattgacgctgacatgaacaatagagggaaggggcgtctgaagtatctcttgcagcagactgagctgtttgctcattttgcaaaaggggatcaatcttcgtctcagaagaagtcaaggggaaggggtcgccatgcatccaatttcaccgaggaagaagaaggatgaagaatacctaaagggagaagaagatggtctagcaaacacacgtctggtgacacaaccatcatgtatccaagggaaaatgagggattaccagctggctggactaaactggctcatacgattgtatgagaatggaataaatggaattctggctggggaaatggggcttggtaaaacattgcaaactatatccttattaggttatttgcacgagttccgaggaatcaaaggtcctcatatggtggttgctccaaaatctactcttggaaattggatgaatgagattcggcgcttttgtcctgttcttcgtgcaatcaagtttcttggcaaccccgatgaaaggagacatatcagagatgaattgttggttgccgggaagtttgatgtttgtgtcacaagttttgaaatggcaatcaaggagaagtctgctttgcgtcgatttagttggcgctacataattattgatgaagctcatcgaatcaagaatgagaattccttgctgtccaaaacaatgaggctctacagtacaaactatcgtctccttattactggcacaccacttcagaataatcttcatgaactctggtctcttctcaactttcttctgcccgaaatttttagttctgctgaaacttttgatgaatggtttcaaatctctggtgaaaatgaccaacaggaggttgttcaacaattacacaaggtcctccgcccatttctccttcgaaggttgaagtcagatgttgagaaagggttgccaccgaaaaaggaaactattcttaaggtaggcatgtcccaaatgcagaaacagtattatagagcactacttcagaaggatcttgaggttgtaaatgctggtggtgaacggaagcgcctcctgaacatagctatgcaactacgcaaatgttgtaatcatccatatcttttccaaggtgctgaacctggtcctcccttcactacaggagatcatcttattgaaaatgctggtaaaatggttcttttggataagttacttcctaaattgaaagagcgcgattctagggtccttatattttcacagatgactaggctgctagacatactcgaagattatttaatgtttcgtggatatcaatattgtcgcattgatggaaatactggtggggatgatcgagatgcttccattgatgctttcaacaaaccaggaagtgagaaatttgtcttcttgttatcaactcgtgctggaggtcttggtattaatcttgctactgctgatgttgtcattctgtacgatagtgactggaacccacaagttgacttgcaggctcaggatcgtgctcataggattggtcaaaagaaagaagttcaagttttccgattttgtactgagtatacaatagaagagaaagtcattgaaagggcctacaaaaagcttgcacttgatgctctggtgattcagcaagggcgattggctgagcagaagacggtaaataaagatgagttgcttcaaatggttagatttggggctgaaatggttttcagttccaaggatagtacaattacagatgaggatattgatagaattattgctaaaggagaggaggcaactgctgagcttgatgccaagatgaagaaatttactgaagatgccatcaaatttaagatggatgacactgctgagttatatgattttgatgatgagaaggatgaaaacagatttgatataaaaaaaattgtgagtgagaactggattgaaccaccaaaaagggagcggaagcgcaattactcggagtctgaatacttcaagcaaacaatgcgccaaggtggtcctaccaaaccaaaagagccccgtattcctaggatgccccagttgcatgatttccagtttttcaacacacaaaggttgagtgagctgtatgaaaaggaagtacgctatctcatgcaaacacaccagaagaatcagataaaggattcaatagatgttgatgaaccagaagaggtgggagatccattgactgctgaagagttggaagaaaaggagcgcttgctagaagagggattttcttcatggagccggagggattttaatactttcattagggcctgcgaaaaatatggccgaaatgatataaaaggtattgcttctgagatggaaggaaaaactgaggaggaagttgaaagatatgcaaaggtcttcaaagaaagatacaaggaattaaatgattatgacagaattattaaaaacattgaaaggggggaggcaagaatttctcggaaagatgagatcatgaaagctattggaaagaagttggaccgctacaagaatccgtggctagagttgaagatacagtatgggcaaaacaaagggaagttgtacaatgaagaatgtgaccgattcatgatatgcatggtgcacaaacttggctatgggaactgggatgagttgaaggcagcttttcgaacgtcgcccttgtttcgatttgattggtttgtcaagtctcgcacaactcaggaactggctaggaggtgtgacaccctcattcggctggtagagaaggaaaatcaagaatatgatgagagggagaggcaagctcgtaaagagaagaaacttgctgctaagagcatgaccccgtcgaagcgttccatgcctagacagactgagagtccatctctgaagaagcggaagcagttaaccatggatgactatttgagctcggggaagaagaaaaaataaatgggcgtatgcgtatattttactttgggtaaagcggggcggatgatgcggcgattttgatatgggcctagctgacatttcaagtgatggcctggtgtgacttcccaagtccgtgattttttgtgggcctgaatataatgtttgaatattgaaattttgtaaatttactaacaaaccgatagattagatgtttatttattgttaactgcagccaattcaacatatttaatgttgctattcttcaaaaaagtgttttttaattcatacttaaggcttaattactgttttagattttcaatttgaggtcttatttttatttttttaattgttataattgatatttaaagccgtccgtgttgaaaattaaaaaaaaaaaaaaagg

SEQ ID NO: 1580 - DNA, 1143 bp, Oryza sativa
attctcttctgtccagacaatgaggatttataatactaattatcgtctccttatcacaggcacaccactccagaataatctccatgagctttggtctctcctcaacttcttgttgcctgaaatatttagctctgctgaaacatttgatgaatggtttcaaatttctggtgaaaatgatcagcaggaggttgttcaacagcttcataaggttcttcgcccatttcttcttcgaaggcttaaatctgatgttgtaaagggattaccccccaaaaaggaaactatccttaaggttggaatgtctcagatgcaaaagcagtactatcgtgccctgcttcagaaagatttggaggttattaatgctggtggtgaacgcaaaagattgcttaacatagccatgcagttgcgcaagtgctgcaaccatccatatttattccaaggagcagaacctggtccaccttacacaactggtgaacatctagttgagaatgctggaaaaatggttctgttagataaattgctgcccaaactgaaggatcgtgattctagggtgctcattttctcacagatgaccaggcttttggatatattggaagattatcttatgtacagaggctatcagtattgccggatagatggaaatactggtggagaagatcgtgatgcatccattgaagctttcaaccagccaggcagtgaaaagtttgtttttttgctttcaaccagggctggtggccttggcatcaaccttgctactgctgatgttgtggttctttatgatagtgattggaatccacaagctgatctgcaagctcaagaccgtgcacataggataggtcagaagaaagaagttcaagttttccgattttgcactgagtataccatcgaggagaaagtgattgagagggcatacaagaagcttgcattggatgctttggtcattcaacaaggccgactggcagagcagaagactgtcaataaggatgatctgttgcaaatggtaagatttggtgcggaaatggtattcagttccaaggacagcacaattacagatgaggatattgaccgtatcatagctaaaggagaggaaacaacagctgagcttgatgcaaaaatgacaaagttcacagaggatgctattaaatt

SEQ ID NO: 1581 - protein, 1152 aa, Oryza sativa
MGKPGKYGDGDDDDSEEEQLSPSSSAGEEEEEEVEEEEGEEQQEEQGEEEEGFSGDEEEQEVEGEADGEQVEEEEEEESSVGEEEAEAEGEEEEEEVEEEQGAGEEEEEEVDEEEIEAVTTGAGGDDDDEEVGDDGGAEEESQSTEDDEVAAGKDGGGEDGDKLEDATGNAEIGKRERAKLREMQKLKKHKIQEILDAQNKAIDADMNNKGKGRLKYLLQQTEIFAHFAKGNQSTEKKSRGRGRHASKMTEEEEDEEYLKEEEDALDGAGGTRLVSQPSCIKGKMRDYQLAGLNWLIRLYENGINGILADEMGLGKTLQTISLLGYLHEFRGITGPHMVVAPKSTLGNWMKEIQRFCPVLRAIKFLGNPEERNHIRENLLVPGKFDVCVTSFEMAIKEKTALKRFSWRYIIIDEAHRIKNENSLLSKTMRIYNTNYRLLITGTPLQNNLHELWSLLNFLLPEIFSSAETFDDWFQISGENDQHEVVQQLHKVLRPFLLRRLKSDVEKGLPPKKETILKVGMSEMQKQYYRALLQKDLEVVNAGGERKRLLNIAMQLRKCCNHPYLFQGAEPGPPYTTGDHLIENAGKMVLLDKLLPKLKERDSRVLIFSQMTRLLDILEDYLMYKGYQYCRIDGNTGGEDRDASIEAFNKPGSEKFVFLLSTRAGGLGINLATADVVILYDSDWNPQVDLQAQDRAHRIGQKKEVQVFRFCTEYTIEEKVIERAYKKLALDALVIQQGRLAEQKAVNKDELLQMVRFGAEMVFSSKDSTITDEDIDRIIAKGEEATAQLDAKMKKFTEDAIKFKMDDTAELYDFDDDKDENKLDFKKLVTDNWIEPTSRRERKRNYSESDYFKQALRQGAPAKPREPRIPRMPHLHDFQFFNTQRLNELYEKEVKYLVQANQKKDTVGEGDDEDQLEPLTVEEQEEKEQLLEEGFSTWTRRDFNTFIRACEKYGRNDIKNISSEMEGKTEEEVQRYAKVFQERYKELNDYDRVIKNIEKGEARIYRKDEIMKAIGKKLDRYKNPWLELKIQYGQNKGKLYNEECDRFMLCMVHKLGYGNWDELKAAFRMSPLFRFDWFVKSRTTQELARRCETLIRLVEKENQEYDERERLARKDKKNMSPAKRSSSRSLDTPPQSSSKRRRQSYTEANAGS

SEQ ID NO: 1582 - protein, 1122 aa, Oryza sativa
MAKPVKYDEEEEEVSSSGEEEEEQSDGAGSGSGEEEDEEEEEAPAAAAGEAAGGEEEEVDEEEIEAVTTGAGADEEEEESGAAAAAPGEGDEESQSTEDDEAVVGEDDDADEAEGGAVVGKREKARLKEMQKLKKQKIQEILDTQNAAVDADMNNKGKGRLKYLLQQTEIFAHFAKGNQSKEKKPRGRGRHASKMTEEEEDEEYLKEEEDALAGSGGTRLLSQPSCIKGKMRDYQLAGLNWLIRLYENGINGILADEMGLGKTLQTISLLGYLHEFRGITGPHMVVAPKSTLGNWIKEIQRFCPILRAVKFLGNPEERNHIRENLLQPGKFDVCVTSFEMAIKEKTTLKRFSWRYIIIDEAHRIKNENSLLSKTMRIYNTNYRLLITGTPLQNNLHELWSLLNFLLPEIFSSAETFDEWFQISGENDQQEVVQQLHKVLRPFLLRRLKSDVEKGLPPKKETILKVGMSQMQKQYYRALLQKDLEVINAGGERKRLLNIAMQLRKCCNHPYLFQGAEPGPPYTTGEHLVENAGKMVLLDKLLPKLKDRDSRVLIFSQMTRLLDILEDYLMYRGYQYCRIDGNTGGEDRDASIEAFNKPGSEKFVFLLSTRAGGLGINLATADVVVLYDSDWNPQADLQAQDRAHRIGQKKEVQVFRFCTEYTIEEKVIERAYKKLALDALVIQQGRLAEQKTVNKDDLLQMVRFGAEMVFSSKDSTITDEDIDRIIAKGEETTAELDAKMKKFTEDAIKFKMDDTAELYDFDDDKFGSLLNSIYILDFLKEENKLDFKKLVSDNWIEPPRRERKRNYSESEYFKQALRQGAPAKPREPRIPRMPHLHDFQFFNNQRLNELYEKEVRYLMQANQKKDTIDGEDEDQLEPLTAEEQEEKEQLLEEGFATWTRRDFNTFIRACEKYGRNDIRSIAAEMEGKTEEEVQRYAKVFKERYKELSDYDRIIKNIERGEARISRKDEIMRAIGKKLDRYKNPWLELKIQYGQNKGKFYNEECDRFMLCMVHKLGYGNWDELKAAFRMSPLFRFDWFVKSRTTQELARRCDTLIRLVEKENQEYDEQERQARKDKRMAKNMTPTKRSALRVSEGETTPSNSFKRRRQSLMDDYVGSGRRKRG

SEQ ID NO: 1583 - DNA, 4011 bp, Zea mays
gaaaaatcccctccgcctctcgtgaatccaccgcgtccaacccgcgtccggccccactcccccgccctcgaaatccaaagcgccccgccccgacccgaaccctaatcctgcattggctttcccgccaccgcccgccccaatggcgaagccggtgaagtatgacgacgaggaggagatctcctcctcctccgccgaggaggacgatgaccagtccgccgccgccgcctccggatctggtgaggaaggggatgacgatgaggaggatgctgcggcgctgcccacggaggaggaggaagctgagggcgaggggcagcaagaggaggaggtcgacgaggaagagatcgaagccgtcactaccggcgctggagctgaggacggagaggacgccagtgccgctaccgccgctgaaggcgaagaggagtcccagtccaccgaggacgacgaatccgtcgcaagggacaaggacaacggcgacgagactgatgcagtggttgggaagcgtgagaaaacaaggctaaaagaactccagaagatgaagaagcagaaaatccaggaaatactggatactcaaaacgctgccattgatgctgacatgaacaataaagggaagggacggttgaaataccttcttcagcagacagaaatatttgctcactttgcaaaaggaagtcagtcgaacgagaaaaagcctcgcgggaggggacgtcatgcatcaaagatgactgaagaagaggaagacgaagaatacctcaaagaggaagaagatgcccttgctggtgcagggggtacacgtttagtttcacagccttcatgcatcaagggaaagatgcgtgattaccagttggctggacttaattggcttatacgattgtatgagaatggtatcaatgggatattagctgatgagatgggtcttgggaaaacacttcaaactatttcattgctgggctatctgcatgagttcagaggtatagctggtcctcacatggttgttgcgccaaagtccactcttggcaactggatgaaggaaatccaacgtttttgccctatcttacgtgccgtgaagtttttggggaacccagaagagcggaaccatataagggacaatttgctacagcctgggaaatttgatgtgtgtgtgactagttttgaaatggcaatcaaagaaaaatctgcgttgaggcgcttcagctggcgctacataatcattgatgaagctcaccggataaaaaatgaaaattctcttctatcaaagactatgaggatttacaacactaattatcgtctcctcatcacaggcactccactccagaataatctccatgagctctgggctctcctcaatttcttgctacctgaaatatttagctctgcggagacctttgatgaatggtttcaaatatctggggaaaatgatcaacaggaggtggtgcagcagcttcataaggttcttcgcccattccttcttaggaggctcaagtctgatgtagaaaagggcctacctccaaagaaagaaacaattcttaaagttggaatgtctcagatgcaaaagcagtactatcgtgctctgcttcagaaggatttggaggttattaatgctggtggtgaacgcaagcgattgcttaacattgccatgcagttgcgcaagtgctgcaaccatccatatttattccaaggagctgaacctgggccaccctacacaactggtgaacatctaattgagaatgcaggaaaaatggttctacttgataaattgctgcccaagctaaaggagcgtgattccagagtccttattttttcacagatgaccaggcttttggatatcttggaagattatcttatgtataggggatatcagtattgtcgaattgatggaaatacaggtggagaagatcgtgatgcatccattgaagccttcaatagtccaggaagtgagaagtttgttttcttactttcaactagggcaggtggccttggtatcaacttggccactgctgatgttgtggttctctatgacagcgattggaatccccaagctgatctgcaagctcaggaccgtgcacatagaataggtcaaaagaaagaagttcaagtgttccgcttttgcactgagtacactattgaggaaaaggtgattgagagagcatataagaagctagcattggatgctttggttattcagcaaggacgattggcagagcagaaaactgtcaataaggatgatcttctgcaaatggtgcggtttggtgctgaaatggttttcagttctaaggacagcacaataactgatgaggacattgaccgtattatagctaaaggagaggagacaacagcagaacttgatgcgaaaatgaaaaagttcactgaggatgccatcaaatttaagatggatgataatgctgaattgtatgacttcgatgatgagaaggatgaaaacaaggttgatttcaagaaacttgttagtgataactggattgagccacctagaagagaaaggaagagaaactactctgagtctgactactttaagcaagcacttcgccaaggtgcaccagcaaagcctagggaaccaaggattccaagaatgccgcacttacatgatttccagtttttcaataaccaaaggctaaatgaattgtatgaaaaggaagtgcggtaccttatgcaagcgaaccagaagaaagataccattgatggtgaagacgaagatcagttggagcctttgacagcagaggagcaggaagagaaggaacaattattagaggagggttttgcgtcatggacaaggagagacttcaacacatttattcgtgcatgtgagaaatatggtcgcaatgatattaaaagtatatcatctgaaatggagggtaagacagaagaggaagttcaacgttatgctagagttttcaaggagagatacaaggaactgagtgattatgatagaattataaaaaatattgaaaggggggaagcaaggatatcccgcaaggatgagattatgaaggccattgggaagaagctagaccgctacaagaacccatggttagagttgaaaattcagtacggccaaaataaagggaagttctataacgaggaatgtgaccgctttatgctttgcatggtgcacaaacttggatatggaaactgggatgaactgaaagctgccttccgtatgtctcccttgtttcgatttgattggtttgtgaagtccagaactacccaagagttggctaggcggtgtgatacccttatccgactggttgagaaagaaaatcaagaatatgatgagcaagagaggcaagcaaggaaggagaaaaggcttgctaagaacatgactccaacaaagcgagctgcactaaagaattcagagggtgagaatactccaccgagttcattcaagagacgacggcagtcccttatggacgactatgtgggctcgggaaagcgtaagagaggctgaccacgtttggcatcctcccttactcgccaggacatgccgtctctacaatgataagaccctgccgcgcagtagtgcttagttcctcttgcacgtgagtcgaatacctgactagcgtaatttatgcaatgatgacataggttagttattaatcctaaatggagcatgtatgtgcatgctgtgttagtgtcgtagatctggacaactgttgctgcccagctgacacagatgcctttcgctgcaatgcttccggtcctgcattttgccgcaactgattttgcaaccaaggctaaacccaacgcgggcagtagtaactgttgcactcaggatccacgtacacaaaaatgagttgaggctaataacgtccctactcggctggtggtatatgttaagagccaatcatgtttaagctattactctgatcgttaaggtgcatcggatcgctaaggtggatctaactgtttgaactagaatgtaaagtgagaactgaaatggaagaagtacctttgcatcgatttgtgattggaatatatataaggtgaaggggtgtaatt

SEQ ID NO: 1584 - DNA, 2623 bp, Zea mays
caggaggtggtccagcagcttcataaggttcttcgcccatttcttcttaggaggctcaagtctgatgtagaaaagggtctacctccgaagaaggaaaccatacttaaagttggaatgtctcagatgcaaaagcagtactatcgcgctctgcttcagaaggatttggaggttattaatgccggtggtgaacgcaagcgattgcttaacattgccatgcagctgcgcaagtgctgcaaccatccatatttgttccaaggagctgaacctggcccaccctacacaactggtgaacatctagttgagaatgcaggaaaaatggttctactagataaattgctgcccaagctaaaggagcgtgattccagagtcctaattttttcacagatgaccaggcttttggatatcttggaagattatcttatgtatagaggttatcagtattgtcgaattgacggaaatacaggtggagaagatcgtgatgcatccattgaagccttcaataagccaggaagtgaaaagtttgttttcttactttcaactagggcaggtggccttggtatcaacttggccactgctgatgttgtggttctttatgacagcgattggaatccacaagctgatctgcaagctcaggaccgtgcacataggataggtcaaaagaaagaagttcaagtgttccgcttttgcactgagtacactatcgaggaaaaggtgattgagagagcatataagaagctagcattggatgctttagttattcagcaaggacgattggcagagcagaaaactgtcaataaggatgaccttctgcaaatggtgcggtttggtgctgaaatggttttcagttctaaggacagcacaataactgatgaggacattgaccgtattatagctaaaggagaggagacaacagctgaacttgatgcaaaaatgaaaaagttcacagaggacgccattaaatttaagatggatgataatgccgaactgtatgattttgatgatgagaaggatgaaaacaaggttgatttcaagaaacttgttagtgataactggatcgagccacctagaagagaaaggaagagaaactactctgagtctgattactttaagcaagcgcttcgccaaggtgcaccaacgaagcctagggagccaaggattccaagaatgccgcacttgcatgatttccagtttttcaataaccaaaggctaaatgaattgtacgaaaaggaagtgcggtacctcatgcaagcaaaccagaagaaagataccattgatggtgaagacgaagatcaattggagcctttaacagcagaggagcaggaagagaaggagcagttattagaagagggttttgcatcatggacaaggagagacttcaacacatttattcgtgcatgtgagaaatatggtcgcaatgatattaaaagtatatcctctgaaatggagggtaagacagaagaggaagttcaacgctatgctaaagttttcaaggagagatacaaggagctgactgattatgatagaattataaaaaatattgaaaggggggaagcaagaatatcccgcaaggatgagattatgaaggctattgggaagaagttagaccgctacaagaacccatggttagagttgaaaattcaatatggccaaaataaagggaagttctataatgaggaatgtgaccgctttatgctttgcatggtgcacaaacttggatatgggaactgggatgaactgaaagctgccttccgtatgtctcccttattccgatttgattggtttgtgaagtccagaactacccaagagttggctaggcggtgtgatactcttatcagactggttgaaaaggaaaatcaagaatatgatgagcaagagaggcaggcaaggaaggagaaaaggcttgctaagaatacgactccaacaaagagagcagcactaaggaattcagagggtgagagtgctccgttgagctcattcaagaggcgacggcagtctcttatggacgattatgtgggctcgggaaggcgaaagagagggtgatgtgatgtttgacatcctgcctttggagctctcagcgagatgcagtctctgcaatgctttaagcccgtccgtgctgtgcttagtttcttgtgcacgtgagttgaatgcctcaagggctggtgactttgtagtgtaagttatgcaacgatgacatagattagttattataaatcctaaatgaggtatgtatgcgcatgctgtattgtagtgctgtagattcggacttcgcaattgcaactgttgctacacttttggtcagtgatgatgcctttcgctgcaacagttgaggctccagttcaatatttgaagataaatccggtcccttctgtctagggatggccatgggtacctgatacccgttcggtaaaaaccgtattagagcacatgtgatggcgatttgttatacccctcggctatggtattgatcatgggtttgttctttcttgccatatatatgttctttcttgccatatatctgctactagatagaaaacctgctcacatgacacgtcttttatattaaatattaaatattggacaattagggtactacccttctgaaaaaaatcgcactattgtttag

SEQ ID NO: 1585 - DNA, 1834 bp, Glycine max
attcggctcgaggcataaccaataattgaatttgaatcatttgggtctctagacacaaacactaccccctctttccccctcctcaacattgttatgatcccttgttggtaaccattccatttgcacttgtctttgcaaccaaaaaacaagctctatgaccaacgaaatgaaagaagcaagtgccttaggagctagaacagcacgagcatgcgagagctgcctaaaagtaagagcacggtggtattgtgcagctgatgatgcattcctttgccatggctgtgacaacatggttcactcagcaaaccaattagcaagtagacacgaaagggttaagcttcaaactgcatcctctaaggtcaactactcagtgacccctaaggtagcatggcacagtggattcacacgcaaggcaagaacgccacgccacaacaacaacagacactcatcattgaaacaacaacaacaaaaaaaaccattacatgaagaacgaggagaggaagaagtgtttttcaataacactattagtcttcttccccttgtgcctgagcttggaagtgaagagccattgcttaatgatgagactgaggagcaactactgtgtcgcgtgccggtgtttgatgctgagctttgtagcatatacaatgaagtgaaggacgaggttgtagctgctggtgaagaagccttggacttggaaaacttttcttccgagtttcttccatcagatacggaccttgctgagtttactgctgatgtgaaaagctttcttggaaacggggctgatgaggattcacctgatgatgatgagcacgtgaaagaatcagaactactgattcttgattgcaaagaagaagaaggagatgaggaaatggatgaatgttttgatggagtactaattggagccaaagatgctatggtgggtgaaggtcaaagatgaagaagaacttgatgctgatgatgacacagcttgccatttggattcgattcttgatatgaacggcgaggcatttaattggaatattgttgaatcagaatcacctgcacaggcacaagaagatgaagtgagtaaagtgggaactaagaaggacatatttttgagattaaactatgaagaagtcattactgcttgggcaagtcaaggttctccatggactaatgggaccccacctaagttcttcaactctgatgattgctggctagacttcttgggttcgaatggtgggaatgttcaatgctgttatggggcagtgggaagcttaagggtgcatgcagatgggggaagggaagcaagagtgtcaaggtaccgagagaagagaagaacgcgtttatttgcaaagaagataaggtatgaagtgaggaagttgaacgcggagaaaagacctagaatgaaaggtcgatttgtgaagaggacaccctttgttggagccactgcgttgccagcttaatcatcaatcaccactgacatgattgatcatcaaagtgatcaaattaatggttaacttctccaagttaatttgattttatggaaaagttaatttttagattaattattagttacttggttttgccatatatgtacaatatcatcactaggtcaggtttctcttgcttgggatatttatttctttctctaacaggtctagctagtactaatggaaatgtggtagcccctctcagcattttgaaggctttggtaatcaatttcgggagccctttttcaatgttgcttaattatgatatatataagaatctgtaattaatctatgctgatgttatgtttacctttaactctgagggtactgattaacagtgtttaacatcaggtacttatatgtcc

SEQ ID NO: 1586 - DNA, 1494 bp, Glycine max
tacggctgcgagaagacgacagaagggggttaaggtcaaagatgaagaagaacttgatgctgatgatgacacagcttgccatttggattcgattcttgacatgaatagcgaggcctttaattggaatattgctgagtcagagtcacctgcacaggcacaagaagatgaagtgagtaaagtgagaaccaataagaaggacatatttttgaggctaaactatgaagaagtcattactgcttgggcaagtcaaggttctccatggactacaggaaccccacctaagttcttcaactccgatgattgctggctagacttggtaacttctcttcaaccctctttgcttatgcagcagtatcttcttgtgtgtttggtttgacttatttttatgagaataaatttttcagttttcttatagtatcatagccgatctcatatatatctggctaaaggaggaaggttgtgttgcgtcttcagtaaccgatgtaaaattcgtcgatatacctgaaatcattcgtagggcggagatgtgttatgccttcggtaaccaatgcaaagttcgtcgatatacctaacatgaatcgctcacagtgagataaaattttgttgttgtggatacatgagagctctcaaaagaaaactattatatattttttattttttttaaaaaagaaaaagtctctcaacaagcatgcagctactcaattatgcacaattgtattgtataggtggccgtagctccttatgagttgtttaattacatagctgtgtttttagtttttgaagttgcaaaccaaaatactgagtttttaaaaaaaatttagaaatgaccatttaaattgttttgaagctcaaacttgatcatcactgtttctatagttgaaatgaaactttctaatttttattttattttgttaagggttcgaatggtgggggtgttcaatgctattatggggaagtgagaagcttaagagtgcatgcagatgggggaagagaagcaagagtgtcaaggtaccgagagaagagaagaacgcgtttatttgcaaagaagataaggtatgaagtgaggaagttaaacgcggagaaaagacctagaatgaaaggtcgatttgtgaagagtgttcctttgttggagccactgctttgccagcttaattatcaatcatcaccactgacatgattgatcatcaaagtgatcaaattaatggttaacttctccaagttaatttgattttatggaaaagttaatttttagattaattattagttacttggttttgccatatatgtacaatatcatcactaggtcaggtttctcttgcttgggatatttatttctttctctaacaggtctagctagtactaatggaaatgtggtagcccctctcagcattttgaaggctttggtaatcaatttcagaagccctttttcaatgttgcttgattgtcatcatatgaataaaaatctgtaactaatccaaaaaaaaaaaaaaaaaa

SEQ ID NO: 1587 - DNA, 1540 bp, Glycine max
attcggctcgagaaacgaaaagccattgttacaagcatttcacacttaacatatcaaaaaaacaaaggtttctactttctacgatgagagacatgaaagacgcaggtgccttgggaggcaagacagcaagagcctgcgacagctgcgtaagcagaagagcaaggtggttctgtgcagctgatgatgctttcctctgccatggctgcgacactttggttcattccgcgaaccagttagcaagcaggcacgaaagggttcggcttcaaactgcttcctcaaaagtaaccaccacgcacgcatggcacagtggattcacacgcaaggcaagaaccccgcgtcacaacagcaagcactttgcgctgcaacagcgtctcaaagacgaagttctcttcaacaacaccagtgttcttcccctcgtgccggagctcggaggggaagaacaagaaccggtggttgtggataacgatgagacggaggagcagatgctgtgtcgggtgcccgtgttcgacccttttgatgtgagaaccgatgacttggatagtttttctgacatggatttcgctgagtttgctgctgatgttgaaagcctacttgataaagaagacgatgaaataagtgcgtgtgtgggagggggagagggagagggagagggagttcaagcgtgcattggccaaggttaaggatgaagaagaaattgatggtgatgtagcgtgttatctggaatcggtttttgatgatgcctttcattggaataacattgagtctgtgctgtcagatgcacgggaagagaaggagggtgtggtggcgtgtgatgtaggtgtcggtgatgaagaaggaggaacaaagagagacatatttttgagactaaactatgatgaggttattactgcttggtctagccaaggttcttctccatggacaacttcaaacccacctaagttcaactctgattatgacttctccttgggtttgagtggtgtaggtggggaagtaagaagcttaagagggcacctagatggtggaagagaagcaagagtgtcaaggtatagagagaagagaaggactcgtttgtttgcaaagaagataagatatgaagtaaggaagttgaacgcagagaaaaggcctagaatgaaaggtcgttttgtgaagaggacatgctttgttggagccaatgcttttcctgcttaccactgacatcaatcaattaacggatccatctttgctttttctgcaaatttgggttaatacttggtttggctatatatatgtacgtatatatagcctgtattatataaatactagtaaataatattactgggccaggttaattttactagaattgttgcttgggatatttctgtctatatatatctctagacaggtttagtaattagtactaattaatgatcatctttattggcaggtttaagccttttggaatccaattttggaagccttttcattgtttctcattagaaattcaattgttcaatgctgatgctgttatttgctagccagttgctatttcacgctgctgatt

SEQ ID NO: 1588 - DNA, 949 bp, Glycine max
  misc_feature (409)..(410): n is a, c, g, or t
ccacgcgtccgacttaacaatggtttgtaagatatgagagacatgaaagacgcaggtgccctgggaggcaagacagcacgagcctgcgatagctgcgtaagcagaagggcaaggtggttctgtgcagcagatgatgctttcctctgccatgcttgcgacactttggttcattccgcgaaccagttagcaagcagacacgaaagggttcggcttcaaactgcatcctctaaggcaaccacaaccactacgcacgcatggcacagtggattcacacgcaaggcaagaaccccgcgtcacaacaacagcaagcactttgcgctgcaacagcgtctcaagaacgaagttctcttcaacaacactagtgttcttcccctcgtgccggagctcggaggggaagaacaagagccgnnggttgtggacaacgatgaaacggaggaacagatgctgtgtcgcgtgcccgtgttcgacccttttgatgtgagaaccgatgacttggatagcttttctgacatggatttttctgaatttgctgctgatgttgaaggccggcttgacaaagaagacgatgaaataagtgcgtatgtgggaggaggagagggagttcaaggtgtattggccaaggttaagggcgaagaagaaattgatggtgatgtagcgtgttatctggagtcagtttttgacatgatcagtgatgatgcctttcattggaataatattgagtctgtggtgtcagatgcccgggaagagaaggggtgtgtggtgccatgtgatggtggggttagtgaacaaggaggaataaagagagacatatttttgagactaaactatgatgaggttattactgcttggtctagccaaggttcttccccatggacaacttcaaacccaccttaagttcaactctgattatgacttctccttggtactactactacttaactttcctttt

SEQ ID NO: 1589 - DNA, 1465 bp, Glycine max
cttgtttttttcccatcaaaacaatcattcccctgttaccaaaaccacactgtaacccccctttttttggtattggcttcaaatgagttcggctactaagaacgcggcaaacgcggttggggccaaaacggcaagagcatgtgacagctgcataaccaaacgtgcacgttggtactgtgctgccgatgatgcttttctctgccaggcctgcgactcttctgttcactcggcgaatcctttggctcgaagacacgaacgagtccgcttgaaaacggcgtcctacaagtccactgatgaacaacaacaacaacaacaacaacaacctcccacgtggcacactaagaaacctcgaacgccgaggcacgggaaacattctcgtaacaacaaccctttccatttggtccctgaagagggttcggaggaggcgaattcccatgatgagaacgaggagcagcttctttatagggtccccatattcgacccttttgttgctgagctatgtgggactaatagttctccttctcctgttacttcaactgatcaaggagtagttgctgctgctgaggttgaatacaaagggtttcaaagcaatggtttttgtagcaatagcagtgagatggaaaacttgcatgggatgcttccttctgatgcagaacttgctgagttcgctgctgatgtggagagcttgttgggtagggggcttgaaaacgagtgcgtggggatggaagaattgggactggttgatgcgaaagaggaggagtgttcggtaggtagtgggaaggtgaagatggaagatcaggaagagagccctctggtggagatggagatggatatggtcgtgggcagagatgatcaatcgtttgagttgagctttgattatgaaacgtgtgaagaggtgaaggtttgtgatttgggattggggaatgaattaggagcgaagaaagagaatgatgatgaggtgaaaaagaccaagatttcgttgcagctagactatgaggcggtaatcatcgcctgggctagccaaaaatctccgtggaccaccgctgacaaaccaaacttggaccctgatgagtgctggaaacaatgcatgggaagttgcgaaacggcatatcatcatccttgcggtgaaatgggtggatttgggattcatccagtgataatagacgggggcagagaggcgagggtgtcaagatacagagagaagcgccgaacgaggttgttctcgaagaaaataaggtacgaagttaggaaattgaatgctgagaagagacccagaatgaaggggaggtttgtcaagagggcttcctttgcaccaccaacatttcctttgctaaataaataagagctacatttgtatgttctgccactaaagttttgttagtatttgctaagtatagttttgcgacgtgatatcgcttttcatttcattttcttatttctttgtatataaaaattttgctaagtt

SEQ ID NO: 1590 - DNA, 1462 bp, Glycine max
acgagcactccctcttttttccatcaaaaataatcattcccctgttaccaaaaccacactgtagcctaacccctcccttttggtgtcatgagttcggctactaagaacgcagcaaacgcggttgggggaaaaactgcaagagcatgtgacggctgcataacgaaacgtgcacgttggtactgtgctgccgatgatgcttttctctgccaggcttgtgactcttcggttcacttggcgaatcctttggctcgaagacacgaacgagtccgcttgaaaaccgcgtcgtacaagtccaccgatgaacgacgacaacctcccacgtggcacaccaagaaacctcgaacgcccagacatgggaaacattctcgtaacaacaaccctttccacttggtccctgaagagggttccgaagaggcgaattcccatgatgagaatgaggagcagctcgtttatagggtccccatagtcgacccttttgttgctgagctatgtgggactaatagttctccttcttctgttacttcaacgctccagggggtagtagctgctgctgctgctgcttctgctgtggttgaatacaaagggattcaaagcaatgatttttgtagcaatagcaatgagatcgaaaacttgcatgggatgcttccttcggatgcagaacttgctgagtctgctgctgatgttgagagctttttgggtaagggggcttgaaaacaagtgcgtggggatggaagaattgggactcgttgataccaaagaagaggagtgttcggtgggtactgggacggcgaaggtggaagatgaagagagccctctgatggagatggatatgggaagagatgatcaatcatttgagttgagctctgattatgagacgtgcgaagaggtcaaggagatgaaggttagtgatttggaattggggaatgagttaggagagatgaaagagaatgatgatgatgaggtgaaaaggaagaaggtatcgttgcagcttgattatgaggcgataatcatcgcctgggctagccaaaagtctccgtggaccactgctgacaaacaaaacttggaccctgatgagtgctggcaccaatgcatgggaagttgcggaacggcatttcatcacccttacggtgaactgggtggatttgggattcattcagtgatagtagacgggggcagagaggcaagggtgtcaagatacagagagaagcgccgaactaggttgttctcgaagaaaataaggtacgaggttaggaaattgaatgcagagaagagacccagaatgaaggggaggtttgtcaagagggcttcctttgcaccaccaacatttcctttgctaaataaataagaccactaatgttttgttagtatttagtatttgcgacgtcatatggcttttcatttcattttcttatttctttgtatataacaattttttaagctaataaatcgtccaaatttataa

SEQ ID NO: 1591 - DNA, 539 bp, Glycine max
aaaaaactaaggtttctacctttctacgatgagagacatgaaagacgcaggtgccttgggaggcaagacagcaagagcctgcgacagctgcgtaagcagaagagcaaggtggttctgtgcagctgatgatgctttcctctgccatggctgcgacactttggttcattccgcgaaccagttagcaagcaggcacgaaagggttcggcttcaaactgcttcctcaaaagtaaccaccacgcacgcatggcacagtggattcacacgcaaggcaagaaccccgcgtcacaacagcaagcactttgcgctgcaacagcgtctcaaagacgaagttctcttcaacaagaaccggtggttgtggataacgatgagacggaggagcagatgctgtgtcgggtgcccgtgttcgacccttttgatgtgagaaccgatgacttggatagtttttctgacatggatttcgctgagtttgctgctgatgttgaaagcctacttgataaagaagacgatgaaataagtgcgtgtgtggagggggagagaga

SEQ ID NO: 1592 - DNA, 1381 bp, Oryza sativa
ccctcacttagggaataagcttgggccgccgtgtcctgctgcagggaggccgcccccggcgagaacccgacgaagccgtccatgacgacgacgacggctacaacgccaccgctccagttctgccccgacggccacgccaatttcggcccgaccgacgccgagctgagggagttcgccgccgacatggaggccctcctcgggcgtggcctggacgacggcaacgacgaggactccttctgcatggagacgctggggctcatcgagccggtggacgacgacgccgggcgggtcaaggtggaggccgacggcgacgccgggatgaccctagcgtggtgccacgagctggacacggagacgtcgtccggcgagatgctggacatcgacttcgactacggctcacctcaggcggcgacgacacccgacgagaaggtcgggagcagcgggcccgccgccgccgccgacgacgacgcccagttccagcagagcagcctcgccctcagcctcaactacgaggccatcatcgagagctgggggacctcgccgtggaccgacggcgagcggccgcgcgtcaagctcgacgactcctggccccgcgactactcgggggtgtggatggcggcggcaggggtgttcgggcacggcggcgaggagcaggcgctgacgccgaggctggggatggacggcggcagggaggcgcgggtgtcgcggtacagggagaagcggcggacgcggctcttctccaagaagatccggtacgaggtgcgcaagctcaacgccgagaagcggccgcggatgaagggccgcttcgtcaagcgcgccgccgccgccgccgccgtcgccacggcgtgcgtcgcgtaagcgctgcatggcggaagtttgatctgccggccgcgcgctcgccatgaaatcacacaagaacaaaacaactcgtcgaaactgcattagttttagctggtttctttcacggtcacaaatgcgtcttctttttccatcagttcgccattgatggttgctaaggatccaaggacttttaataataattattactataataataatgataatactaataagtgaattgtactatttgttgagaggtatacagtacccctgcgctcaattgctgaaagttttgaaagtttttttccccccttcagattcagggggttggttgacagtagtagcctgtagctgtgctatatgtatgcatatatgtccattggttgtcatgcacgggtacagttcgaggccaggagatatacatgtaaatcaatcaatcaatatatacaactaattgattcagtgatgaaaaaaaacctgcagcccggggatccaaaaaaaaaaaaaaaaaaaaaaaaaaagggggaggcctgcagcccgg

SEQ ID NO: 1593 - protein, 421 aa, Oryza sativa
MASAAAATGAALGARTARACDGCMRRRARWHCPADDAFLCQACDASVHSANPLARRHHRVRLPSASSSPASSPRSAAAPRAGSDDPDAPAWLHGLKRRPRTPRTKPGGGGKHDASAATVAAAAASAVPDLEAEESGIVGDTDHDVGEEDDEDLLYRVPVFDPMLAELYNPVAADDEEQQIEQKPAARVVPFSEPSPEFASGSVEADGLSGFDVPDMELASFAADMESLLMGVDEGFDDLGFLDDEKPHVKLDLDMDMDFASISPAPAPEREERKRKRPEMILKLDYEGVIDSWARDGASPWFHGERPRFDPSESWPDFPAGSRGGLGAAVTAVTGGEREARVSRYREKRRTRLFAKKIRYEVRKLNAEKRPRMKGRFVKRAAALPPLPLPRHQHPPPPPPRALPPVPMMLAPRGAHGRYRF

SEQ ID NO: 1594 - DNA, 641 bp, Oryza sativa
cccgggctgcaggaattcggcacgaggcctcgtgccgaattcggcacgagggaggccctcctcgggcgtggcctggacgacggcgacgacgaggactccttctgcatggagacgctggggctcatcgagccggtggacgacgacgccgggcgggtcaaggtggaggccgacggcgacgccgggatgaccctagcgtggtgccacgagctggacacggagacgtcgtccggcgagatgctggacatcgacttcgactacggctcacctcaggcggcgacgacacccgacgagaaggtcgggagcagcgggcccgccgccgccgccgacgacgacgcccagttccagcagagcagcctcgccctcagcctcaactacgaggccatcatcgagagctgggggacctcgccgtggaccgacggcgagcggccgcgcgtcaagctcgacgactcctggccccgcgactactcgggggtgtggatggcggcggcaggggtgttcgggcacggcggcgaggagcaggcgctgacgccgaggctggggatggacggcggcagggaggcgcgggtgtcgcggtacagggagaagcggcggacgcggctcttctcccagaagatccggtacgaggtgcgcaagctcaacgc

SEQ ID NO: 1595 - DNA, 455 bp, Oryza sativa
gcacggaggattttttttttgttaaccgcgaaaagtgttgtgttgtttgggtaggcagtgtgtgcgacggaatggcgagcgccgccgcggcgacgggcgcggcgctgggggcgcgcacggcgcgggcgtgcgacgggtgcatgcggcggcgggcgcggtggcactgccccgcggacgacgcgttcctgtgccaggcgtgcgacgcgtccgtggactcggcgaacccgctggcgcggcggcaccaccgcgtgcgcctcccgtcggcgtcctcctcgccggcatcctcccctcgctcggcggtcgctccacgtgccggatcagacgaccccgacgcgccggcgtggctgcatgggctcaagcggcggccgcgcacgccccggaccaagcccgggggaggcggcaagcacgacgcctccgccgcgacggtggccgcggcggcggcgtcggcggtcccg

SEQ ID NO: 1596 - DNA, 543 bp, Oryza sativa
gctgcagctcggagaaggcggccggggccgtgggcggcaaggcggcgcgcgcgtgcgacagctgcctgcggcggcgggcgcggtggtactgcgcggcggatgacgccttcctgtgccaggggtgcgacacgtcggtgcactcggccaacccgctcgccaggcggcacgagcgcctgcgcctgcgcgtctcgtcgcccccgccggtgacggcgcgggcgtcggtggaggaggaggcggcggcggcggtggggacgacgacgacgacgacgtcgaagagagagggcggcgtctcgccggcatggtcgaagcgcaaggcgcgcacccggcgcccgcaggtcaagagcgtcgggcagctgctctcgaggcggctcgtcgtgccggagatggcggtggagtcgtcggacgaacggaaggccgacgaagacggagctcacgaggagctcgaggggcagttgctgtaccgcgttccggtctttgacccctccctcaccgagttctgctcgccgcccgcgatcgatgacgcggcggccgcatcctcatcgt

SEQ ID NO: 1597 - DNA, 543 bp, Zea mays
  misc_feature (188)..(188): n is a, c, g, or t
cgcttctcggcgttgagcttgcgcacctcgtaccggatcttcttggcgaacagtcgcgtccgccgcttctccctgtatcgcgacacccgcgcctcacgctcgccaccggtcaccggtgtcacggctccgccgaggagttcccggtctcccgtctgcatgcatgcgatccatggcaaaaggaaagccgntcagttatttatcccaagacagtgccagagcatgtgtagatctcatgctcgaaccgtagtgcttaccgtgaagtcgtccgaccatagctcgtgacagtcgaggtgaggacgctcgccgtggaaccacggcgagccgccgtcacggacccatgaggcgatgacgccttcgttgttgagcttgagtatcatctccggccgcttccgtttcttgtcctctggttcaggcgccggcgctactatggcgtccaagtccgcgttcacctgaggtttctcttcgtcccagaaacccaaacagtcaaacccgtcgtcgtcgactcccatgaggaggctctccatgtccgcggtgaagctagcg

SEQ ID NO: 1598 - DNA, 649 bp, Zea mays
  misc_feature (640)..(640): n is a, c, g, or t
ctccgcgttgagcttccggacctcgtaccttatcttcttggcgaacagcctcgtccgccgcttctcccggtaccgtgtcacccgcgcctctcgcccgccgcccatccccagccgtggagtcaccgccgcctccccacccaaccgtcctcctcccgccatccagccctgcacgcaaaccttgcatgaacccgattgtactttgcaagtcgaagcataattaagcacgcgtcgacactcgacagcgctcgcgatcgatcgatcgaggacgaggagcagcgtgaatttgaaaataaacgtaccgtgaggtgggcgtggggccagaaatcatcgagctggacgcttggccgttggccatcggtccacggcgagcttccccagctctcgatgatggcctcgtagttgagactgagatccaggctcctcttcaagaattgcgtacccgcggcggcggcggcgttgctcgccgacgccttctgttcggaactgtcctcatcctcgttatccatcatcaccgtgggcgagcagcagttgaagtctgtgtccagcacctcagcagcagctgacgacgcctctggcttcatctccgtagggccaaatccgggagcgccctcgccgcgggagcgggagcgtacgatgccgntgggctcca

SEQ ID NO: 1599 - DNA, 786 bp, Zea mays
  misc_feature (699)..(699): n is a, c, g, or t
cattgggtacctcgaggccggccggggtagcaagatcgttgcacaccgctcggaagagaaatgattgccacgaccggcggcagctcggcgaaggcggcggcggtgggcggcaaggcggcgcgcgcctgtgacgggtgcctgcggcggcgggcgaggtggtactgcgcggcggacgacgcgttcctgtgccaagggtgcgacacgtcggtgcactcggcgaacccgctcgcgcggcggcacgagcggctgcgcctgtgcccggcgtctccgctgcagacgccgccagctcgctcggcggcggcagcgacggcgactaataagcgcgagcgccacgacgaggtggcggtgcccgcgtggttcgggcgcaaggcgcgaaccccgcgcggcgggcacgccaaaagcgtcggccaggtggcgttgtcgcggcgcctcgtcgtaccgcatgcggctggcggggactcagactcacccgatgagcgaaacggcggcgaggaggagcagctgctctaccgcgtgcccatccttgaccccgccctagccgagttctgctcgcccccgcctctcgaggaccccgcgaagccggatcctgcggcgccgctggcccagttctgccccgtcggcggccatttcaacttcggcccgaccgacgccgagctcagggagttcgccgcggacatggaagccctcctcgggcacggnctggacgacggaaacgaggaggaatcgtcgttttacatggagacgctgggcctcctcgaccaatggaagtgggcgacgatgccacgc

SEQ ID NO: 1600 - DNA, 810 bp, Zea mays
  misc_feature (766)..(766): n is a, c, g, or t
aaagtacacttgggcacttggcatcgcggccgaggtccccgaaaaagagccgtgctgggccctaatccagacgtgatattttctcgcgattttgtcacgttagcggccagctacatcctgacgatcctgtcacccgctcgatcggcgggcgctggagcgcgcgcatctagctttgtgcaagtttcacgggatctctagctttgtcggcggcacatgagcagctccaagcacgccgcgggcgccgtaggcggcaaggccgcgcgcgcctgcgacagctgcctgcggcggcgcgcgcggtggtactgcgctgccgacgacgccttcctgtgccagggctgcgacgcctcggtgcactcggcgaacccgctcgccaggcggcacgagcgcctgcgcctgcgcccgacggacccgcactcgacgacgctcgaggccggcgtggcgacgacgacgtggaagaagcgccagcagcaggtcgcgccggcgtggtccaagcgcaaggcgcgcactcggaggccgcacgtcaagagcgtcggggagctcctgtcgaggaagctcgtcgtcgtgcctgaggtgtcccccatcgaatcgtcggaggagcggaaggccgaggaggagggggaagaggaggaggggcagctgctgtactgcgtgccgacctttgaccgcgccctggccgagctctgctcgccaccgcctccggtcgatgacccgacggcctcatcctgctgcagggatgacgtcgacggcgccgtggagaacaacacanaggcaccaccggtcgtggttgcgggatcgcccgtgcagcagctt

SEQ ID NO: 1601 - DNA, 1494 bp, Zea mays
ccggccggccacctgttcccgttttttttgttaagctctcgcttaacctaaacgccgggagcacaagtgctcggcgaaatgacgagcgccggggcggcgacaggcgccgcgctaggcgcgcggacggcgcggtcctgcgacggctgcatgaggcggcgggcgcggtggcactgccccgccgacgacgccttcttgtgccagacctgcgacgtctccgtgcactcggcgaacccgctcgcgcgccgccaccaccgcgtccgcctcccctctgcgtcctgctcctccccaccgcgcgacccggacgcgccaacgtggctccacggcctcaagcgacggccacgcacgccgcggtccaagccaggggggagcaagagcaacaagcatgaggcgactcccagctttatcgccgcggctgcgtcgtcggcagcggtccccgacctcgaggcggaggagtccggctccggtatcctgggcggtaacgacgaccaccacgggttcctgcaggatgacgacgaagaccttctgtaccgcgtgccggtgttcgaccctatgctcgccgagttctacaaccccgtggccgacgagggggagcagaagccggcctgcagcctgctgatgccgtctctcgcggaaacatcgccggagttcgcctccggcggctcggcggaggcggacgggctctccgtgtcgttccacgtcccggacatggagctcgctagcttcgccgcggacatggagagcctcctcatgggagtcgacgacgacgggtttgactgtttgggtttcttggacgaagagaaacctcaggtgaacgcggacttggacgccatagtagcgccggcgcctgaaccagaggacaagaaacggaagcggccggagatgatactcaagctcaactacgaaggcgtcatcgcctcatgggtccgtgacggcggctcgccgtggttccacggcgagcgtcctcacctcgactgtcacgagctatggtcggacgacttcacgacgggtagccgggaactcctcggcggagccgtgacaccggtgaccggtggcgagcgtgaggcgcgggtgtcgcgatacagggagaagcggcggacgcgactgttcgccaagaagatccggtacgaggtgcgcaagctcaacgccgagaaacggccgcggatgaagggccggttcgtgaagcgcaccacgctcccgccgctgccgaggccgcccccgccgtcacagcagcaacagaagaagaagcaactgccacgctcattgccacacgtgggcatggtgctcgcgccacctccaggagcggacgggcgcttccggttttgagtctttgagatcacgcacgcaagcacggaaggctcggtatcaggacatcaggtgcacaacggagggatagtgcacaaatgcacaaacttgatcctgcccttccatctcccaatgaacggtcaccgccaaaattgcaagatggcccctccgcacctcctcctcctttaaaaa

SEQ ID NO: 1602 - DNA, 1140 bp, Zea mays
ccacgcgtccgcggacgcgtgggcgacgacgaggaccttctgtactgcgtgccggtgttcgaccctatgctcgccgagttctacaaccccgtggccgacgagggggagcagaagccggcctgcctgatgctgcctctcgtggaaacatcgccggagttcgcctccggcggcttggcagaggcggacgggctctccggcttcgacgtcccggacatggatctcgcgggcgcgtgggcggacatggagagcctcctcatgggagtcgacgacgggtttgacgatctgggtttcttggacgaacagaagcctcaggtgaacgcggacgtggacttggaggccatggcggcgccggagcctgaacgagaggacaagaaaaggaagcgggacggctttgattatctgggtttcttggacgaagagaagccacaggtgaacgcggacgtagacttggaggccatggtggcgccggagcctgaacgagaggacaagaaaaggaagcgaacagatatgatactcaagctgaactacgagggcgtcatcgcctcgtgggttcgtgacggcggatcaccgtggtaccacggcgagcgtcctcacctcgacgatccttacgagctatggttggagttcccggcaacggggagccggggacttttcggcggcaccatgacagcggtgaccggcggcgagcgtgaggcacgggtgtcccggtacagggagaagcggcggaggcggctgttcgccaagaagatccggtacgaggtgcgcaagctcaacgccgagaaacggccgcggatgaagggccggttcgtgaagcgcaccacgctcccgccgctgccgaggccgccgccgccgtcacagcagcaacagaagaagaaacaactgccacgcgcattgccacacgtgggcatggtgctcgcgccacctccaggagcggacgggcgcttccggttttgaatctttgagatcacgcacggaagcatggaaggctcggtatcaggtgcacaacggagggatagtgcacaaatgcacaaacttgatcctggccttccatctcccaatgaacggtcaccgtcaaaattgcaagaaggcccctccgcacctcctcctcctttaaaaaaaaaaaaaaaaaaaaaaaaaaag

SEQ ID NO: 1603 - DNA, 527 bp, Glycine max
caacttcctcggtgtctcatggttcaggtagtgttgtggaagcagaggtttcggtttcgtacagaggggttcgaaggaggccctgggggaagtttgcggcggagataagggactctacgaggaacggagtgagggtttggttgggaaccttcgacactgccgaggctgctgcgttggcttacgaccaggccgcgctggtcatgagagggtccatggcagtgttgaacttcccagctgagattgttcgccaatcgcttcggaacatggagcagtacggtagtttccaagaaggctcttctccagttctggagttgaagaagaggcactccatgaagagaaaatcagagaccaagaagcaccaactccacgatgtgatggtgttggaggacttaggggcagagtatttggaacaccttcttactctctcccaggatatggatatggatgcttgttagttaagttacatttacctccttcgtcaaaccttgcctttcccatccccaccactttcttttctctctctatca

SEQ ID NO: 1604 - DNA, 593 bp, Glycine max
  misc_feature (6)..(7): n is a, c, g, or t
  misc_feature (15)..(16): n is a, c, g, or t
  misc_feature (33)..(34): n is a, c, g, or t
  misc_feature (41)..(43): n is a, c, g, or t
  misc_feature (46)..(49): n is a, c, g, or t
  misc_feature (90)..(92): n is a, c, g, or t
  misc_feature (457)..(458): n is a, c, g, or t
  misc_feature (464)..(465): n is a, c, g, or t
  misc_feature (493)..(493): n is a, c, g, or t
  misc_feature (590)..(591): n is a, c, g, or t
aaccgnngagagganngcatcatacatacgcanngacgatnnncgnnnnaaatgatctttttttttcacagcaatatactaatcaaagcnnntaaccaatattgagtcccctttctttcagcatgcagattggggcatgttgaaggagcctaattcggatattttgtttgaatcattttcaagcaaaggagttgatcatgaccctttccatgattgtctttcctttgatatgattgataactcaagggatccacaggaagaaagtcatcatcaagtgattgaagaagctatgaaaacaaagaagaagtcttatattggggtaagaagaaggccatggggaagatttgcagcggagatcagagacacaacaaggaagggtataagggtttggcttggaacgtttgatagtgctgaggaagctgcattggcttatgaccaggctgcattttccatgagnngctctnntgcagtgctgaattttccggtcaaaagngtcaaagagtctttacaagagatgaactattctggttgcagccgaaggtgctctcctgcattagaactcaaagagaggcacaacataagaagaaaanngt

SEQ ID NO: 1605 - DNA, 514 bp, Glycine max
aactctgtttactcatctggtgttagaatggatagttcctctcatcagctcctccccttcaacgaaaacgacccagaagacatgcttctctatggcatcatcacttcatgccaagaaaaaaaagtgaccatcaaccaagagcaagtgaataagaagaggagcagcttccgcggcgtgcggaggcggccgtgggggaagttcgcggcggagataagagactccacgcggcatggcgtgagggtgtggcttgggacattcgacaacgccgaggccgccgcgctggcgtatgaccaagccgcattctccatgaggggctccggcgcggtgctcaacttccccgtggagaaggtgaaggagtctcttagagacatgaagcttgatggatgctctcccgttgtggccttgaagaggagacactccttggctgctaagaggaagaaggaagatgtccttgttttccatgaccttggggctgattatttggaacacttggtgatgtgctctgatctaccta

SEQ ID NO: 1606 - DNA, 989 bp, Glycine max
ccagcgtccgcccccacccgtccgtaaaaaacagagcaactactcaattcttcactctgtttccccttaccttacacactctaacacatggattcaccttcctccttcttcaactcaccctcttccggtttctgctccgaatcttcctctccggaagccttctcgtgggaagggtacctacccttcaacgagaacgacccggaggagatgcttctatacggcatgatcgccggcgcgacaaccgaggagcactccggcgagagggcgagctcggaggagagtgctgcagcacggaaggagaagtcgtaccgcggcgtacggcggcggccgtgggggaagttcgcggcggagataagggactccacgcgccacgggatgagggtgtggctggggacattcgacagcgccgaagccgcggctctggcttacgaccaagccgcgttctccatgcgcggctcggcggcgattctcaacttccccgcggagatcgttagagagtcgcttaaagagatgaactacgctcatgatgattccaacaacgaagaagggtgctcccctgttgtcgctctcaagaggaaacactctttgagaaggaaaattaacgtcaggaagaagaagaacaacaataacaatagcaaactacaaagtagtaccgtagacaatgctgtcgtgtttgaagaccttggtcctgattacttggaacagctgttgatgtcctctgatcatcatattcccaccaccttctgattcatttattcctcaattgcaattcagatctcaaaaaccttataaatatccattgcatagtttctacctagggtttttgtgttagtagtgttaattccttcttcttctttgttcttttgtttttgtaaggctaaaatgcttaggtcatgtttggatgacagatttgaacttcttttcagttcttatctttttttctttgtttttgtttttgttttcctactctgggagaattttcttcttta

SEQ ID NO: 1607 - DNA, 430 bp, Oryza sativa
aaaagtcaatccacgccaccatcgatctctctatccaatccaagcgcgcaaatcaatggcagagcatttcagccacgccggcatgtacatcggctacacggcagacgccgccgcgtcctcctcctcctcctcctcgtcttcgtcgtcttcctcctcggagatgcttcggttcgacacgggctggcccgacgagacacctgcgccatcctccgtggcggggaggaggaggagcgcgggcggtgatcatcgtcaaggtcggggacagacggaggcggcggcggcgttcatcggggtgcggaggcggccgtggggcaggttcgcggcggagatccgggactcgacgcggaacggcgcgcgggtgtggatcggcacgttcgacagcgccgaggccgccgcgatggcctacgaccaggccgcgctctcgcgcgtg

SEQ ID NO: 1608 - DNA, 1235 bp, Glycine max
gtcttgacggtcccattttcaccccattgtgcaaattgaaagtagtagggaacccctactatagctactacatcatcacaatgacgtcaccttaacgtctctcgtgttgacacgtagctcagtgaggctatttcgctgcatcctccaagaaggtgtttggaaggatccttcccaccccatgccaaaagcaagcatattaattaaaaaaaatagaaaaaaataaaacacaattttattttattataggatatttattagttatttattggatataagtggcagcatgctttagtcctaggcgtgataaaaggccaaagactcttaggtttttggctctttgcagaatctttgagtgacacatacctagctatcacctcaatggattactattttggaaaccttaatcctaacccttattaccatcactctgccgtagtgaacatggcatctccctcctccgagttcatgttatctgattatctcgtgttggaagatgctcttgttgttgatcatcatcaagagtcttggtcacaaagcactgaaactgaatcatcggagaaagcaacctccagcgatgcaagtcatgggttcggtgatgcaacctccaccaacaccaacatgcatataaagtgccaaaatagtgggattaagggaaagaatgcagaagtgagtcaaaggatcacgtttagaaccagatcgcaacttgaggttatggatgatggatataaatggaggaaatacgggaagaaaacagtgaagagcagtcccaacccacggaactactacaagtgttcaggtgaaggatgcgatgtgaagaaaagggtggaaagggatagggatgactccaactatgtgttaacaacgtacgacggtgtccacaatcatcagaccccgtctactgcctactacagccaaatgcccttgctgcattctaatcatgattgggccctccacccttctgcaaactcataatatcctccttaatatagtaatatccagagataggagaatcaacttatacttttaggattactttttatctttattatttattttttataagagattttaaaaaataaataatgagaatagagaataattttaaaagaattattgttgatgtaagttaatctctactctgtatatatatatagttattgactcatttagtatattgcctgtcaataaccattattacatgtatattgattattatgcaggttcccctccacgct

SEQ ID NO: 1609 - DNA, 974 bp, Glycine max
tttttaggaggcaaaacttttattattaaacagagtacaagagagatactctaatcctaatacaagatacttacttttaagatttgaacaactttacacatggagaatcatgttccttgttacatgaactagcaaaggctgatttttaattgagagatatattaaacgtggaaccaaaaaaaggtatagaaactctcttcaacctattacagcatgaaaataaattatgattgattagacaatgcaatgatacatagcttcccctgctcgatcgaatcttccaagctttttcttggcacataattaagctagggaggtgtaaatgcccaaaagggtttgaagttggtgtcatttgaaagtagtatcagaatgtacgaaggagatggggctgtagtatgtggtaaatgggctctcatgattgtgcacaccttcatatgttgttatcacgtagctgtagtcatctctatccctttccacccttttcttcacactgcatcctccacttgaacatttgtagtagttccttagattgggactgctcttcacggacttcttgccgtacttcctccacttgtatccatcatccatgatctcaagctctgatttggttctaaacgcgatccttggacccactccacctttgttttcattaatcccatttttgcagtttatgttattattcttagaggttgcaccagtactgaatccgtgagtggcatcattgaaggttgctttttcagatgactcggtgctttgtgatgatcgagaatcttgatgatcaacatagtcatcgagcatgagataatcggatagtgcaatctcaggggaagatagagccatattaagagaattatgagcataattattgggataaggaggagagtttccaaagtagaagtccattgctgataactaaatatggtagtaaatgaaaacaaagactatggtgcgtagagcaacgagcagaattctga

SEQ ID NO: 1610 - protein, 243 aa, Oryza sativa
MAAAAAGASTPFNFCRHGSHAEYDAVFSGSWMARRPSAAPHGGGASGSGSGSGYGAASYVAPTFGAAFRQQHLDLLDYLSDDQGVPAPPPAAVPSASYVTPAPAMAPAEPVVPDAVAAAGGYPRSVAAAAAAVAGEGRDRTTTDKIAFRTRSDDEILDDGYKWRKYGKKSVKNSPNPRNYYRCSTEGCNVKKRVERDKNDPRYVVTMYEGIHNHVCPGTVYYAAQDAASGRFFVAGISHPDLN

SEQ ID NO: 1611 - protein, 221 aa, Oryza sativa
MAAVGAHAAVYHHPVSGLSAPAGDAAYSMSSYFSHGGSSTSSSASSFSAALAAATTPPLPDPSGSQFDISEFFFDDAPPAAVFNGAPTAALPDGAAANATRSAAEAVPAPAPAAVERPRTERIAFRTKSEIEILDDGYKWRKYGKKSVKNSPNPRNYYRCSTEGCNVKKRVERDKDDPSYVVTTYEGTHNHVSPSTVYYASQDAASGRFFVAGTQPPGSLN

SEQ ID NO: 1612 - DNA, 743 bp, Zea mays
agatcgagatcctggacgacggctacaagtggaggaagtacggcaagaagtccgtcaagaacagccccaacccaaggaactactaccggtgctcgacggaagggtgcaacgtgaagaagcgggtggagcgggacaaggacgaccccagctacgtggtgacgacgtacgaggggatgcacaaccacgtcagccccagtacggtgtactacgccagccaggacgccgcctccggccgcttcttcgtcgccggcacgcagccgccgggctccctcaactgatccccggcggcccatcgcgacgtacggtccgctccaccgcaccaatctggtttcgactcccagatggcagctagctagtcggcggtatacactagtagtagtaggataggccggccgacacccccgataggtgatcggctggtgggtcggtttcccgaggtggatttctcgtttgggtttctagcacacccctccgctcctccctcttttccccgtccttttcctgctccgatcatggaaagggccggcggctggctggctggctggctgttgcgatcgaatagtatgtagtggtggtggtgctgctgttcatgctgggttccaagagaggtttaatttcccattgccttgagctcagctaaattattagtccgggacggaaatgtagcatatactgcattgaccgtgtaataagatgtacagaagctgtcccaacgttggacacaagatacttagattatatct

SEQ ID NO: 1613 - DNA, 680 bp, Zea mays
ggccgcggacgacgcggatcgcgttccggacgaggtcggagatcgagatcctggacgacggctacaagtggaggaagtacggcaagaagtccgtcaagaacagccccaacccaaggaactactaccggtgctcgacggaagggtgcaacgtgaagaagcgggtggagcgggacaaggacgaccccagctacgtggtgacgacgtacgaggggatgcacaaccacgtcagccccagtacggtgtactacgccagccaggacgccgcctccggccgcttcttcgtcgccggcacgcagccaccgggctccctcaactgatccccggcggcccatcgcgacgtacggtccgctccaccctaccaccgcacctatctggtttcgactcccagatggcaggctggcagctagctagtcggcggtatacactagtaagtagtagtaggataggccggccgacacccgatcggtgatcggctggggggttcggttccccgaggttggatttctcgtttgggtttctagcacacccctccgctcctccctcttttccccgtccttttcctgctccgatcatggaaagggccggcggctggctggctggctggctgttgcgatcgaatagtatgtagtggtggtggtgctgctgttcatgctgggttccaagagaggtttaatttccca

SEQ ID NO: 1614 - DNA, 823 bp, Zea mays
  misc_feature (9)..(9): n is a, c, g, or t
  misc_feature (802)..(802): n is a, c, g, or t
ccggccggngatattcaggcaggcgcattgactggtacgcatacaactacaagcaaggcggctagctacagcggctagtgcgcgcgtggtgcaggcgcagctagctagtgcgtgcaatggcgacttcgctgggactgaaccctgaagatctcttcacttcgtactcgtcttcctactactcctcgccgccgttcatgtccgactacgcggcgagcttcacgccggcgggcggggactccacggccttctcctcggagctcgacaaccttcaccacttcgactactcaccggcgccgatcgtcactgctgccggagccggggctgggggcggcgatcgcaacgagaagatgatgtggtgtcagggtggtggtgacgagagaagactcagaagcaacggaaggatcgggttcagaacgaggtcacaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccgcagccgctgctatcatcgtcccgtacggcaacggcggcggcaatagcggcttctacagcccgccgcacagcggctccccgtcggccacctcctactcgggctccctagtcttctgacttttccgggccttgacccatagttacctttacaccccagtcgtcggatgagaagaatcttcagcggncggctaaacagtctcaactgc

SEQ ID NO: 1615 - DNA, 834 bp, Zea mays
cattgggtacctcgaggccggccgggaagttacttgcagctggccatgcacatggcgctatcgtcccgcagctcattcgccgccgacgtcctcctcccagccaccatgtcgtatcgtcagccgtgcagcggtgcttccagctacttgggctctcagcccgcggcccctttcccgtcggcagcgttcggcgcggtggcgcagctggacgtcttcgactgcctgtcgtcggacgaaggcgttggcgtcccggcagctgtacctggtgcgttcgcgccgccgccgccgcttatgccggccgagcgcgtcgtcccggacgctgctgcaggctacagtagtcatactaggagtgcagcggctgtggcgggtgaggggtcgaggactacgcacagaattgcgttccgagtgaggtcggacgaggacgaggtactcgacgacggctacaaatggaggaagtacggaaagaagtccgtcaagaacagccctaatccgaggaactactaccggtgctcgacggagggctgcaacgtcaagaaaagggtggagcgagacagggacgacccgagatacgttgtgaccatgtacgagggagtgcacaaccatgtgagtcctggtaccgtctattacgccacccacgacgccgcctccggccgcttcttcgtcgccgggatgcatcagccaggccattgatcaacgagcagatcagagagcgtcttaattagtgtaagatatgtataccgactatctgttttaggccttgttcatgttttaggtcttgtccagttattccaaatcatatagattggaatgtattgaaatgaattgagatagatttag

SEQ ID NO: 1616 - DNA, 825 bp, Oryza sativa
agtggatcccccgggctggaggaaaattcaccggtgaaaaggttcagcactgtgcaatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctatttcggcaggcggcttcgctgctcttctgagggctgatgaagtttgtctaggactagacacgcccgggagctctagctaggatagaaaactagagaaagtttaattatacctgaattttaattaatcacctcacaaaactctgatgtatcatattatatcgtgatagtgactggttgttaatttaattttggcgatcgatgtgatcttcggt

SEQ ID NO: 1617 - protein, 194 aa, Oryza sativa
MAASVGLNPEAFFFSNSYSYSSSPFMASYTPEFSAAAIDANLFSGELDFDCSLPAPAQEYPENENTMMRYESEEKMRARVNGRIGFRTRSEVEILDDGFKWRKYGKKAVKNSPNPRNYYRCSTEGCNVKKRVERDREDHRYVITTYDGVHNHASPAAAAAALQYAAAAGDYYSPPLSSAGSPPAAYSAGGSLLF

SEQ ID NO: 1618 - protein, 246 aa, Oryza sativa
MSSLYPSLLSLSESPAEYRQVGGGRYAGEDVVDDDDDMAAVADAVSSYLSFDMDDVEYYTPEVGFHSKQHNPPPVAAAPLEAGGGREQSRREAAVNLGKMDRGPAPVSGGAATGGVPRSKNGSKIAFKTRSEVDVLDDGYRWRKYGKKMVKNSPNPRNYYRCSSEGCRVKKRVERARDDARFVVTTYDGVHNHPAPLHLRPQLPPPGGYSIAGAPAVVAPHGRLGLEEAEVIALFRGTTATSLLLP

SEQ ID NO: 1619 - protein, 219 aa, Oryza sativa
MAASLGLCHETSYAYSYPASNTSSSLCFPPLMADHIVDGGGGGGCSFGEFLELGHSVYSLPLPPPPSQPVVVAGGNNDQYGVSSSSSAAATTSRIGFRTRSEVEVLDDGFKWRKYGKKAVKSSPNPRNYYRCSAAGCGVKKRVERDGDDPRYVVTTYDGVHNHATPGCVGGGGHLPYPTSAAPPWSVPAAAASPPPAHAQAWGAPLHAAAAAHSSESSF

SEQ ID NO: 1620 - DNA, 1696 bp, Zea mays
cggacggcacatcaacggacagacacacacaagcaaggcggctagcggtgcaagtagtgcgaagctagctaggtgctggtgcatgcaatggcggcttcgctgggtctgaaccctgaagctgtcttcacttcctacacctcctcgccgccgttcatgtcggactacgtggcggcgagcttcctgccgccggccgtcgtcgactccacggacttctctgcagagctcgatgatcttcaccaccacttggattactcatcgccggcgccgaccttggccggggctcggagcgatcgcagcgagaagcagatgatcaggtggtgtgagggtggtggtggcgagaagagactcggtaggatcgggttcagaacgagatcagaggtggagatcttggacgatggattcaaatggaggaagtatggcaagaaggctgtcaagagtagcccaaatccaaggaactactaccgctgctcgtcggagggctgcggcgtgaagaagcgggtggagagggaccgcgacgacccccgctacgtcatcaccacctacgacggcgtccacaaccacgcaagccccgcagccgccgccatcatccagtacggcggcggcggcggattctatagcccgccgcacagcggctcgccgtcggccgcctcctactcgggctccttcgtcctctgacttctccgggccttgacccagagtgatctgatctacctgctttatcccagtcgtaggatgagaagagtgttcagacttcagagacatcagttcagcggccggctaaattcggacctgattgtagatatttacacctcaattattggttacctcttgtgacgactgacgaggcatcataatcgtcactaggataattgatcacgcatgtttttcgcttaattagtttctgtgtatacatacgaagtttgccgtatagctgataggctgctgatttaacttgacttctctttgttcggtattagaccccaagatcaacatttacgctgaacagatgctttgtaacagtgaaggaatattttatggtttttccagatatatgccattatgaaaataaaaaaaaaaaaaaaaaaagcggccgcttggtttgtctctttgttggcattccttgcaacaaattattaattctccacggtacagaacgggacatcatcacaatgtcagtgcgcaaccataactgaactgcaacaatgaagaacaggtagcaaaccttatttcgagcaaacagtcagctcagcttagaaactaactaaaaagagcacggcactcattggcctcattagccatctcttccatgctcctatctttcctctcaatgtccaggtcaagcttctccttcaattctttctccttcacatcaatcgcatcatatatttcatcatttttctcaaaatcccctttcttccttgggatgaggtggatgtggacatgcgcaactgtttggccagcttgaggaccatcctggatagcaaaggtaagtgacgatgctttgtggtactgctcaagacgtgcaccaacttcctttgcagtaacccataagtcactaatctcatcagaacttagatcggcgaatcttttcacttcacgcttggggcacacaagaacatgtaggtattgtcaaggaaaaaccagtgcatatagaagaacacagtttcctaaaacatgatgtatcaaactttgagtc

SEQ ID NO: 1621 - DNA, 1663 bp, Zea mays
cattgggaccctcgaggccggccgggtctaattatatgataggtgtcaagtggaagtgcagtgatgtatgcagctgaggcatcctaacagaccccggccgacgggaaacaagaaagaaaaaatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccgggacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatcagaaataatgcgtggttttcgcgcccaaaattgggaaccccgaggccggccggggttattcaggcaggcgcattgactgatacacatatatacaacaagcaaggcggctagctacagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagccttctgacttttccgggccttgacccatagttacctttacactccagtcgtcggataagaagaatgttcagcggctggctaaacagtctcaactgctgcagctattcaaattagtgttggagatgcaatttatagagataaaatactctagaagctatcgctgtagccggattaaattctgacctacttgtatagttttacacttacacagtgcaagtaataatatttaagggaagcagagagcactctaggcggccgctcaaaaaaaaaaaaaaaaaaaaaaaaaaaaaaaaaaaaag

SEQ ID NO: 1622 - DNA, 999 bp, Zea mays
agagaaaggcagggtcggagcgctgcaggtgtttgggcgcccaactctttgggtttagctactgttcattcgtcttcctcctctcaccaatctgtgtcctgtgcttgtgagcgttttagagttccaacacattctagctacgtgacccgtacgtgcgtgtaataactgatggatgacggatcggatcagtacgacgactccgaggaatgagcaaccgccgccgcggcgtgcagctgcgcctcccaccacgcgtcacaggcggcgctccagctgggcgctgcagccagaggcgctggcgccgaggccgagcgtggaggcgagaagggcgttgcggtcgcggttgcgccgcgcggcggcggtggttggcacaggtaggaggcggcgcccgggcccggcgcggcgtggttgtggacgccgtcgtaggtggtgacgacgtagcgcgggtcgtcgctgtcccgctccacgcgcttcttcacgccggagccctccgtcgagcaccggtagtagttcctcgggttggggctgctcttgaccgccttcttgccgtacttgcgccacttgaagccatcgtccagcacgtccacctccgaccgcgtccggaacccgatccgtgacgacgacggcggccggccgccgccgttcccaccggtgccatatggtggtccgctcatcggcctcctcccgtcgccgtcgccgtccacgccgtagctcagcaggctcatgccattgccgacggcggcggtgacggcgtctgaagaactgttggcgaacaccggcgccgagcagtcatcggccaccatctcctggccggtgaacccgaactggaagtagtcatcggccatggtggcggcggcgggcggcgggaggtccgccacgaggtcgggtggtggtgggaagtacgaggaggcgggcgcgggcggcgggtagtaggcggcgtagctcgtctcgtgggcgagtcctagcgaggccgcctgagtaagtagacgcacgcgccggcag

SEQ ID NO: 1623 - DNA, 890 bp, Glycine max
  misc_feature (850)..(850): n is a, c, g, or t
actcctcctcctcctcctcctaccctttcattttcatttcccacatttctctctctctctctcctatacttcctctttacactccccatctctctcacttttcattttcatctccattttttttctctaaaactccaatttcccattttacccctcactgtcgatccccccccggccctcgctccgattcctaggaacagggttttcagttttcactgttccattaagtttccgagctcaattcagcttccgattcgccgcgcgcaaaacgacttcgtttttggattttggcgtcgcgtcctattcagaagctatatactataagatgagacgaatgaagaaagatattgaagatgaggtgcttcccaatgatatgagtggggcacagttgaatgatgagagttatgaaggaagtgctggcattgttctgaagaaggggccatggacatcaactgaagatgatattttggtggattatgtcaagaagcatggggaggggaactggaatgctgttcagaagcacaccgggctggttcggtgcggaaaaaggtgtcggctgcggtgggccaatcacctaaggccaaatttaaagaaagggggcgtttgccgcagaagaggagcggctgattgctgaacttcatgccaaaatgggaaacaaatgggcacgcatggcagctcatttgcctggtcggacagataatgagataaagaactactggaacacccggatcaaaaggcgtcaacgggctgggttgccactttatcctccagaagtgagtttgcatgctttgcaagagagtcagcatagccaaagcactggtggacttaaatggtggcgataaaatgcatnctggattcttgcagaaaaacagttatgagatacatgatgc

SEQ ID NO: 1624 - DNA, 2373 bp, Oryza sativa
ggaaaaatggggtgcccatgcggccctgcccaatagcgttgctgtacctttcagctttataatctcgcccctcgcgagagagactccccccatcctgcaggcgcgccccgctctcttgctcagctcctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccagttgagacgccatgtatcgggtgaagagcgagagcgactgcgagatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcaggtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatgtcagaattcaaatgaattctgtatttggtatttgccagacgctaaagcagattcttggtatcgttcttgctcattgtttggatcataacttgaggaagatctcgtcggttgtaattctgcattgctgacagagtccttgatggcatgcaggcactatcagatgttctcttatgcgactagcccttttgtccaataaagtagtgcatggagataagccggttaattattgttttcttttttgtattagagaaccctttttgtcatctctattgccggaattctgttggaaattcgtcatgtttgtttgaacaaaaaaaaaaaaaaaaaaaaa

SEQ ID NO: 1625 - protein, 141 aa, Oryza sativa
MYRVKSESDCDMIHQEQMDSPVADDGSSGGSPHRGGGPPLKKGPWTSAEDAILVDYVKKHGEGNWNAVQKNTGLFRCGKSCRLRWANHLRPNLKKGAFTAEEERLIIQLHSKMGNKWARMAAHLYLLKFIFVGFTPAWMRS

SEQ ID NO: 1626 - protein, 553 aa, Oryza sativa
MYRVKSESDCDMIHQEQMDSPVADDGSSGGSPHRGGGPPLKKGPWTSAEDAILVDYVKKHGEGNWNAVQKNTGLFRCGKSCRLRWANHLRPNLKKGAFTAEEERLIIQLHSKMGNKWARMAAHLPGRTDNEIKNYWNTRIKRCQRAGLPIYPTSVCNQSSNEDQQCSSDFDCGENLSNDLLNANGLYLPDFTCDNFIANSEALPYAPHLSAVSISNLLGQSFASKSCSFMDQVNQTGMLKQSDGVLPGLSDTINGVISSVDQFSNDSEKLKQAVGFDYLHEANSTSKIIAPFGGALNGSHAFLNGNFSASRPTSGPLKMELPSLQDTESDPNSWLKYTVAPALQPTELVDPYLQSPAATPSVKSECASPRNSGLLEELIHEAQTLRSGKNQQTSVISSSSSVGTPCNTTVLSPEFDMCQEYWEEQHPGPFLNDCAPFSGNSFTESTPPVSAASPDIFQLSKVSPAQSTSMGSGEQVMGPKYEPGDTSPHPENFRPDALFSGNTADPSVFNNAIAMLLGNDLSIDCRPVLGDGIMFNSSSWSNMPHACEMSEFK

SEQ ID NO: 1627 - DNA, 1970 bp, Zea mays
tagcgtggggcagggcgagggcgagggcgactgcgaaatgatgctgcaggaacagatggactcgctggtggccgacgacgtcagcagcggaggagggtcgcctgaagaaggggccatggacgtccgcggaggacgccatcctggtggactacgttaagaagaacggcgagggcaactggaacgcggtgcagaagaacaccgggctgttccgctgcggcaagagctgccgcctccggtgggcgaaccacctcaggcccaacctcaagaagggggccttcacccccgaggaggagcgcctcatcatccagctccacgccaagatggggaacaagtgggcgaggatggctggtcacttgccagggcgtactgacaatgagatcaagaactactggaacactcgaataaagagatgtcaacgagctagccttcctatttatcctgctagtgtatgcaatcaatctacaaatgaagatcagcaactgtctggtaattttaacggtggcgagaatatatccaatgatcttctatctgggaacagcctttatctgccagattttaccagtgacaatttcattgcgaacccagaggctttatcctatgcaccacagttgtcagctgtttcaataagcaatttgctcggccaaagctttgcatcaaaatgcggctcctgcatggatcaggttgaccaagcggggatgctgaaacaatctggctgtgtgcttcctgcattgagcgatgccattgacagtgtgctttcctcagctgatcatttttcaaatgactctgagaagctcaggcaggctttaggttttgattatctgaatgaagccaatgctagcagcaagagtattgcacctttcggggttgcacttactggcagccatgcctttttaaatggcaatttctctgcttctaggcccacaaatggtcctttgaagatggagctcccttcactccaagatactgaatctgatccaaatagctggctcaagtatactgtggctcctgcaatgcagcctactgaattagtagatccttacctgcagtctccatcagcgaccccttcagtgaaatctgagtgtgcatcgccgaggaacagtggtcttttggaagagctgcttcatgaagctcaggcactaagatctgggaagaaccaacaatcatcggtccgaagttcaagttcttctgctggcacaccttatgagactaccacggtggttagcccagagtttgatatgggtcaggaatattgggaagaacagcccagttctttcctcagtgaatatgctcattttagtggaaattctttcactgaatccactcctcctgttagtgctgcgtcacctgatatcttccagctctccaagatttctcctgcacaaagcccttcaatgggctctggcgagcaggcgttagagcctaaacatgagtcggcagcttcacctcgtcctgaaaacttgaggcctgatgcattattctctgggaacacagccgatccatccattttcaataatgccatagccatgctcctgggcaatggcattgatgccgagtacaaacctgttcttggtgatggaattgtgctcgattcttcgtcatggaacaacatgcaacatgcttttcagatggcgggattcaaatgagttccatgcacttgtttgtgatgctgaagggcttcttgttgcttgttttggggtcagtatcagcgaaggccgcattgattgtgacgctgcattcctgacagagggcgtgcaggtgcagcagctaccatatgtgatcttcatgctaatagtccttttgtctaataaagtgcatgaagataaaccggatatttttttttttgctttgtattagagaaccgtttttgtcaaccctgtcaggattctgttggaaatgtgtcatgatttttgtttgaacaatttaatatctgtcattggtactgtgctgtgtgccaaaaaaaaaaaaaaagg

SEQ ID NO: 1628 - DNA, 620 bp, Zea mays
  misc_feature (1)..(1): n is a, c, g, or t
naccgctggccggctcacagtaccagaggagtccaccggaggagctcagctagactcccaccctggtggctcgatcggcaccggccgctgcctgcgagactccgccagcgcgcgatgtaccgggtgaagagcgagggggagggcgagggcgagggcgactgcgaaatgatgctgcaggaacagatggactcgctggtggccgacgacgtcagcagcggaggagggtcgcctcacaggggcgtcggcacgcccctgaagaaggggccatggacgtccgcggaggacgccatcctggtggactacgttaagaagaacggcgagggcaactggaacgcggtgcagaagaacaccgggctgttccgctgcggcaagagctgccgcctccggtgggcgaaccacctcaggcccaacctcaagaagggggccttcacccccgaggaggagcgcctcatcatccagctccacgccaagatggggaacaagtgggcgaggttggctggtcacttgcccgggcgtactggccatgagatcaagaactacctggtacactcgtattaagagatgtcaacgagctagccttcctatttatcctgctagtgtatgcaatcaatctacaaatg

SEQ ID NO: 1629 - DNA, 1332 bp, Zea mays
atccagtctcccttcttgccccacgcagccgagcgtgcctacccctcctcgacccttctctggggccgccgttggacgctcatggagaggagtcgtccgggcgccgcgccgaaaccatcgccagaggaggaggtggcggcggagggccatgcgcatggtgacgatgtgacggggcaggaggaggaggaggaggcgacgccagtggtgctcaagaagggcccgtggacggcctcggaggatgccatgctcatggaccacgtccggcaccacggcgaggggaactggaacgcagtacagaggatgaccggcctgctgcgctgcggcaagagctgccgcctgcgctggaccaaccacctccgccccaacctcaagaagggctccttctcccccgacgaggagctcctcatcgcccagctccacgcgcagctcggcaacaagtgggcgcgcatggccgcgcactggttggcttggtgcgcgcccgcagctgcccgggaggacggacaacgagatcaagaactactggaacacgaggacctagcgccgccagcgcgccggcctgcccgtgtacccgccggaggtgcagctccacctcgccctctccaagcgctgccactacgacgactacgacttcccgccgctcgcgtcgtccccgcagctgtcggcgacgacgacgacgaccgatgtccaggcgctgggcgccgggcccgggtacgccagctcgcgcccggcgccgctcgacctggctcgcagccagctcgccgcgacgacgacccagcagacggcgcagttcctctcgccgccgcccttctcggcgccgtcgtccccgtgggccaagccgttcgcgcggaacgcgcagtacttccagctcgcgcactcgtcgcccgtgtccccgtcgacgccgaccgggccggtgcacccggccatgccggacctgtctctcggcggccacggcgcgcgcgccgccgccgctgccgaccagagcaggctcccaccgctctcgccgtcccccggccccagagtggagctcccttcaaaccaatacggccagccggcgccgccgacctcggccgccgccgtcgccgccggacttgcgctgccggatcatcagaacgcggcgagcctcgaacagatgctgcaggagctgcacgacgtcatcaaggtcgaaccgcaggcgctggtcccggccagcggcggcggcgctgcactggagcggcatgattgcggagtttcagtcccagagagcagaatcagcggcctgcagcgtcggggtgacgacatggacacgctgttcggcctggtgcacccagcgctcggcgcgccggagacggcgcc

SEQ ID NO: 1630 - DNA, 988 bp, Glycine max
cggctcgagcggctcgagctcgagccctcggcccggctcgctttatgcttgcacacaaaataatggacaaaaaaccatgcaactcatctcatgatcctgaagtgagaaagggaccatggaccatggaagaagacttgatcttgataaactatattgcaaatcacggtgaaggtgtttggaactctttagccaaagcttctggtcttaaacgaacgggaaagagttgtcgactccgttggctaaactaccttcgtcctgatgttagaagaggaaacattacacccgaggaacagcttttgatcatagaacttcatgcaaagtggggcaataggtggtccaaaattgcaaagcatcttccaggaagaactgacaatgagattaagaacttctggagaacaaggatccaaaagcacattaagcaagctgagacttcacaacaacatggtaattcagagaataatgatcatcaagcaagcactagtactagcaaagtgtccaccatggcacatccaaatgagactttctctccaccctcataccaaggaacttttgagccattccaacctcaattccctacaatcactgatcaatcaagttgttgtaccaccaccaacgacaacaacaactattggagcatcgaggatatctggtcgtctatgcaattactcaatggagattaaacctagctatatgcatgcctatataaatcatatatatgatgatatataaacctaagctcttgtagagtgtgttcaggcttaataacatcattaggtctgtttatatgagtagtctaagtttggtgtttgtaatgcatgatgtgagttaagaattaatttagttatggattgaaatatatagtaacttatatactacatgtgcattctcctattatcgtaaataatatggttgttgtaccatatattatcagtgacgggcatgctcgtattttagtaaatcggtataaataattgctttgtctcaaaaa

SEQ ID NO: 1631 - DNA, 968 bp, Glycine max
aattaggctccagtatctctctctctcccctcttccccacccaaccttctctctatcacacacacaagtcaatggataaaaaacaactgtgcaacacgtctcaagatcctgaagtgagaaaagggccttggacaatggaagaagacttgatcttgatcaactatattgcaaatcatggggaaggtgtttggaactctttggccaaagctgctggtctcaaacgtaccggaaagagttgccggctaaggtggctaaactacctccgtcctgatgttagaagagggaatattacacccgaggaacaacttttgatcatggagcttcacgcaaagtggggaaacaggtggtccaaaattgccaagcatctacctggaaggactgataatgagatcaagaactattggaggacaaggatccagaagcacatcaagcaagctgagaactttcagcaacagagtagtaataattctgagataaatgatccccaagcttgcactagccatgtgtccaccatggcgcagcccatggagacctattctccaccctgttatcaaggaatgttagagccattttcaactcagttccctacaattaatcctgatcaatccagttgttgtaccaatgacaacaacaacattaactattggagcatggaggatagctggtcaatgcaattactgaacggtgattaaatattatcaagataaaacctaagttctgaagttccataaggctggaatgtctctggattaaaacatattattgggtttgtttatataagtagttggatgtttggttttgcgtaccattattagctatgtgctgtaatatatacgagatcttatattaaactatatctgcatgctttatatatattttaaatgaggtgctatgtgcattgtagaagatacagttaagaaccacatagttcaaaacacttaatatattcccagtggcatgcttgctta

SEQ ID NO: 1632 - DNA, 969 bp, Glycine max
tggcaagagctgggggcttttttatgatcctgccctgttattcgggccaggacaatggaagaagacttaatcttgatcacctatattgccaatcacggggaaggggtttggaactctttggccaaggctgctggacttaaacgtaccggaaagagttgccggcttcggtagctaaactacctacgtcctgatgttagaagagggaatattacacccgaggaacagcttttgatcatggaacttcatgcaaagtggagcaacaggtggtccaaaattgccaagcatctacccggaaggactgataatgagattaagaactactggaggacaaggatccagaagcacctcaagcaagcttccagcagcttccagcaacagagtagtaattctgagataatttatcatccccaagcttgcactagccaagtgtccaccatggcgcagcccatagaaacctattctccacccagttatcaaggaatgttagatccattttcaattcagttcccaacaaatcctcatcattctagttgttgtaccaatgacgacgacaacaacaactattggagcatggaggatatctggtcaatgcaattagccaattactgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcagaagcagacacatgg

SEQ ID NO: 1633 - DNA, 418 bp, Oryza sativa
agcaaatccaccgccccctcacccgtctctgctctgctctgctctctgttcctcgcggcacgctagctattcgatggccaccaggatgtgcggccgcgccggcgagccggcggtgcgcaagggcccgtggacgctggaggaggacctcatcctcgtcagctacatctcgcaaaacggcgaaggatcctgggacaacctcgcgcgctctgccgggctgaaccggaacgggaagagctgcaggctgcggtggctcaactacctgaggcccggtgtgcggcggggcagcatcacgccggaggaggacatggtcatccgggagctccactcccggtgggggaacaggtggtccaagatcgccaagcacctccccggccgcaccgacaacgcgatcaagaactactggaagaccaagatacac

SEQ ID NO: 1634 - protein, 249 aa, Oryza sativa
MQYTVEGSGGGGVQTVEAAVRKGPWTMEEDLSLVNYIAANGEGAWNTLARAAGLNRTGKSCRLRWLNYLRPDVRRGNITPEEHTLIVELQARWGNRWSKIARYLPGRTDNEVKNFWRTKIQKKHRKSTDGIYATTTSESIMPAATVHQNTVAEDQGSSSVSGRTTTATVAVTQEYATEAPPPSGMSSGSYLDQLQPGYASSIHGGQDGGAAAAAAGDVVVSDEFLAASSDNFWALEDLWPTVQSLHGNC

SEQ ID NO: 1635 - protein, 228 aa, Oryza sativa
MATRMCGRAGEPAVRKGPWTLEEDLILVSYISQNGEGSWDNLARSAGLNRNGKSCRLRWLNYLRPGVRRGSITPEEDMVIRELHSRWGNRWSKIAKHLPGRTDNEIKNYWRTKIHRKPRGRSQLLQEPCEDAMGMGMSTTTSEAASTSASSGQSQASPGVWDEYMQASSFPHPELVSFAADHHLEMAGVGEVAAAAAAQFVPTEFGFNDGFWNFVDNFWETMPVSDVV

SEQ ID NO: 1636 - DNA, 777 bp, Zea mays
  misc_feature (11)..(11): n is a, c, g, or t
  misc_feature (687)..(687): n is a, c, g, or t
  misc_feature (753)..(753): n is a, c, g, or t
ctcggccgggngcagctccgcacagtgcccctggcacaggcgaggagcaggagcttctgaggtgtcgccgcgtagcagcaactgcagcttggggctcggaacgaacgagaagaaacaggcatggggaagggccgggcaccgtgctgcgccaaggtggggctcaacaagggctcctggacgccggaggaggacatgcgcctcatcgcctacattcagaagtacggccacgccaactggcgcgccctgcccaagcaagcaggtctgctgcggtgcgggaagagctgccggctgcggtggatcaactacctgcgcccggacctcaagcgcggcaacttcaccgccgaggaggaggaggccatcatcaagctccacggcttgctcgggaacaagtggtccaagatcgcgtcgtgcctgccgggccggacggacaacgagatcaagaacgtctggaacacgcacttgaagaagcgggtgtcgccggccggggaggagcgcggcgccgccgggtccaagaagaagaagaaaaagaagacgacgaaggcagccgctggcggtggcgcggaggcgccgctgccgctccggttcgcggtcgccgtcctcgtccacgacgacgaccaacttctccagcggcgactccggcgagcagcagagcaacaacatgagcaaggaagcggacgacgagctggnacctggagacttcgagatgatgccgatgctcgacgtcgacgaccccagcttcggctttggcacgcntggtggacaccgcgccagcgccgt

SEQ ID NO: 1637 - DNA, 1302 bp, Zea mays
acccgggagcagacagtgacaggcgaaccaagacacgcagggacagggagacatggggcgagggcgagcgccgtgctgcgccaaggtggggctcaacaggggctcctggacgccgcaggaggacatgcgcctcatcgcctacatccagaagcacggccacaccaactggcgcgcgctgcccaagcaagcaggtttgctgcgctgtgggaagagctgcaggctgcgctggatcaactacctgcggccggacctcaagcgcggcaacttcaccgacgaggaggaggaggccatcataaggctgcacgggttgctcgggaataaatggtctaagatcgctgcctgcctgccggggaggacggacaacgagatcaagaacgtgtggaacacgcacctgaagaagaaggtggcgcagcgggagaagaagaaggccggcgcggggagcggcgacgccggcacgcccgccactgcgcccttgtcctcggcgacctcctcgacgacgacccacaacagctccgggggcagcgactccggcgaccagtgcggcacgagcagggagcctgacgcgaccgacgtgtgccccctccagctagaggacatggacgtctcggacatgctggtggacggcgcgcccccggcggcgcagccaatgccgtcgccgtcctcctcgtcctccctgacgacgtgcgtcggcggcgtggaggagctgatcgagctgccggtgatcgacatcgagccggaaatctggagcatcatcgacggcgagagcgctgtggcgcgccatggtggcgatgcagccgcgccatgtacgggcaccggcaccgccgtcagcaccagcgaagcagaggaagcggcggcgaacgattggtggctggagaatttggagaaggagctgggcctgtggggctacgcggaggaggatactcaggcccaccctgacctactggaccactacacaggtttgagcccactctgcgccctggagggggacccagtctccacctacttccagaccgggcccgccgccgcggaacctgagctcctggtggtcgtcgaaccatctgccgttctgctatgactatgagcaacatgacggacggtcacagcaacgaacatcctggttcttggagatgttcggtggatcaaattcgagtagtttgtttgatgcagtggcagattaatatctctacaggccaattagaatgcacattcagaacagaaccgtccaaagaaagcctgtagagtgaaggctagtactctcttattcttaacagtgtttaacgcagataaaaaaaaaaaaaaaag

SEQ ID NO: 1638 - DNA, 946 bp, Glycine max
  misc_feature (6)..(6): n is a, c, g, or t
gaagcncggaattcggctcgagctcgagccgctcgagccgcaggttcaaagatgtgcagatgacaaagcagtgttgataacaacctacgaaggcaatcacaaccaccctttgccgccggccgccaccgccatggcaaatactacgtcagcagccgcagccatgctgctatcaggttcggcagccccaagcaaggaagcgctaacaaactctgcaggatattactcttcttcttcaattccctatgcttcaatggcaaccctatcagcttcagctccattcccaaccatcactctcgacttgacccaaaaccccaacaacgccatgcagctgcaccgagtaccagcaggccatggcgccacgttccctctgccactgcatgcggcagctgctggtccccacctactaggtcaccccttgttcttccaacagaagcttccaccggcagcattaatgccccttcttcaacgacaaccttcgtcgtcgatggtcgaaacggttagtgcagccattgcttcggatccgaacttcactgcagctttgatggcagcaatctcatcaatcattggagtaccaagaggaggcaatgacggtaacaacaacaacagtggaagtggtgctattccaggttcaccgcagcttcctcagtcatgcactactttctccaccaactagcggaattttgagaaactatatacttaatttctctatgtatatacacaacttaaaagagaagattaggcatgctcgcgcttaatttactgtgtttttattttcttatatgtaaaacagattaagagtcacctctgattctgaatgcatgactctataaacaaatcgtttgaaccttaccttcgacccgcaggagcgtgcatgtaagtaagttgatccttttggtacatgagtctggatataacttatgttatatacgtcacagatttgcaattt

SEQ ID NO: 1639 - protein, 310 aa, Oryza sativa
MNTFTLFRDEVQKASEKVHRHHANDDEAGLFLSLGLSLGSSPDACQCHASKKDEADAGNGGGDGYLALALRCAPAAGEPMVHPKRQRATTNSSSSSSICGEYGGGAAAAAVPAGHDDDDRSCMITAASTANRPGRVVLRTRCSAPTVKDGCQWRKYGQKTAKGNPWPRGYYRCTGAPGCPVKKQVQRCNHDTSVLVTTYDGVHNHPITPYAAALPPSSSSSSSAAVAMLASSSSSSTWSELQRAMPAAQSSWSQRNYPIQADVVAKAIWDPKFQATVAAAVASYVRDREQSARVAGGKGAGELFNLAPPC

SEQ ID NO: 1640 - protein, 244 aa, Oryza sativa
MNTFTLFRDEVQKASEKVHRHHANDDEAGLFLSLGLSLGSSPDACQCHASKKDEADAGNGGGDGYLALALRCAPAAGEPMVKDGCQWRKYGQKTAKGNPWPRGYYRCTGAPGCPVKKQVQRCNHDTSVLVTTYDGVHNHPITPYAAALPPSSSSSSSAAVAMLASSSSSSTWSELQRAMPAAQSSWSQRNYPIQADVVAKAIWDPKFQATVAAAVASYVRDREQSARVAGGKGAGELFNLAPPC

SEQ ID NO: 1641 - DNA, 1025 bp, Glycine max
ctgcgagaagacgacagaaggggagtctcgatcagtttcattcattggaagatatgggaacattagaacaaattgatgcccctcaaacccggtcatcatcatcttcttcttcttccatcgatagcaacaaccacccttctaggactaggactccaccaccctcttccccttcatcaagtccctgcagaaacagaactgatttgagcactgacctcagacttggtcttagcatctctccttcttctcaatctgaatcacccttcaattcaacaccaagggaggaaagttttgactggccaccaattaagtctatattgaggagcacccttgtggggaaacaaagccatctgaaccaaagaccctctttgtttgtcaaagtctatatggaaggaatccccatcggaagaaaattgaatctgatggcacattatggctatgatggactagtgaaaactcttggccatatgtttaggacgaacattctctgtcctaactctcaaccacttaattctgggaattttcacgtgctaacttatgaggatcaagaaggggactggatgatggttggagatgtgccgtgggagatgttcttgaacagtgtgaggaggctgaagatcacaagagctgaccgatgctagttaatttaatgatgtatacaatctctctcacaacacaagctcctcctgatcaattttcattgttcataaatttttgctgtagatctagttattaattagtgggtgggtgaaaccccttgaagtatttcaccaaaaagaatggatcccgtgattatcatatatctaatagctttatacaccgaaaaacaatatagatgtgtaacttcttacctaattctcaattcagtacatagctgcagtattcctagtctctctgtttgatgatggagtcgtctaattttcctctttgttttggaactagctccattattttgtagtcatttggaacaatgcatgtcccttttgtcttcatacctttaatgcatgatgtttcttggtgtctctttt

SEQ ID NO: 1642 - DNA, 822 bp, Glycine max
ccacgcgtccgggcaacaatcacaccacccttttgtgaacatttattcacaagttcctgctgaagtgaatgattgcagcaacgatcatagcagcttctttgtgaaggtgtacatggaagggattccaatcggaaggaagctcaatatactagctcatggaggctactatgagttagtcaggactcttgaacacatgtttgacactaccattctttgtaagtctattgttttatatcctctcattttgttgaatattaacaacacattttttaacatgagcttcctaactcgcaagattttgtaatttataagccagagagtgttgaatcagcaaaataacaatggaatgttgtggtgtgttaacagggggaacagaaatgaatggagtgcaaccagagagatgccatgtgctaacttatgaagatgaagaaggggatttggtcatggttggagatgtcccttgggagtaagttaattgactcttttttgtttttttttcttatctgagaaacaaaagcattatatgttccattttgtgaattgatgtggtatttgttttgatggtgtaggatgttcttatcgccggtgaagaggttgaagatcacaagggtagacacattcgggtgttaagtgaagaacatgacactgcctcttcctccaccggtgattttagattttgtcctctagagtgagactctaatgaggtcgctgatcagaaaatttagaaaaatcttagtgaagtatatgcacagataggtgatgtatatgcatagctcactctgctctttctttcaagataaaaaaccacccggccaacccaag

SEQ ID NO: 1643 - DNA, 597 bp, Oryza sativa
atcgaggccgcgtgcggcgccatgacggcgacgttccactgtttcgtgaaggtgtacatggagggcgtccccatcggcaggaactggacctgctgccgctggacggctacaaggtctcgtcgcacggcttgcctccatgttcagagcatccatcacctatcatcattgccatcgacagttcgccgtcgtcgggatgaagacgaacaaggttcatcatgttctgacatacgaagaccaggagggagactggatgatggctggagacgtgccactgggactgttcctgacaagcgtgaagagattgaggattgcaagagcggatgacaagtactgctatagctgttgaataattggttaaccaggatggtcaattaattcttccagagttcttggatttcattcattcttactttgctcattttggtggagcacatttagatttgagatgattgttttcgggagcgaaaatttactagtaaaagcatagtgatattgagcagaggatattgtacaaaatatattgtacacactagtaaaagaaaagaaacatatatatagaaatacccttttacttctcaaaaaaaaaaaaaaaaaaaa

SEQ ID NO: 1644 - DNA, 937 bp, Oryza sativa
  misc_feature (118)..(118): n is a, c, g, or t
  misc_feature (133)..(133): n is a, c, g, or t
  misc_feature (693)..(693): n is a, c, g, or t
tgatgctgagtgatcccgtccactagctggtgaattggagagacggatggagctcgagctcggcctcaggctcgcgctgccgtcgccgtcgccgtcgccggcgagcggtcgtcggcgngatgggtgtgagctntgacctttctcaacagcgcgccggggtcctgccgcaagaggggcttcgaggaggcgctcggtgggttcaaaaccgacgacgacaacgacgacggcgatggccgcggcggtgacggcgattccgacggcgaactgggcaacaagaggaggaagctggtggggtggccaccggggaagtgcttgcaccggcggcgcgacggtggctgcggtggcggatatgtgaaggtgaagatggaggggttggccatcgggaggaagctggacttgtccatcctcggctcatacgctgagctgctcgacacgctccaccttatgttcccctccactaaccaagaggatgggcacgatcgtcgtcgacgtcacccatacgctgtcacctacgaggatggggaaggagactggatgcaggtcggagacgtgccatgggaggcctttgccaagtcggtgaaacggctcaagatactggtgtaactgactgcaaattaagctactagtactagtctttactacttcgaataaaattgtacgtgaacgggattattttgttcacgtttctctcanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggccgttttaaaggacccaattttacttccccgggtttgcaaggtaaaaatttttttatggggcccccaaaattaatttccggggccgcggtttaacaccggggggaggggaaaa

SEQ ID NO: 1645 - DNA, 769 bp, Zea mays
  misc_feature (654)..(655): n is a, c, g, or t
  misc_feature (667)..(667): n is a, c, g, or t
  misc_feature (681)..(681): n is a, c, g, or t
  misc_feature (697)..(697): n is a, c, g, or t
  misc_feature (747)..(747): n is a, c, g, or t
  misc_feature (756)..(756): n is a, c, g, or t
ggcgattgggttcctcgaggccggccgggcccttccccccttccgttccgttccgatttgacgagttggtggctgctatagattcactccacccctctccatttctgataagtatccagctagctaccagtgtatgcaccaggcagcagcagcatggcggagtgcaaggacgacgacagcggccggcggtctccgtcgtcgtccatggacagcagcacccaccccccggcgctctccaccgcgtcctcggcctcccgccgcccgccggagaggagggaccagctcagccccgacctgcagctagggctcagcctgtcgccggcgtcctccgccctcctggtagcggagacaaacaacagcatcgtcccttctacgccaaggaaccaagcactcccggattggcccccgatcaaaccgttccttagaagcgccctgactgcctcggcacgccgacggcgaacgctgttcgtcaaggtgtacatggaaggcgtcccgatcggccggaagctggacatgctcttgctggacgggtacagcagcctcctagcgaaactttgccacatgttcaaggcatctatcacttcgggttcctcacgagaaggccgcgcatgttctcacctatgaagaccatgatggagactggatgatggttgnngatgtaccgtgngagctctttctcgnaagcgtaaagagctgnagatgcgagaaccgacaggtgctagatagcaaacttttcatgcgggggancgactctgntcccctctctttt

SEQ ID NO: 1646 - DNA, 1097 bp, Zea mays
ggccctaggggccttttttttttttttttttcttcacgcaaatcgcctcttcccttgcatccagccttggtacttgctaggcactcagagaaaacagaaaagggaaacatataaaaataccaaaatttaattttctagggatggtatcaagattgacttttcttccgtatactgtacacggtcagtatatatagcctcggtatcacatgcatgtccactctgtggccagcaaaatctttctgtatgaaccgatataaataaaaagaggaaagaaatagagtccatgcagcgcacgaataataagctttgctaactagcatttatctgttcttgcaaatcctaagtttcttcacacttccaaggaagagctcccacggtacatccccaaccatcatccagtctccatcccggtcttcataggtgagaacatgtgcaggcttctcgtgaggaactcgttggtggtactccatagcatcagcaaaggtgatggaggccttgaacatgtggcggagcttcgctaggaggctgtcgtacccatccagcaagagcaagtccagcttccggccgatcgcaacgccttccatgtacaccttcacgaacagtgtccgccgtcgtcggcgtgccgaggctgtcaaggcgcttctgaggaatggtttgatcgggggccagtcttgggtggtcctgctgccccttggcgtggaaaggacgctcttgctctccgctaccaccaggagggcggaggacgccgccggcgacaggctgcagagccctagctgaaggtcggtgctaaggtcgtccctcctctccgtcgtcgtcggccggaagcccgacgacgacgcggcggatagcgccggcgggtgggtgctgctgctgctgtccatggacgacgacgaaggagaacggccgccggcgtcgtcgtcctgcttgcacccggccatatgctgcctgcaggtgtgcatacactgtgtgatatatgttacgccgcagctggtgcttgttagaaatgggtcggcggagagcggcggagcgaatgatcttgctagcgccgacgactcgtcaaactggagcggaaagggagaagcccggccggcctcgag

SEQ ID NO: 1647 - DNA, 1017 bp, Zea mays
  misc_feature (117)..(117): n is a, c, g, or t
aaacaagaaaaaggtctgcgtatactcctgacttgataaccaaataaccatggtatttacaaggcagtcaaagaaccaggggaaaggaaacataaaataccaaaatttaattttgcnaggggtggtagcaaaggctggcgtttcttcagtacactgtacacggttagtatagcctcagcatcacgactccactctttagttcagcaaaatctttcctaatgaacctaatatatattaaaagaagaagaaacagagtcgatccaccgcatgaaaaagtttgctatctagcatctgtctgttttcgcaatcctcagcttctttacgcttccgagaaagagctcccacggtacatccccaaccatcatccagtctccatcatggtcttcataggtgagaacatgcgcggccttctcgtgaggaacccgctgatggtactccacagcgtcagcataagtgatagatgccttgaacatgtggcaaagtttcgctaggaggctgctgtacccgtccagcaagagcatgtccagcttccggccgatcgggacgccttccatgtacaccttgacgaacagcgttcgccgtcggcgtgccgaggcagtcagggcgcttctaaggaacggtttgatcgggggccaatccgggagtgcttggttccttggcgtagaagggacgatgctgttgttggtctccgctaccaggagggcggaggacgccggcgacaggctgagccctagctgcaggtcggcgctgagctggtccctcctctccgccgggcggcgggagcccgaggacgcggtggagagcgccggggggtgggtgctgctgtccatggacgacgacggagaccgccggccgctgtcgtcgtccttgcactccgccatgctgctgctgcctcccgcccgccctcgtggtacccctggatacttatcagaaatggaaaggggtggacacggtggagtgaacctatagcaccaaaacaacagctcgtcaaatcgatacggaacggaaggggggaag

SEQ ID NO: 1648 - DNA, 810 bp, Zea mays
aaaaagaagaaccagtcgcgcgatccaccgcatgaaaaaagtttgctatctagcatctgtctgttctcgcaatcctcagcttctttacgcttccgagaaagagcctcccacggtacatcccccacccatcatccagtctccatcatggtcttcataggtgagaacatgcgcggccttctcgtgaggaacccgctgatggtactccacagcgtcagcataagtgatggaggccttgaacatgtggcggagtttcgctaggaggctgctgtacccgtccagcaagagcatgtccagcttccggccgatcgggacgccttccatgtacaccttgacgaacagcgttcgccgtcggcgtgccgaggctgtcagggcgcttctaaggaacggtttgatcgggggccaatccgggagtgcttggttccttggcgtagaagggacgatgctgttgtttgtctccgctaccaggagggcggaggacgccggcgacaggctgagccctagctgcaggtcggggctgagctggtccctcctctccggcgggcggcgggaggccgaggacgcggtggagagcgccggggggtgggtgctgctgtccatggacgacgacggagaccgccggccgctgtcgtcgtccttgcactccgccatgctgctgctgcctggtgcatacactggtagctagctggatacttatcagaaatggagaggggtggagtgaatctatagcagccaccaactcgtcaaatcggaacggaacggaaggggggaagggcccggccgccctcgtggtccccaatcgcccttaggagt

SEQ ID NO: 1649 - DNA, 2414 bp, Glycine max
  misc_feature (8)..(8: n is a, c, g, or t
gaccacanactgtcatgccatcctcagttctatctagtgatagtatgcacattgggcttcttgcagctgctgctcatgctgcagcaactaatagctgctttacagtgttctataacccaagggctagtccatctgaatttgtcataccgctttcaaaatatatcaaagctgtgtaccatacgcgtgtttctgttggtatgcggctcgggatgctttttgagactgaagaatcaagtgtccgcaggtatatgggtacaataactggcataagtgatttggattctgttcggtggccaaattctcattggcgctctgtcaaggttggttgggatgaatcaacagctggagagagacaaccacgagtgtctctgtgggaaattgagccattaacaacattcccgatgtatccatcattatttcccctcagactgaaacgtccatggcatcctggcacctcatctttgcatgatgggagagatgaagctactaatgggctaatgtggatgagaggtggacctgtagaccaaggtctcaattccctaaattttcaaggagctggtatgttgccctggatgcagcagagactggatccaactttactaggaaatgatcagaatcaacagtaccaagccatgttggcagctggtttgcagaacttagggagtggagatttaatgagacaacaaatgatgaattttcagcagcctttccactatcttcaacaatctggaaaccccaatcctcctttgcagcttcagcagccgcaaccagttcaacaatctgtgtcttctaacatgctgcagccacaagctcacgtgttgacagagaacttctctcagcacctccttcagaaaccacataacaatcaagaagtccaagcacaacagcagcagcatacttatcaagactcgctcttaattccgagtgatcagctccatcagagacaacactctggcattccttcaccatcatattcaaaaccggatttcttggattcgagcatgaagttccctgcttcagtttcccctgggcaaaacatgcttagttcactttgtcccgaaggaagtggcagtctcttgaatttatccaggagtggtcagtccttgctgaccgaacagttaccccaacagcaatggactcaaaaatatgcacctgtgcaggtcaatgcctatggaagcactgtgtcacatccacaatattccggaaaagattctgtaatggtgctaccacattgtaactcagatgcccaaaattctactctttttggtgtcaatatcgattcatctggccttctcctccccaccaccgtccctggttacaccacctcgtccgctgacactaattcatcaacaatgccattagcggagtctggtttccagggttctctatatggttgcatgcaagattcatcggagttgttgcaaagtgcagggcatgttgacccagaaaaccagactcaaacctttgtcaaggtttacaaatcagggtcagttgggcgctcacttgacatatcccggttcagcagctatcatgaactgcgcgaggagttggctcagatgtttggaattgaggggaagttagaagaccctcttagatcaggctggcagcttgtgttcgtcgacagggagaatgatgttcttctccttggagatgatccgtgggaatcattcgtcaataatgtttggtatatcaaaatactttcacctgaagacattcagaaaatgggggatcaagcggtagaatcccttgctctaggttcaggacaaaggctaaacggcactggtgctgagtctcaggacattgtttctggaccaccatcaatcggctcacttgagtactgagaaaactgaaacatgtattccttcagaccaccatggtcaagagaatttctctacatgttttattacttaagttggaatatgttgtgtatgatctgttccccctttcagccctccttattattactatcagcattgaagaaaagtatacatttatgattaaaaaaaacccttaggacatgcttctgtgccaatttgaacttggagcactgcaagctagagttagtgttaatgctattttagcataatatttgatcaaacttttgcatgaactaatgtactctagataggaaactagagaaggctgtttatgcttgagctgtctttgtattctacaatgccattagttcccagttaaggggtcgaacttttaactcaaaatgtatgagtagtattttactatattgccattgaaaccatcaacccaccatacgacatgtctcttaaatgctactattttgtagctctataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 1650 - DNA, 2021 bp, Glycine max
attcggctcgagtattattctgagtgtggtgcaagccacctatgtactatttttcctttacttatgcaaaagctacctttgtactatttttcctttacttctgcacaagccaccttcgttttgcaggtacatgggtacaataactggcataagtgacctggatcctgttcgttggccgaattctcattggcgatctgttaaggttggttgggacgaatcaaccgctggagagagacagccccgggtatcattatgggaaattgagcctttaacaacgtttccaatgtatccatctctatttcccctcagattgaaacgaccctggcatccgggcacctcttcttttcatgatggcagagatgaagcaactaatgggcttatgtggctgaggggtggacctggagaccaagctctcaattccctgaattttcaaggttctggtttgttgccatggatgcagcagagaatggatccaactttacttgcaaatgatcataatcagcactaccaagccatgtttgcatctggtttgcagaacttagggagtggagatttaatgagacaacaaataatgaattttcaacagcctttcaattatcttcaacaatcaggaaaccccaatcctcctttgcagcttcagcaaccgcaagcaattcagcaatccgtatcttctaataatattctacagccacaagcccaagtaatggcagagaacctgtctcagcacctccttcagaaatcacacaacaatcgagaagaccaaacacagcagcagcagcagcagcggcacacttatcaagatacagttttacttcaaagtgatcagctccatcagaggcaacactctggtctaccttcaccgtcatattcaaaaccggatttcttagattcaagcatgaagttccctgcttcagtttcgccaggacaaaacatgcttggttcactttgtcccgaagggagtggcaatctcttgaatttatccagaagtagtcagtccatgttgactgaacagttacctcaacaatcatgggccccaaagttcacaccattgcagattaatgcttttggcaactcaatgcaacatgtgcagtattctggaaaagatactgcaatggtgccaccacattgtaacccagactcccaaaatcctattctatttggggtcaacattgattcatctggccttctgcttcctacgactgttcctcgttatactactgcatcagctgaaattgatgcatcagcaatgccaataggagagtctggattccagtctcctctatatccttgcgggcaagattcatcagagttggtgcaaagtgcagggcaagtcgaccctcaaaaccagacacgaacattcgtcaaggtttacaaatcagggtcagtagggcgctcacttgacatctcccggttcagcagttatcatgagctgcgggaggagttggcacagatgtttggtattgaggggaaattagaagaccctcttagatcaggctggcagcttgtattcgtcgacagggagaacgatgttcttctccttggagacgatccgtgggaatcatttgtcaataatgtatggtatatcaaaatactttcacctgaagatatccataaaatgggagaacaagccctggaatcccttggtccaagtccaggacagaggctgaatagcactggtgcagattctcatgaaattgtttcaggactaccatcaattggctcccttgaatactgagagaattttaacatgtatttttctctcaggtcctacggttaagaagactattacatatccacatgtttagtacttctgtttgaacactacttttcgaccttgcatatctgaatcaatatatactgtattgtctgtttcactttcaaaaacatcgttattatttcgtagaggattgttgagattttcaggacaaaaaatctatattatatatatgatgagaaagaaacctaggacaaacttttgtgcctgtaaccttgtgttgacatagagttaaaactattgtagc

SEQ ID NO: 1651 - DNA, 3152 bp, Oryza sativa
  misc_feature (3084)..(3084): n is a, c, g, or t
  misc_feature (3138)..(3139): n is a, c, g, or t
cccgggctgcaggaattcggcacgaggtctctctcgccccccggccccaccctttctccccaccatggtggcgatctccgagctcgggtgagcggaagagaaagaatgcggccgatttgaggagggggatggggttttcgggtggatttgtgaggggatagattaagagtttgtgcttctctggtttggtcggaggaggaggagatgagctcgtcgtcggcggccagcatcgggccgccgcagccgccgccgccccccgcgccgcccgaggaagagaagaagtgcctcaactcggagctatggcacgcctgcgccggcccgctcgtctgcctccccaccgtcggcacgcgcgtcgtctacttcccgcaaggccacagcgagcaggtggcggcgtcgacgaacaaggaggtggagggtcacatcccgaactaccccaacctgccggcgcagctgatctgccagctccacgatgtcacaatgcatgcggatgtggagactgacgaggtgtacgcgcagatgacgctccagccactgaacccacaggagcagaacgatgcgtaccttcccgcggagatggggataatgagcaagcagccgacgaattacttctgcaagacattgacggcgagcgacaccagcacgcacgggggggtttctccgtgccccgccgtgctgctgagcgcgtcttccctcctctggatttcacacagcagcctccagcccaggagctaattgcacgggatattcatgacatcgggtggaagttcaggcccctctttcggaggccaacccaaacgacacctgctaaccactggctggagcgtttttgtcagtgctaagagacttgttgctggagattctgtgcttttcagctggaacgcggcacgccggcttttacttggaataagacgtgccagtcggccacagactgtgatgccttcctctgttctttcaagcgatagcatgcacataggtctccttgcagcagcagctcatgctgctgctacaaacagccgtttcactattttctacaacccccgggcaagtccatcagaatttgtcataccactgtcaaaatacatcaaggctgtttttcacacccggatatcggttgggatgcggttcaggatgttgtttgagactgaggaatcaagcgttcgcaggtatatggggactataactgaagttagtgatgcagacccagtccgttggcctagttcctattggagatctgtgaaggttggttgggatgaatcaactgcaggggaaaggccaccaagagtttctttatgggaaattgaaccattgacaacctttccaatgtatccatctctgttcccactgagagttaagcatccttggtattcaggagttgcttccctgcatgatgacagcaatgctttaatctggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaattcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgctatacaacagcaactccagcaactacagcaaatgcagcaagttcagaatgatcagaagcagaagattcaaccagatcaaagctaccaagttcctacaagtgcagttctcccaagtccaacatcattaccgagtcatttgcgagaaaaatttggcttctctgatcctaatgcgaattcttcaagcttcatcacctctagcagtagtgataacatgttggattcgagcttccttcagggaagttcgaaagctgtggacttatctcgatttaatcagcctgtagctagtgagcagcagcagcaacaggcatggaagcagaagtttatgggttcacagtcagtgtcttttgggggctcggttttgcataactcacccacaagcaaagatggttctgttgaaaacaaaattggtcgtgatgtgcaaaaccagtccctttttagtccacaagttgactcttcatccctcctgtacaacatggttcctaatctgacttcgaatgtttcggatggcaacttatcaacgatcccttctggatcaacttatctgcagaatgcaatgtatggttgcttggacgactcttctggtttattgcaaaatacaggagagaacgatccagcaaccagaacatttgtgaaggtttacaagtcaggttcggttgggaggtcgttggacataacccggttctctaattatgctgaacttcgagaagaactgggtcagatgttcggcattaagggtcaattggacgaccctgatagatcaggctggcagcttgtattcgtcgacagggagaatgatgtgcttctccttggagacgacccttgggagtcctttgtgaatagtgtatggtacatcaagatactttcacctgaggatgtgcataagatgggaaagcaaggaaatgatccacggtatctgtcctgaagtgagagaacatggtgccatttctgggcttccaggaggattctgcagtgcatggtggcactcttgctctcgacaatgcacgtcgtcagaagtcccaaatttgtatcttgcatgtacgccgtacatgtttccagaactctctgttacctattcggtgcaggccaccggaaccacgaaacctgatattttgtaggttccacttaggaatcagtatcggtttaactcttatcctagatgatttgtaactcgcacggcagtccactgttttcatgtttcatcgagtcttcctagacattaaacttagttgatattgtatcaggatttatgtgtattgagattcctctacatgctttcaacccaaaaaaaactgcaataatcgaagcgcacgaggattgtttccaaaaaaaaaaaaaaaaaaaaattttnaccgattgtccggttatgtcagtttcgagaggagctgtcaaaaaaaaaaaaaannaaaaaaaaaaaaa

SEQ ID NO: 1652 - DNA, 2536 bp, Oryza sativa
ataagctcaatagttcttgaactgaattttcacagttgcatggaaaaccttacttgctgtcattaacagtacattgcaggaggaaaacatcatcaatatacagaatatggccgaagctagcgcctgcggcactacagcactactcaacatgaacctaataattagatgccctaagttaacatgatcagtattccaggaaacaaagtgtcggcatgtataccaaaatgtaataggtaccactaaaagtcaatgtaatatgacataattaccagacagcgcataacttagagctacacttgacctatgtgcttgggttccaggtcacagaactaagagctacagagacgtacagaactggacgcctaacgccgggtgctatgagctccctatttctcagaactcaactgagcccaccgacgcgattccagtgcttaggcttcttgattcctgcctgctcatgtagttgtcacagctgttgccaagtctccttgcagaagtcgagaagagttcaatgcccggcttgcccatctgctgaacctcctgcggcgaaagtatctttatgcaagacacactgttcacaaattcctgccacggatcatcgccaactagaagaaccgtcgtcctctcggtcaacaaatacaagctgccagccctgatctcaaaggggtcttccaactggcccctcaaggcccaaaaggcgccctacctcactacgaagttcatgataactgctaaatctagtgatgtcgagcaaccttccaacggttccagatttgtaaaccttcacaaaggttgcatgcggtcgcttcacttgatcagcattatctgaacatggaacatatcctgattcatctaagcagcccggagtagttagtgtttgactcaatgcctcgtccccttgcctgcggctaaggaagttggatgtggaatatggaattgtgcttgaactgttttcattgtgaaggcttggaatgccatcttgcatcaaaagtgactgtgagtctatatttacaccaaacaagaagtgattttgaggatcagagctcccatcttgatccaccaggcattcccttccaggcagtggtgctaacgtggagttttgaggaatactagaaggtgtcaagtcgaagttctctatctgtgatgaaatgtcatgtgggcgagaagtgatcgtagattccactgcaactcgcttagatgaccatgggtcagagacaggtacaggggtgattcttgccacacctgggaggtctgaagcagcttctgaagggaatgatctcagtgtatcgtgcatggatgagacattggatggagagagacaactgatatttgtgtcagggaaattatgttgctgtgagaatggtgaaactgtctgcaatgtggagggtgtagactgaggggtggaggaaagctgtgaaaaaaccgacaatgcatttggtacagtctgaaagttggacaagtgtttctgttgtcccatttgttgatgctgaggttgctgctggtgtgattcttgctgctgttgctgcggctgcaactgaggcttctgttcgttaaatgatgggcaatgttgaagcggttgctggaggtactcaggctgactatgcccttggattgagttgccattgatgttttggtggtacatctgctgaaattgaggctgtgcttgctgcagaatctgactggatagaagagaagatctaccgacaatgttttgcggctgctggaactgcagcatggcaggtgatacttgcttagtggtgttctgtaaagccgccgccgccgctatcgtttggtacatgtcaggttgcagaccaagtagggaactatccagccttggctgcatccacggactcataccaagtcctccaaaattcagagattggaaacctgtgttttgactatctcgaagccacataagagaagaagccaagtcatcctcctttccgccatataaagaaggtaagcctgttggccatggacgctttagtctgagaggaaaaggagatggatacatcgggaaagttgtcagaggctcgatctcccaaagagacacccttggctgtctctctccagcagtcgactcatcccatccaaccttgacagagcgccagtgtgagttcatccaacgaacaggatcaagatcacttattcctgttattgtccccatgtatctcctaacactggattcttctgtttcaaaaagcatccggaaacgcatgcccaccgatatgcgggtatggtagacagcctttacatatttagccagtggtataacaaactccgaagggcttgctcttggattatagaaaatagtaaaccggctatttgttgatgcggcgtgagcagctgcagcaagcagaccaatatgcatgctgtcactagacaatactgatgatggcatgaccgtttgtggcctatttgcccgacgaattcccagaagcagctgattactgtcattccagataaaaaggacagagtctccagcaacccctcgcgccgcactcccgcagccccgccaacccgtagtcagaagatg

SEQ ID NO: 1653 - DNA, 650 bp, Oryza sativa
ctgcaggaatcggcacgaggattgctgcgacggtccaggtttggttagttgttgagggagaaaaaaatggaagatatttctgggcgcaagagaggaaggcaggtgtttgctgctgctgctgggagcatgatgggaagctgaccagcagcttctccggtatcctggtgcggcggagtttcgtgctctttggcgacgggtgcactggtgattggagatgaagctctctccgccggcgtcagcggatatgccgcaggccttgccggagaacgacggggaacaaagatgtctgaactcggagctgtggcatgcatgcgctgggccccttgtgtctttgccagtggtcaggagcagggtcgtctactttccacagggccatagcgagcaggttgcggcatcaactaataaggaagttgatgctcaaatcccaaattatccaaacttacctcctcagttaatctgccagcttcataatgtcaccatgcatgctgatgcagagacagatgaagtttatgctcagatgacattgcaaccattgagcccggaagagcaaaaggagcctttccttccaatggagttgggtgctgctagcaagcaacccactaattacttctgcaagacattgactgcaagtgacacgagcactcatggtg

SEQ ID NO: 1654 - protein, 908 aa, Oryza sativa
MKLSPSAGGVSDQPPSPPEVAEEQKCLNSELWHACAGPLVSLPAVGSRVVYFPQGHSEQVAASTNKEMESQIPNYPNLPPQLICQLHNVTMHADAETDEVYAQMTLQPLSPQELKDPFLPAELGTASKQPTNYFCKTLTASDTSTHGGFSVPRRAAEKVFPPLDFTQQPPAQELMAKDLHGNEWKFRHIFRGQPKRHLLTTGWSVFVSAKRLVAGDSVLFIWNDSNQLLLGIRRANRPQTVMPSSVLSSDSMHIGLLAAAAHAASTNSRFTIFYNPRASPSEFVIPLAKYVKAVYHTRISVGMRFRMLFETEESSVRRYMGTITGISDLDPVRWMNSHWRSVKVGWDESTAGERQPRVSLWEIEPLTTFPMYPSPFPLRLKRPWPTGLPSLYGGKEDDLASSLMWLRDSQNTGFQSLNFGGLGMSPWMQPRLDSSLLGLQPDMYQTIAAAAALQNTTKQVSPAMLQFQQPQNIVGRSSLLSSQILQQAQPQFQQMYHQNINGNSIQGHSQPEYLQQPLQHCQSFNEQKPQLQPQQQQQESHQQQPQHQQMQQQKHLSNFQTVPNALSVFSQLSSTPQSTPSTLQTVSPFSQQHNFPDTNISCLSPSNVSSMHDTLRSFPSEAASDLPGVPRITPVPVSDPWSSKRVAVESTITSRPHDISSQIENFDLTPSSIPQNSTLAPLPGRECLVDQDGSSDPQNHFLFGVNIDSQSLLMQDGIPSLHNENSSSTIPYSTSNFLSPSQDDYPLSQTLTTPGCLDESGYVPCSDNADQVKRPHATFVKVYKSGTVGRLLDITRFSSYHELRSEVGRLFGLEGQLEDPLRSGWQLVFVDREDDVLLVGDDPWQEFVNSVSCIKILSPQEVQQMGKPGIELFSTSARRLGNSCDNYMSRQESRSLSTGIASVGSVEF

SEQ ID NO: 1655 - protein, 863 aa, Oryza sativa
MSSSSAASIGPPQPPPPPAPPEEEKKCLNSELWHACAGPLVCLPTVGTRVVYFPQGHSEQVAASTNKEVEGHIPNYPNLPAQLICQLHDVTMHADVETDEVYAQMTLQPLNPVRRLGFLHDVCSAEVLMQEQNDAYLPAEMGIMSKQPTNYFCKTLTASDTSTHGGFSVPRRAAERVFPPLDFTQQPPAQELIARDIHDIEWKFRHIFRGQPKRHLLTTGWSVFVSAKRLVAGDSVLFIWNEKNQLLLGIRRASRPQTVMPSSVLSSDSMHIGLLAAAAHAAATNSRFTIFYNPRTSPHYLWEFYNWASIKIHNILMRPMHTLMKHRYMGTITEVSDADPVRWPSSYWRSVKVGWDESTAGERPPRVSLWEIEPLTTFPMYPSLFPLRVKHPWYSGVASLHDDSNALMWLRGVAGEGGFQSLNFQSPGIGSWGQQRLHPSLLSSDHDQYQAVVAAAAASQSGGYLKQQFLHLQQPMQSPQEHCNLNPLLQQQILQQASQQQIINPDAQNIQTMLSPSAIQQQLQQLQQMQQVQNDQKQKIQPDQSYQVPTSAVLPSPTSLPSHLREKFGFSDPNANSSSFITSSSSDNMLDSSFLQGSSKAVDLSRFNQPVASEQQQQQQQAWKQKFMGSQSVSFGGSVLHNSPTSKDGSVENKIGRDVQNQSLFSPQVDSSSLLYNMVPNLTSNVSDGNLSTIPSGSTYLQNAMYGCLDDSSGLLQNTGENDPATRTFVKVYKSGSVGRSLDITRFSNYAELREELGQMFGIKGQLDDPDRSGWQLVFVDRENDVLLLGDDPWEFINIYMNVSNAKKSYIMKRREYNTLVSWFPQLIAYRGKTVLPSIICVGQSLYVDAQLPKTLRESKHQT

SEQ ID NO: 1656 - protein, 662 aa, Oryza sativa
MKLSPPASADMPQALPENDGEQRCLNSELWHACAGPLVSLPVVRSRVVYFPQGHSEQVAASTNKEVDAQIPNYPNLPPQLICQLHNVTMHADAETDEVYAQMTLQPLSPEEQKEPFLPMELGAASKQPTNYFCKTLTASDTSTHGGFSVPRRAAEKVFPPLDFSQQPPAQELIARDLHDNEWKFRHIFRGQPKRHLLTTGWSVFVSAKRLVAGDSVIFIWNDNNQLLLGIRRANRQQTVMPSSVLSSDSMHIGLLAAAAHAAATNSRFTIFYNPRASPSEFVIPLAKYVKAVYHTRVSVGMRFRMLFETEESSVRRYMGTITSISDLDSVRWPNSHWRSVKVGWDESTTGDKQPRVSLWEIEPLTTFPMYPSAFPLRLKRPWASGLPMHGMFNGGGNDDFARYSSLMWLRDGNRGTQSLNFQGHGVSPWLQPRIDSPLLGLKPDTYQQMAAAALEEIRYGDPSKQHPATLQYQQTHNLNSGLNSLFASHVLGQVQFQPQQSPLQVVQQGHCQNTGDSGFLQGQLPRLQLHNTQQLLKEQELQQQQRQHVLQEQSSQEMQQQLPSSDHHVADVASESGSAPQAQSSLLSGSSFYNQNLLEGNSDPPLHLHNNFHNFSYQEASNLLILPRSSQLMASDGWPSKRLTLESAVHPEAPSMHPKIEK

SEQ ID NO: 1657 - protein, 917 aa, Oryza sativa
MRLSSSSGSVLPAQAASPEAVEEQKCLNSELWHACAGPLVSLPAVGSRVVYFPQGHSEQVAASTNKEMESQIPNYPNLPPQLICQLHNVTMHADAETDEVYAQMTLQPLSPQELKDPYLPAELGSANKQPTNYFCKTLTASDTSTHGGFSVPRRAAEKVFPPLDFTQQPPAQELIAKDLHGNEWKFRHIFRGQPKRHLLTTGWSVFVSAKRLVAGDSVLFIWNDNNQLLLGIRRANRPQTVMPSSVLSSDSMHIGLLAAAAHAASTNSRFTIFYNPRASPSEFVIPLSKYVKAVYHTRISVGMRFRMLFETEESSVRRYMGTITGISDLDAARWPNSHWRSVKVGWDESTAGERQPRVSLWEIEPLTTFPMYPSPFPLRLKRPWPTGLPSLHGGKDDDLTSSLMWLRDSANPGFQSLNFGGLGMNPWMQPRFDASLLGLQPDMYQTIAATAFQDPTKQVSPTILQFQQPQNIGGRANTLLPSQILQQVQPQFQQQQYLQNINETTIQGHAQSEFLQQQLQRCQSFTEQKPQLQTQQQQQESQQQQQQQSQCMQVPQHQQMQQQKNMTNYQSVPNALSPFSQLSSPSQSSPMTLQTVLPFSQPQSYPDTSMSSLSPSNTSTMHNALRPFSSEAPSHLSMPRPTAVPVPDPWSSKRVAVESLLPSRPQVTSQMEQLDSTAPSIPQSSALAPLPGRGCLVDQDGNSDPQNHLLFGVNIDSQSLLMQGGIPSLQGENDSTAIPYSTSNFLSPSQNDFPLDQTLSSADCLDESGYVPCSQNSDQVINRPPATFVKVYKSGTYGRSLDITRFSSYHELRRELGRLFGLEGQLENPLRSGWQLVFVDREDDVLLVGDDPWQEFVNSVSCIKILSPQEVQQMGKPFELLSSAPGKRLGSSCDDYVSRQESRSLSTGIASVGSVEF

SEQ ID NO: 1658 - DNA, 3210 bp, Zea mays
aattcggcacgaggcttccttctcctaccccccacaccctcgcccccccccgctcccgcccgccgcgccctcctcctcccagtccgccccacccttccggccctccccctcttttatatccagtaccatggtgatctccgagctcgggtgagctgatgagaatgcggccgatttgaggaaggctgtgggcgcgatggatgcggtttcgggcggattcgcgaggaggctgtagaggttaggttccggtgtcccccggcccggccggtcgtgggagatgagctcctcgtccgcggccagcatcgggcagccgccgccgcccgcgccgccgccggaagaagagaagaagtgcctcaactcggagctgtggcacgcctgcgccggcccgctcgtctgcctccccaccgtcggtacgcgcgtcgtctacttcccgcagggccacagcgagcaggtggcagcgtcgacgaacaaggaggtggacgggcacatccccaactaccccaacctgccgccgcagctgatctgccagctccatgatgtcacaatgcatgcggatgtggagacagacgaagtgtacgcgcagatgacgctgcagccgctcaatccacaagagcagaacgacgcgtacctgcctgccgagatgggaatcatgagcaagcagccgacgaattacttctgcaagacgctgactgcgagcgacaccagcacgcacggcgggttctctgtgccccgtcgtgcggccgagcgcgtcttccccccgctggatttcacacagcagcctccagcacaggagcttattgcacgggatattcatgatgttgagtggaagttcaggcatatcttccgaggccagcccaaaagacacctgctgacgactggctggagtgtgtttgtcagtgctaagagacttgttgctggagattctgtgctattcatatggaatgagaaaaaccagcttttgcttggaatcagacacgctacccggccacagactgtgatgccctcttctgttctttcgagtgacagcatgcacatcggactccttgcagcagcagctcatgctgctgcaacaaacagccgcttcacaattttctataatcctagggcaagtccaacagaatttgttatacccctttcgaaatacatcaaggctgtttttcacacgcggatatcagttgggatgcgattcaggatgttatttgagactgaggaatcaagtgtccgcaggtacatggggacaataacagaagtgagtgatgctgacccagtgcgttggcctagttcctattggagatcagtgaaggttggttgggatgaatcaaccgcaggagaaaggccacctagagtttctctgtgggaaattgagccactgacaacctttcctatgtatccatccctgttcccactgcgagttaagcatccttggtattcaggacttgctgctcttcatgatgacagcaatgctttgatgtggctgagaggagtaaccggtgaagggggctttcattctttgaacttccagtcacctggtataggttcctggggacaacagagactccatccatccttacttagcaatgaccatgatcagtatcaagcagtggttgctgccgcagctgcctcccagtccggtggttatctgaagcagcaattcctacaccttcaacaacctatgcagtccccacaggagcagtgcaatctcaatccgctgttgcagcaacaaatactacagcaagcgagccaacagcagatggttagttctgatgctcaaaatattcagtccgtgctcaacccaggtgctattcagcagcagctccaccaactccagcagatgcagcatactcataatgaccagaagcaaaagattcaaccagatcaacagtaccaagttgctagcagtgcggttctcccgagtccaacatcattaccaagccatttgcgtgaaaaatttggcttctctgatcctaatgtgaactcttccagcttcatcagctctagcagcaacgaaaacatgctggaatcaaacttccttcaggtaagttcaaaatccgtggatttgtctagattcaaccaaccagtagttagcgagcagcagcagccgcaacaacaacaggcatggaagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgtagcactgttcacgacggcctgctctactgtgctcgcatgttcgcccgtgtcatctgtagcatgcaccaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtaaaaaaaaaacaaaaaaaaaaaaaaaaaaaaaaaaaaaaaaaaactcgagagggg

SEQ ID NO: 1659 - DNA, 3988 bp, Zea mays
aattcggcgcggggcgaaagcaagcaaggagcaccgcaccacgccactccagtactccactccactctcgtcccctcctcgatccagccatggcggcctagcccccccccccccctcccctagggttctctgccagcccccacccacccaggcgcctcctgccgctcccacccggtggtcgcgctgcccgcgtcgaatgggaggccacccggcgctcggagtcgggcgtgaccgcgcgctgccggaggttccctgagctcggcggcggcgggagcgtggctggtccggagcgcgccgcgcgtgcaatgggaggttcgagtggggttcctgcgagccgccgcggcggtctcggttctgcgagcgcgtggcccatgcttcgcgaagggtagggttgtctgtctgtctagctagctgctagctgcttggtctgatgagctcagctccggcgccccgcctcggcttccccgcgcgcttgctccgtcggctgcccagaacccagcttgcccgctccggcgcttctcttcgcttcttcggggaaaggttggagctttgaggtggtgcgggtgctcagccgaggactccgggcgatgacgcccgcagtggcgcgcgtttgccgcgacagtcctgggttcgggtagcgagttcctcgagcggatttggctgctgctgcgtcctgcgtgggaaggggaggcggcggcggcggcagcagcagaggaaggggaacggttgctctgaagcggagggggagcgggctgacattgcttctgggagcatggcgagcttctaaggacgcgcagctcccgcagcccagccattctcatcgccgcaccttggtgttcttgcccccaggtcgtactggttggtgggagggaacatgaacctctccccgcccaagatgtcggagccatctccggcacgtggcggggaacaaaggtgtctgaactcagagctatggcatgcatgcgcagggccccttgtgtccctgcctgtggttgggagccgggtcgtctactttcctcagggccatagtgagcaggttgctgcatcaactaataaagaagttgatgctcaaatcccaaactatccaaacctacctccacagttaatatgccagcttcataatgtcacaatgcatgctgatgcagagactgaagaggtgtatgcccaaatgacactgcaaccattgagcccggaagagcaaaaggatccttttcttccaattgaattgggtgctggtagcaagcagccaaccaattacttctgcaagacgttgactgcaagtgatacgagtacccatggtggattctctgttccgcgccgagcagctgagaaagtcttccctccattggatttttcacaacagcctccagtgcaagagctggttgcaagagatctgcatgataatgaatggaaatttcgtcatatttttcgtggtcagccaaaaaggcatctactgacgactggttggagtgtttttgtaagcgcgaaaagactagtagcaggggattctatcatatttatctggaatgataataaccagcttctcttgggaattcgccgtgcaagtcgtccacagactgtaatgccctcttctgtgctatcaagcgatagcatgcacattggtcttcttgctgcagcagctcatgctgcagccacaaacagtcgtttcactattttctacaaccctcgggctagcccttctgagtttgtcattccactggctaagtatgtgaaagctgtttaccacacgcgcgtatctgttggaatgcggtttcggatgctttttgagacagaggaatcaagtgtcagaagatacatgggtacgatcacaggcataagtgatctggactcagagcgctggccaaactcgcactggcgttctgtgaaggttggttgggatgagtctacagctggtgataaacagccaagagtttcactctgggagattgagccactgacaacctttccgatgtacccaactgcttttccattaaggctaaagcgtccgtgggcttcaggactacctatgttcaatggtgggaggagcgacgagttcgctcgttattcttctctcatgtggcttcgagatggaaaccgaggggctcagtcactgaacttccagggacttggagcatcaccatggcttcagccaagaatagattatccattgttgggtctgaagccagatacttaccagcagatggctgctgccgcactggaagaaattagagctggggatcatttgaagcaggcatcttctctcctgccagtgcagcagcctcaaactttgaatggtggattagatcctttgtatggaaatcctgttctgcagcagatgcagttccaatctcagcagtcaacactgcaagctgtgcagcaaggttatggtcagaatgcaaacgactctgggtatgttcaaaatcaactgcagcagctgcagctgcaaaagcagcaggagccaccaccaccacagcagcagcagcagacacaagtccttcagcgacaagcacatcaggaaatgcaacagcacctctcagctagttgtcatgatattgctaatgtagcttctggtgtgtccatgtctggatctgcttgtcaatcacaatcttctctgctttctgggtcatcgttctaccaacagaacatctttgatggaaatggtggtccagatctgcatctgcacaacagtttccacaacttttcaagccaagagtcctccaaccttcttaacctcccaagaagtggccaattaatggcatcagagggatggccttcaaagaggttggctgtggaatctcttgctggtcatgagatccaacctctgcagcacaagcttgagaaagttagtcaccagagtactgtgtctcactgttctggcaccttgccgccactatcagcaagagacggttctagtgcccaggcttgtggtacaaatgttcagagtcacctgcttccatcatcatttgcaatccatgatggattgtcaaccatcaggagtggtggtgttggcagtggaactgatgcgataaccatagcttcgttgagatatagtgatgcgaatttgctacctgaaaactccatagcaacttccagttgtttgggtgaatcaggaaccttcaattctcttgacgatgtttgtggtgtaaacccatcacaaggtggaacctttgtgaaggtttacaaatcagggtccctcgggagatcgctcgacatcaccagattcggcagctactacgagttgcgtgtcgagctcgagcggttatttggtctcgaaggccaactggaggaccctgcaagatcaggctggcagcttgtattcgtcgaccgggaaaacgatgttcttctcctcggcgacgacccgtggcaggagtttgtgaatagcgtagggtgcataaagatcctctcgccgcaagacctgcagcagatggcccgcggcggcggaggtgaccttctgtctgcgcctggagcgaggatgctgcagggcagtgtctgtgacgactattctgcaggccacgacgtgcagaacctcaccggcagcattgcgcctgtggtgcctctggactactgaagaggactgaggcgaaggccgggatctgaagctctgaaccaaaaccggcaatccagcatttgcaggatttgccatccgcaagtcgtttcgttcctgtgttatgatcctctcagtctcaggccctgttgatcgggaataacctagtcgtttaatatagctagatgatgatccatgtatcattatggtaatggacatgctgtacgatagctactgtagctctaaatgcaggcaaggcaagaattgatctatcaaagaacgaatgaatgcaggcactcactgtagaggtgatctagccctgtactcctaagtcctaagatatattctcatagctaaaactgatggttccatgtggcattggcacccaagctattgaaaccagtcacctttgccgattcctcctgcgaaaaaaaaaaaaaaaaa

SEQ ID NO: 1660 - DNA, 2886 bp, Zea mays
gtcgacccacgcgtccggtctacctccgcagcttatatgccaactgcataatgtgactatgcatgctgatgctgagacagatgaggtgtatgcacagatgacactgcagccactcagtccacaagagctcaaggacccatttttgcctgctgagttaggcactgccagcaaccagccaacaaattatttttgtaaaacactaactgcaagtgatacgagtacacatggtgggttctctgttccacgccgagcagctgagaaggtgtttcctccactggatttcaatcagcaacctcccgcacaggagttgattgcaaaagatcttcatggcaacgactggaaatttcgccatatttttcgaggtcagccaaagcggcatcttctgacaacaggttggagtgtctttgttagtgcaaagagactggttgctggcgactctgtcctttttatctggaatgacaacaaccagctgcttctgggaattcgacgggcaaacagaccacaaaccgtcatgccatcatcagtactttctagtgatagcatgcatattggcctgctcgctgctgcagctcatgctgcatcaacaaatagtcggtttactatcttctataatccaagagcaagcccttgtgaatttgtcatacccatggctaagtatgtgaaagctgtgtaccatacccgtatatctgtgggcatgcgtttccggatgctttttgagacggaggaatctagtgtaaggcgttatatggggacaattacaggaataagtgatcttgatcctgttcgctggccaaactcgcactggcgctcagtaaaggttggatgggacgagtcaactgctggagagaagcagccaagggtatctctttgggagattgaaccgttgacaacttttccaatgtatccatctccttttgctcttggattaaagcgcccatggcctgcaggcctgccttctttatacggtggaaggggtgatggcttgacctcttctcttatgtggcttcgagacagggcaaacccgggtttccagtcactgaatttcagcgggcttggtatgagtccctggatgcagcctaggctggataattccttacttggtctccaatctgacatgtaccagaccatagcagcagcagcagcattacaaagcactacgaagcaagttccaccttcagcaatgcagttccaacagcctcagaacattgctgatagatctgctcttctatcaagtcagattctgcagcaagtacaacctcggtttcagcaaatttaccctcaaaatctcaacgaaaacaaaattcaaggtcatacacaacctgagtacctccaagtccaacagcagcttcaacgctgccaatcatttaatgagcagaagcctccgatgcatccacagcaacaacagcaggaaccacagcagcagcaatgcgtccaaacaccacaggatcaacaaatgcaagaacagaagcatctgcacaacttccactccttgccagatgcattatcggccttttctcagctttccccagccactcactccccaccttccgcattgcagacagttccagcattctcgcatcaacaaaacttcccagatacaaacattagctctctctcaccatctactggcccttcaatgcatggcatgttggggagattaccttccgaagcagcttcgagcctcccatgtgtggcaatgaacgcccctgtatcggtatctgacccatggtcatccaagagagttgcagtggagtctgttaacccttgtcgacctcatgtttcaccacatatagaacatttggatatggcgacgtgtaacatgccgcagagctctgcactagcaccattacctggacgagaatgcctagtggatgaagatgggtgctctgatcctcaaaatcacctcttgtttggtgttcacatagactcacattcacttctgatgcaagggggcattccagcccttcagaatgataacagttcaggcactattccatactcaacctccaatttcctgagcccttctgataacgatttccccttgaatcaaccgctacgcagcgctggctgcttagatgagtcggattatcttccatgtgcagagaatgccgaacaggcaaatcaacagtttgcaacctttgtgaaggtttacaaatccgggaccgtcggaaggttgctcgacatcactagattcagcagctacgacgagctccgtagcgaggtggggcgtctgtttggcctcgagggccagctggaagaccctttgagatcaggctggcagcttgtatttgttgacagggaggacgatgtccttctggttggcgatgacccatggcaggaattcgtgaacagtgtgtcctgtataaagatactttcaccggaggaggtccagcggatgggaaagccgggcatccagctcctgagctcggctccttcaagaaggctgggcaatggctgcgacagctacgcgagcatgcaggagccgagaggcctggacgctgggatggcgccggtgggttcggtcgagttctgaagacggcggagggaagcccaccatggccctcgggtcgaggattactctccctcctgtatgtttctgcagcacttgctagctctgcgacttggaacaaagcacgtagatcaaatggagctctgtgctgctccccgtctgatgatgtcttatggtatagactcgtagcagtaactactacatgttgtatacatgccggcacttcagttcttatcgagtagcaataccgctagtttagtccatccaatcaactacgttcttgttcctatgatcctgttgttgcgatgcagtaaaactttttttttcgtcataaaaaaaaaaaaaaaaaaaaaaagggaaaaaaaaagggcggccgc

SEQ ID NO: 1661 - DNA, 3033 bp, Zea mays
ccgcttgtttccttgcccgcggtgggtagccgagttgtgtacttccctcagggccacagcgagcaggtagcagcatcaacaaacaaggaaatagagtctcagatccccaactatcctaatctgcctgccacagcttatatgccaacttcataatgtgacgatgcatgctgatgcagagacagatgaggtatatgcacagatgacactacaaccactcaacccgcaagaactgaaggacccatatttacctgcagaattaggttcggccaataaacagccaacaaactatttctgcaaaacattaacagcaagtgataccagtacccatggtgggttctccgttccccgtcgagcagctgagaaagtgtttcctccactggatttcacccagcaacccccatgccaggagttgatggcaaaagatcttcatggcaatgagtggaaattccgtcacatctttcgtggccagccaaagcggcatcttctaactacaggttggagtgtctttgtaagtgcaaagagactcgttgctggcgactctgtcctttttatctggaatgacaataaccagcttctgctgggaattcgtcgtgcaaatcggccacaaactgtcatgccatcttcagtcttatcaagcgatagcatgcatatcggtcttcttgctgcagctgctcatgctgcttcgacaaatagccgatttacaattttttacaacccaagggcaagcccttcagagtttgtcataccactcgtaaagtatgttaaggctgtgtatcatacccgcatatctgtggggatgcgattcaggatgctttttgagacagaagagtctagcgttaggagatacatggggacaattaccggaatctgtgatcttgattctgttcggtggccaaattcacactggcgttctgttaaggttggctgggatgagtcaactgctggtgagcgacaaccaagggtgtcactatgggagattgaacccctgacaactttcccaatgtatccatctccttttccgctcaggctcaagcgtccatggccaacaggcttgccttctctgcatggtgggaaggatgatgacctggctaactctctcatgtggcttcgagataccgcaaatcctggttttcagtcgttaaattttggtggacttggtatgagcccttggatgcagccaaggctggatgctaccttacttggtctgcaacctgacatgtatcaggcgatggccacagctgcttttcaggatgcaacaaagcaggcatcgcccacaatgctgcagttccagcagccccagaacatagctggccgggcttccccgcttctttcaagtcagattttgcagcaagcacatcatcaatttcagcagcaaccgtaccttcaaaacatctctgagagcacaatccaagcacagggtcagtctgagttcctcaagcagcagatccaacgcagccagtcattcaatgagcagaagccccagatgcaacaccagcaagaatcacagcagcagcagcaaccacagtgtctgccagtcccccaacatcagcaaatgcaacaacagaatatgaccaactaccagtctatatctaatgcattatcaccgttttctcagctgtcgccagtttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagaccaagccttagctctgcgagctatgtaccatctaataattctgtccgtgtcgtaccatgtcaactcctaagtagaagaattgaagaaactaccagcagccgctgtctggtatacacgctgaaacattttttttcttgtatggagaaatactaatcatctggatgtagccaggcctatgctctctaatggttgatcgggtaatacagcccctcgcacacaaaaataagtcgacgcggccg

SEQ ID NO: 1662 - DNA, 1337 bp, Glycine max
gaattcggctcgagggatggctcatttatcatagtagtgcttcctcctttaccatttgaccatatttatccatctcaatcacttcccactttttatgagcattggccaacccccacgcttcctttattctccctctcaagcttcaagctactcacaccaatgaagatccagtgcgacgtttgcaacaaacacgaggcctccgtcttctgcaccgccgatgaagccgccctctgcgacggctgcgaccaccgtgtccaccatgccaacaaactcgcctccaaacaccaacgcttctctcttctccgcccttctcctaaacaacaccctctctgcgatatttgccaggagagaagagcctttacattctgtcagcaagacagagcgattctctgcaaagagtgtgacgtgtcaattcactctgccaacgaacacacccttaagcacgataggttccttctcaccggtgttaaactttctgcttctgctatgcttcgttcgtcagaaactacctctgattcaaactcaaacccttctcttcttaacttttcacaccaaacaacattactacctccatcttccaccaccaccaccaccaccagcaacaacaacaacaacaaggttgctgttgaaggaactggttcaactagtgctagcagcatatcggagtatttgatagagactcttcctgggtggcaagttgaagactttcttgattcatattctgttccctttggtttctgtaagaatgatgaagtgttgccacggtttgatggtgaaatggaggggcatctgagttctttctcaaccgagaacatggggatctgggttcctcaagcgccaccaactcttatgtgttcttcacaaatggatcgggtgatagttcacggtgagaccaatatcaaaggtagcagcagatcaaggttgaaggatgataatttcactgttccacagattagtcctccttccaattccaagagagccagatttctgtggtagaaacaaataaacaaacaaacaagcctcagtttccattctcttgaggcagaattaacaaccctctttgttttgttttgtcccttttctctttttcttaccctggcttgtagtttactctgcccatgttttcaatttggttcagtttgactttttttttttccctttttcttgtttctcctccctctttccctactgggctgtgttttgataaatttgtgcacctttctactagtgattgtaaatataaaccttttcaaatgcatgttgttttttgacacatgtttagaagagaaacaacagagtatgagcttaatagatatgttgagtaaaattcccccccc

SEQ ID NO: 1663 - DNA, 1173 bp, Glycine max
attcggctcgagccttcctttattctctcctcttaaacctttcacttcaagcttcaagttttcaagctacccacccactgctcatactcacacccaatgaagatccagtgcgacgtgtgcaacaaacacgaggcctccgtcttctgcacagccgacgaagccgccctctgcgacggctgcgaccaccgtgtccaccatgccaacaaactcgcctccaaacaccaacgcttctctcttctccgcccttctcataaacaacaccctctctgcgatatttgccaggagagaagagccttcacgttctgtcagcaagacagagcgattctctgcaaagagtgtgacgtgtcaattcactctgccaacgaacacacccttaagcacgataggttccttctcactggtgttaaactcgcagcttctgccatgcttcgttcatcacaaactacctctgattcaaactcaaccccttctcttcttaacgtttcacatcaaactactccacttccatcttccaccaccaccaccaccaccaacaacaacaacaacaaggttgctgttgaaggaactggttcaacgagtgctagcagcatatcagagtatttgatagagactcttcctgggtggcaagttgaggactttctcgattcatattttgttccctttggtttctgtaagaatgatgaagtgttgccacggttggatgctgacgtggaggggcatatgggttcgttttcaaccgagaacatggggatctgggttcctcaagcgccaccacctcttgtgtgttcttcacaaatggatcgggtgatagttcaaagtgagaccaacatcaaaggtagcagcatatcgaggttgaaggatgatactttcactgttccacagattagtcctccctccaattccaagagagccagatttctatggtagaaacaatcctctttgttttgttttgttttgtgccttctctctttttgttaccctggtttgtagcttactcttgcccttgttttcgatttggttctgtttgactttttttcttcttctttttcttggttctcctccctctttccctaccgggctgtgctttgaagtattgataaatttgtgcacctactagtgattgtaaatataaaccttttcaaatacatgttttttttgacacatgtttagaat

SEQ ID NO: 1664 - DNA, 857 bp, Glycine max
attcggcgcgagcaaaagcaaaagatgaagatccagtgtgatgtgtgtgacaaagtggaagcctccgtcttctgtcctgcagatgaagctgctctttgccatagctgtgatcgcaccattcaccgcgccaacaagcttgcaaccaaacacgcccgtttctctctccactaccccacctccaaagacttccctctttgtgatatatgccaagagaggcgtgcatatctattttgccaagaagacagggcgttgttatgcagggaatgcgacgttcctatccacagagccaatgagcatacccaaaagcataacaggtttcttctcacgggtgtgaagctctctggtacttgtttagatcctgcttcgtcctccaccaattacaccaataataatagagtcactggctctgaaggaagaaacgacgctcgatctagaatgaacagacccagatcatcagtttccaatgaagaaaatgcaagtaattcttcttgcaaggttgaagacaacgtggctagtgacactggttcgatttcaactagcagcatttctgagtacttgattgaaacaatacccggttactgttttgaagacctccttgatgcttcgtttgcacctaatggtttctgtaagaagcagaactttgatcatccctgggcgtttcaggaccaaaagcgaacaagtggagacactatggccgtgccgttcctgaaactagtcatccattgatcaaaatatctaaaccctcgcggtcataaactgtttgtaaaaatctgttggaaaatatcttctttatttttgttatttgtaaaaatctgaaactttatgattttattttttattctctattcccaaccaca

SEQ ID NO: 1665 - DNA, 1242 bp, Glycine max
acggctgcgagaagacgacagaaggggaatctttttgtaagaacgtgaaacatgacaccctaactcgcgttgcttgcttgagtgatttgactcgtgtcgagtgtattgtatttagtttaagcgtggctgatcgagtgagtatcagaatcaattcaattttgagctagtcatgaagatccactgcgacgtgtgtaacaagcaccaggcctctttcttctgcaccgccgacgaagctgccctatgcgacggctgcgaccaccgcgtccaccacgccaacaagctcgcctccaaacaccaacgcttctccctcacccacccctctgcgaaacattttcccctctgcgatgtttgccaggagagaagagccttcgtgttttgtcagcaagatagagcgattctgtgcaaagagtgtgacgtgcccattcattctgccaacgacctcaccaagaaccatagcaggtttcttctcactgggattaagttctctgcttctgccacgccttatgattattcatcaccaccaccaccaccaccaccaccacccaagagaaaccctgttctcgattctccttcaacaccgtcaccgcctaagcctgggggaaactcgctaacaaacgaagaagaacctggtttcacaggtagcagcatttcagagtacttgataaactctatcccaggcatgaagttcgaagatttcctcgattcacattctcttccctttgcttgctccaagaatagtgatgacatgttgtcgctgtttggtgagggaaacatggtttctttctcacccggtgggttctgggttcctcaagcaccaccatcttcagtacaaatggatcggcagagtgggtacagagagacaagggaaggtagcattagatcaagttttggagatgataatttcatagttccacagatgagtcctcccagcaatgtgtctaataagagatccaggcttctctggtaaaacagatatagctagttacaactagctaacccccttatgtggctttgtgtgacttaaatttcactctcccctcctattttgtattttttatgtggtattgttttaatttttgtttgttcgtttggttttggtccctctcccttcctgaactacactactcttctagctactttctctcttgataagttggtgtatctcttccaaattgtaaatatgaacgttttaagagctctctgggttgagataaaaaaaaaaaaaaaaaaaaaagcggccaa

SEQ ID NO: 1666 - DNA, 1111 bp, Glycine max
ggctcgagttcaaatcctcctttctattaatctgaaacaagttattagtcatgaagatccagtgcgacgtgtgtaacaaacagcaggcatcgttgttctgcaccgccgacgaagccgccctatgcgacggctgcgaccaccgcgtccaccacgccaacaagctcgcctccaaacaccaacgcttctccctcagccacccctctgcaaaacattttcctctctgcgatgtttgccaggagagaagagcctttgtgttttgtcagcaagatagagcgattctgtgcaaagagtgtgacgtgcccgttcattctgccaacgacctcaccaagaaccataacaggtttcttctcactgggattaagttttctgccctcgattctccttcaacacctcctaagcctgcaggtggaaactccctaacaaatcaacaaccacaacaacaaactggtttcacaggtagcagcatatcagaatacttgataaacactatcccaggcatggagttcgaagatttcctcgattcacattctcttccctttgcttgctccaagaatagtgatgacatgatgttgtcgatgtttggttgagggaaacatggtttcgttctcagccggagggatctgggttcctcaagcaccatcttcagtacaaatggatcagcagagtgggtacaaagacacatgggaaactagcattagatcaagttttggggatgatagtttattagttccacagatgactcctcccagcaatgtgtttaataataagagatccaggcttctatggtaaaacagttacagctagctatcaagctaaccaccttatgtggcttttaatttcactctattcttaatttggttttctttgtttttttgtccctctcctccttcctgagtactacactactcttctagctacttaattccctcttgcgttctcgataagttgatgtatctcttccaaattgtaaatgtctatgttttaagagctctctgggttcagattaattgtttctgctacatgttaaaagatgactcaagtcttaattaacattgcataaatgaaccggaagaagacttaggcgatatcttcaaaaaaaaaaaaaaaaagg

SEQ ID NO: 1667 - DNA, 1018 bp, Oryza sativa
  misc_feature (202)..(202): n is a, c, g, or t
ggcgactcgagcaaccacgcggtcgcagaagaaagagagagagagagatggcggcatgagcacctcctcctgcatcgccacctcccccgatcccccgcaaaccctagcgaccgcgccccccaccgtcatccttctctgcggcggcgccctggtgaggagggaggaggaggatggggaggtggagagggcggtcgctgcgacntgtgcgcggccgaggccggcctcggtcttgtggtgggcggacgaggccgcgctgtgcgacgcgtgcgaccgccgcgtccacagcgcgaacaggctcgccgggacgcgccggcggttctgcctcctccgaccggtggcgtggtggtggtccgcccagaagccaccggcgggcgcctcccgtcaggagaagagggggttcttgttctgcaaggaggacaggggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccgcctcctcctcctcagacgggctatttcaggtcagttcatccactgttaacgatccaaactttccatggcaacgaaaacctgaatacgtattcagtccggttcatgcatgaaaccctgaaaaaccaatccacacacgttcttgtgagcaccatgaacgaagcacaggcaaagcacggcgcgccaaactctgttcaggccctgccggccgtcgtgggcacataagccaatctgttcacaatatcgtgagcggacaaattttaccatgcaggtagtttgtagtcatgctcacacagctagcaataac

SEQ ID NO: 1668 - DNA, 478 bp, Oryza sativa
gcacgcctcggacccgtccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagacatgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggagaagagggggttcttgttctgcaaggaggacagggcgatcctgtgccgggagtgcgacgtcacggtgcacaccacgagcgagctgac

SEQ ID NO: 1669 - DNA, 1393 bp, Oryza sativa
  misc_feature (1378)..(1378): n is a, c, g, or t
  misc_feature (1380)..(1380): n is a, c, g, or t
  misc_feature (1387)..(1387): n is a, c, g, or t
  misc_feature (1390)..(1390): n is a, c, g, or t
tttgttccctccacttcggcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccggccatgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtagggaggggagcagcatctccgactacctcaccaccatctgccccggctggcgcgtcgaggacctcctccccgacgacgacgccttcgccgccgccgccgcgcaggcggggaaagagaaggacgagcgcgtgccgttcctcgacgccgacctgttcgacgtggtcgcccgccggccggagaagaagggcggcgcgtgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctgaacgccgccgccgccgtacaatctggccgccggcgagctcgacgaacacctcgatggatcgatcgaacacctgtgtaatcactcagctggtcactactacaagtagcaatcagcaagcttgatgtgccactgttactagctgctgctgtttaattagtgagtactaagctactactagttaattttggtgaaaactatgctactttgttactatataatgaagtatgtgtatcaaactaaactgagatgttggtaattaattatcgtattttgtaaaantnaaaaaanttnaaa

SEQ ID NO: 1670 - DNA, 427 bp, Oryza sativa
ccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcagagcgagctcaccatgcgccacagccggtacctcctcaccgtgcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccact

SEQ ID NO: 1671 - protein, 250 aa, Oryza sativa
MKVQCDVCAAEAASVFCCADEAALCDACDRRVHSANKLAGKHRRFSLLQPLASSSSAQKPPLCDICQEKRGFLFCKEDRAILCRECDVTVHTTSELTRRHGRFLLTGVRLSSAPMDSPAPSEEEEEEAGEDYSCSPSSVAGTAAGSASDGSSISEYLTKTLPGWHVEDFLVDEATAASSSSDGLFQGGLLAQIGGVPDGYAAWAGREQLHSGVAVAADERASRERWVPQMNAEWGAGSKRPRASPPCLYW

SEQ ID NO: 1672 - protein, 337 aa, Oryza sativa
MRVQCDVCAAEPAAVLCCADEAALCSACDRRVHRANRLASKHRRLPLVHPSSSSSGDGGAAAAPLCDVCREKRGLVFCVEDRAILCADCDEPIHSANDLTAKHTRFLLVGAKLSPAALAEQPLPSSDCSSDDDAAAAATEEEYHSSAASTGAAVSAPLDASSNGAGGGGGVGGSSISDYLTTICPGWRVEDLLPDDDAFAAAAAVSTTNPSLRRVLATSPSMKPRLTYDSLEQQAGKEKDERVPFLDADLFDVVAGRPEKKGGAWAPHVPHLPAWCLDEVPVVVAASAAPAATPVKAKQGHVRDSHWSDSDAFAVPEFSPPPPPAKRARPSSQFWCF

SEQ ID NO: 1673 - DNA, 700 bp, Zea mays
  misc_feature (163)..(168): n is a, c, g, or t
  misc_feature (594)..(594): n is a, c, g, or t
  misc_feature (596)..(597): n is a, c, g, or t
  misc_feature (609)..(609): n is a, c, g, or t
  misc_feature (636)..(637): n is a, c, g, or t
  misc_feature (664)..(665): n is a, c, g, or t
  misc_feature (669)..(669): n is a, c, g, or t
  misc_feature (690)..(690): n is a, c, g, or t
gaattgttctctgtttcttttaagcggcaatgaagatccagtgtgatgtgtgtaacaaacacgaagcttctttattttgcaccgccgatgaagctgccttatgtgattcctgtgaccaccgtgtccaccatgctaacaagctcgcctacaaacaccaacgttnnnnnnttaatcacccttctgcagaacatttccctgtctgtgatgtttgcacggagagaaaggcttatgttttttgtcagcaagatagagcgattttgtgcaaagagtgtgacttgcctattcattctgcaaacgaacataccaagaagcataataagtttcttctaactgggattaagctctctgcttctgccaccctttattcatcactaccctcttctaattccaagtctgtgatgaaaaatcctgtgattgattcttcttcacaacaacctttgatggataagacttcttcttcaacagtatcagtgcctcccaccatcagcaaggctaatgaagaagctggtttcacaagtagcatatctgagtacttgataaatactatcccgggttggcaatttgaagatttgctcaattccccttctcttcctntnngtttctctaagnatggtgatgatatggtgtcactggtgnntggtgatgttgggggaaatatgttttnnttcncaccacccgagagcattggtnggatctggga

SEQ ID NO: 1674 - DNA, 1364 bp, Zea mays
gaattcccgggtcgacccacgcgtccgcccacgcgtccggtcctctcctctgtctctctctctttgagcctcctttttcaacctaacctttgacgctgtagctcgagagcaagcatagtgcctagtgcctaccagattctctccctgagcggctgagctctgccgatccgcgataggctcgcgccatgcagatgctctgcgacgtctgcgccgccgcgccggccgccgtgatctgctgcgccgacgaggccgcgctctgctccgcctgcgaccgccgcgtccaccgcgccaacaagctcgcccacaagcaccgccgcatccccctcgcccagccctctggcgacgaatccgacgccgacgccaagccgctctgcgacgtgtgtaaggagcggaggggcctcgtgttctgcgtggaggaccgcgccatcctgtgccccgactgcgacgaccccatccacagcgccaacgacctcaccgccaagcacacccgcttcctcctcgtcggggccaagctctcagccgcgctcgtcgacgcccaggcgccccactcccctgacgacgacgacaacgactgcggccgcggcaacggcgccgccgccgagcccgacgctgtccccgccgtctgcgcgcagggctcctgcgcggccaaggcctcgtctcttgagtccggtggcggcggcggcggcggcagcggcagcggcagcagcatctccgagtacctcaccaacatctgcccaggctggcgcgtcgacgacctcctctttgacgactcggcgttctcagcggcatcgaaggccgacagctgcgacgacgggcacgagcaggtgccgtccctggacgccgacctcttcgacgtggtggctggcgccggctggccggggaagcgcggcagcgcgtggtcaggagtcggagctctgggcttcgacaaggtgccggcctccgttgttgtcgtcccgacggcggccaagcaacagcaggggtgcgtgagggagaggacctgggactcggacagcgacagcgacgtgttcgcggtgccggagctcccgcaaccaccgcaggccaagaaggcgcggccggcgccggctccggcgccgactttctggtgcttctgagctgcactgtcccagtccggtccggccggcctgtgtgcactgtgtacttgccgtgacttctgtaaccagtgtgtgtgagcgagcttgctcgtgctttttacccatgtactgttgttactgcatacacacacacacttaccactactattagtagctagcagtgctcaaacccaagttaattaagtttggcgcagtttatattatgacttaatcataaggtgattttgcggcggccggtcgagatcttgaact

SEQ ID NO: 1675 - DNA, 779 bp, Zea mays
ctcgaggccggcccggcccgccatgtcctctcctctgttcctctccagcccccttttcaacctttgacgctgtagcttgagagcgagattagtgcctaccatattctcctcctgagcgactgagcgctggtctccgataggctcgccatgcaggtgctctgcgacgtctgcggcggcgcgccggccgccgtgctctgctgcactgacgaggccgcgctctgctccgcctgcgaccgccgcgtctaccgcgccgacaagcgccgccgcatcccgctcgtccagccctgcggcgacgactccgccgccgccgccgccgcgccgctctgcgacgtctgcaaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgcgctcgtcgaccaggcgcccccctcccctgacgacgacgacgacgacgtcgccgagcccgacgctgtccccgccgcctgcgcggccaaggcctcgtctcttgagtccggcggcggcagcagcatctccgactacctcaccaacatctgcccgggctggcgcgtcgacgatcttctcttggacgactcgtcgttctcagcgccatctaagaccggctacagcgacggccacgatcaggtgccgtccgtggatgccgacctcttccacgtggtggccagcggccggccaggcaagcgcgtcggcgg

SEQ ID NO: 1676 - DNA, 1627 bp, Zea mays
cgggatggtctacaaccgtatgcgtactttatcagttaactgcccatgatctagcagtggtccaatgtttgtcctagactcctagggggaaaaaagatctgcactttgtgctgtgctgtttcttcttcttgttgttgttgtacgtagcgccgagatttcccagcaccgcttgcgatttagaaacccacagtttgttctttttcgtttaggggatggctgtacactgctgctgcttcttactaatgatagaaaggagaggtgaagttcgcagttgctgagatagacagatgatagaaggcaacgctagctaccgcgagggggaggaagatgagcaatcgggaaagcacggcatcaagcaagttgttgccttgtagttgtaggagtgtccttattgcgactttgtcaccctggtgacctgagcgctcccacgcggccatgtctgatgaattacggcggcccattcgctcccatcagcaaacacccacgaatggccaatcgttgcccagcagcagcgggcttcagtattcgtcaaccaaattgtcagagagagtccttttgcgccccccggggcgcatactacagaggaggttgagcggagtaggcggcggccagcaatgaaggtacagtgcgacgtgtgcacggccgaggcggcctccgtcttctgctgcgccgacgaggccgcgctgtgcgacgcatgcgaccgccgtgtccaccgcgccaacaagctcgcggggaagcaccgccgcttctccctcctgcacccgtgttcttcctcttcctcctccgccgcgcacaagccgccgctctgcgacatctgccaggagcggaggggcttcttgttctgcaaggaggacagggcgatcctgtgccgggagtgcgacgcgccggtgcacagcgccagcgacatgacgaggcggcacagccggttcctgctcaccggcgtgcgcctctcgtcagcgccggtggactctgcgggcccatccgaagaggaggagcaggagaacagccgcggcccctgcaacgacgaatcctgcagcagcggcagcggcgccggcggcgcgaccacggcgaccgccagcgacgggagcagcatctccgagtacctgaccaagacgctgcccgggtggcacgtcgaggacttcctcattgacgacgcgtccgctggcgacgtcggcgcctgctcggatggcctctatcagggacaaaatggacagatcagtggggtgctgcaagaagcttacctgccgtggacggagcgggagcaggtgcaaactgacgtcgcagacgagcgggccagctgggagcggtgggtgccacagatgcatgcggagttcggcggcggcggcaagcgacctagagcgtcgccttcgcctccctgttcgtactggtgattggtgaaaagttcgccgtcttcagcaagatgatttgtattgggctaattagtagagctactgtaggaacgaccgaaaaatgagccaaaaaagtaacggcctccatcgagctcgttttaaattattctctgcctaaagccaaactttcagaaaggagaacggtattttcctgttcgattaattaggtcgatttcgatcgaactcgttccaaaaaaaaaaaaaaaaagggcggccgc

SEQ ID NO: 1677 - DNA, 835 bp, Zea mays
ggtctagctaggactagtaagtagcataccattaccatcctccgcgcggctagctccggctcgctttcatccatacgattgcccggagctcaagccctgagctgagccgccagagcgcgcgcgatcatcgcttgagggaaaagcagagtggagtggccgagatgaaggtgcagtgcgacgtgtgcgcggccgaggcggccgaggtgttctgctgcgccgacgaggcggcgctgtgcgacgcgtgcgtaccgccgcgtgcaccgcgccaacaagctcgccggcaagcaccgccgcttctcgctgctcagcccggcgccaccgccgccgccgccgctctgcgacatctgccaggttcactcgatcatccatcccccgatccccgtgcaaaataaatctcttcggacggcgttctttccgattgttcagcctgccaggtgtgccctgcctgcctctgatcgatatgcatgcaggacaagcgggggctcctgttctgcaaggaggaccgcgccatcctgtgccgcgactgcgacgtgtcggtgcacacggccagcgacctgaccatgcgccacgcccggttcctgctcacgggcgtccgcctctccgccgagcccgccgccgcgtgcccggcgccggaggatgaggaggaggaggacgacgagaacagcagcggcagcttctgctgcagcgccggcgacgcagccgcacatcctcctcctcttccgtcgtcggcgcccgccaccagccacgggagcgacagcagcagcatctccgagtacctcaccaagacgctgcccgggtggcacgtcgaggacttcctggtggacgaggcggccgc

SEQ ID NO: 1678 - DNA, 727 bp, Zea mays
  misc_feature (477)..(477): n is a, c, g, or t
  misc_feature (481)..(481): n is a, c, g, or t
  misc_feature (490)..(490): n is a, c, g, or t
  misc_feature (492)..(492): n is a, c, g, or t
  misc_feature (499)..(499): n is a, c, g, or t
  misc_feature (587)..(587): n is a, c, g, or t
  misc_feature (642)..(642): n is a, c, g, or t
  misc_feature (644)..(644): n is a, c, g, or t
  misc_feature (708)..(708): n is a, c, g, or t
ccggccgggctttcctgctaagccccggctagctaggaagtatcactagtagcatcccccatcatccagcctcgcggtcgctacagttagcttcgctttcctccagcccatccttctatacacgattgacctgagctgagccgcctcccgtctcgagagggagggagagggagagggagagcgagagctagcgcgcgcgatcgcaaagagagcggtgaaagatgaaggtgcagtgcgacgtgtgcgcggccgaggcggcgtctgtcttctgctgcgccgacgaggccgcgctgtgcgaggcgtgcgaccgccgcgtgcaccgcgccaacaagctcgccggcaagcaccgccggctctcgctgctcggcccggcggcgccgtcctcgtcggcgcacagacacccgccgccgcctccgctctgcgacatctgccaggagaagcgcgggctcctgttctgcaaggaggaccgggcgatcntgtnccgcgactncnacgtgcnggtgcacacggccagcgagctggcaatgcgccacacccggttcctgctcacgggcgtgcgcctctccgcagagcccgccgcgcgcccnccgccgtcggaggaggacgagaacgacagcagcagcagcagcatctccgagtacntnaccaagacgctgcccgggtggcatgtcgaggacttcctggtggacgagaccgccgccgcaactnccattggcgtctccgcaga

SEQ ID NO: 1679 - protein, 303 aa, Oryza sativa
MTHNSSSSSSWDLDMSLGSHHHPLLFDQPPPPPPPPPPPPLPFHLHHHPLDPSPSSSLFPPPPHHHHHAHHLHHPLDLDQRRGHHDYGGGDQGGDEELRLQQEAAAGGGGGGQDGGGGGDQDADEELGAMKEMMYRIAAMQPVDIDPATIKKPRRRNVRISDDPQSVAARHRRERISERIRILQRLVPGGTKMDTASMLDEAIRYIKFLKRQVQELQHQPGPPPPPYPAGAAPAAGPSTSAVGPPGRPFLPLGGGGPMIDWVGLTRPVDIHGPTSSSSSSSMGGALGFGFGCGGGGQSSHGMH

SEQ ID NO: 1680 - DNA, 731 bp, Glycine max
ctcttttttcacctatataccctctaatattctaattctctctcttgatccaacaaacaaacactaccattttgtttgttctgagtagtgatccatgatggaacctcaacaacaacaacaacaagcacaagggagccaacaacaacaacaaaacgaggatggtggcagtggaaaaggggggtttctgagcaggcaaagtagtacacggtggactccaacaaacgaccagataagaatattgaaggaactttactacaacaatggaattagatccccgagtgcagagcagattcagaggatctctgctaggctgaggcagtacggtaagattgaaggcaagaatgtcttttattggttccagaaccacaaagctcgagaaaggcagaagaaaaggttcacttctgatcataatcataataatgtccccatgcaaagacccccaactaatccttctgctgcttggaaacctgatctagctgatcccattcacaccaccaagtattgtaacatctcttctactgcagggatctcttcggcatcatcttctgttgagatggttactgtgggacagatggggaattatgggtatggttctgtgcccatggagaaaagttttagggactgctcgatatcagctgggggtagcagtggccatgttggattaataaaccacaaacttgggtgggttggtgtggacccatataatttctcaacctatgccaacttctttg

SEQ ID NO: 1681 - protein, 289 aa, Oryza sativa
MDHMQQQQRQQVGGGGGEEVAGRGGVPVCRPSGTRWTPTTEQIKILRELYYSCGIRSPNSEQIQRIAAMLRQYGRIEGKNVFYWFQNHKARERQKKRLTTLDVTTTTAAAADADASHLAVLSLSPTAAGATAPSFPGFYVGNGGAVQTDQANVVNWDCTAMAAEKTFLQDYMGVSGGGGAAAAAPTPWAMTTTTREPETLPLFPVGGGGGDGAHRHAGHGGFPSNFQRWGSAAATTNTITVQQHLQQHNFYSSSSSQLHSQDGPAAGTSLELTLSSYYCSCSPYPAGSM

SEQ ID NO: 1682 - DNA, 1440 bp, Glycine max
gcacacgtacgcaagcgtaagctcgggattcggctcgagcaattatggtttccaatttattaattgtgtgttgagtttttgtttttggattttgggtactaaaaattatgtattggggtttaaatttcatagggttttagaaaaattgatccagataggtgggagtttgcaaatgaaggattccttagagggcacaggcacctgttggcaaacataaggagaaggaaacaaccttcttctcagccttcttcttcttcttcttcatcctcttattattattattcttcttcttctcaacaagcacaacaaggtcactgtgttgaagttggtcgctttggacttgatgaagagattgatcgtttgaggcgtgacaagcacgtgttgatgatggagcttgtgaagctgagacagcagcaacagaacacaaggtcataccttcaagcaatggaggagaggctaagagggacggaaattaagcagcaacaaatgatggctttcttggctagagctttgaaaaatccaacctttattcagcagctacttcagcagaaggagaagaggaaggagcttgaagaggccatgtccaagaagaggagaaggccaattgagagagggccaaaccatggggttgttggagaagaatcaagcagtgttaaggttgagtctcttgtgtttggtgatgaatatggttttggagtgtcagagttggaagtgttagctatggagatgcaaggttatggtaagggaaggagggaacaagaggaggagcctgatgaggcactagatcaatcacaagagaggctggagaaagagcttgatgaagggttctgggaagaacttttcagtgagggttttgagggtgaattggatactaatccaactaattcccaagaccaagatgaagaagaagaagatcatgtcaatgtgttggccaatcgctttggttacttgggttcaagtcctaaatgaaaccaaccacatatagtactcaagattattattggttaacattgttcattaatttggttcaagtggaggcactcatgtggtgaatggaggaggaggcatcccatttggcatgatacatgtggaaatgatttactttttggtgtttctaacccccccattatatgatgatgcatgtccttttgtagaacctaaaaaatttctcacttttctctgtttgattaggtaggttgcagctgttgcttggacaagaatctatggtagtgatagcaatcgttatttactcaaggttcagttttatgtgttttttttttttttaaccactcaaattaaaccccctctcctttgtaatgttcatcttaattaattatattatatatcaaccaagctattgctgtaaaaaaaaaaaaaaaaaaaaaaaaaaaaaaaaaaaaaaaaaaaaaaaaaaaaaaaaaaaaaaaaaaaaaaaaaaaa

SEQ ID NO: 1683 - DNA, 446 bp, Glycine max
ggctcgaggtttcgtggagcagaggaaacaacagcttcgttgtgtgggatcctcaggctttttccatcactcttctccccagatacttcaagcacaacaacttctccagctttgtcagacaactcaacacctatgggtttagaaaggtagatccggataagtgggagtttgctaatgaagggtttcttagaggacagaagcatctattgaagaacataaggagaaagaagacattaactaatcaacaacaagctcttccaatagaccattgtgttgaagtggggaggtttggatcattagatggtgaagttgatgcattgagacgtgacaagcaagttctcatggtggagctagtgaagctcagacaacaacagcagaacacaagatcctttctccattccctttgttgaaccaattgttgcaagaagttggggttcctagatcgc

SEQ ID NO: 1684 - DNA, 385 bp, Oryza sativa
  misc_feature (122)..(122): n is a, c, g, or t
  misc_feature (193)..(193): n is a, c, g, or t
  misc_feature (254)..(254): n is a, c, g, or t
  misc_feature (307)..(307): n is a, c, g, or t
  misc_feature (340)..(340): n is a, c, g, or t
  misc_feature (370)..(370): n is a, c, g, or t
ggatggggcggcggcggtggcggcgggggtggcgccgaggccgatggaggggctgcacgacgccgggccgccgccgttcctgaccaagacgtacgacatggtggacgacgccggcaccgacnccgccgtgtcgtggagcgcgacgagcaacagcttcgtggtgtgggatccccacgccttcgccaccgtcttnctccccaggttcttcaagcacaacaacttctccagcttcgtcaggcagctcaacacctatngtttcagaaaggtggatcctgatcggtgggaatttgcaaatgagaattttctncggggacagagacatcttctcaagaacatcaancgtagaaaaccaccttcccatactgcttcnaaccagcaatccctt

SEQ ID NO: 1685 - protein, 357 aa, Oryza sativa
MNYRVVNPVKVESGPSTGVANGQPPRPMDGLADGGPPPFLTKTYDMVDDPTTDAVVSWSATNNSFVVWDPHLFGNVLLPRYFKHNNFSSFVRQLNTYGFRKVDPDKWEFANEGFLRGQKHLLKSIKRRKPPNSSPSQQSLGSFLEVGHFGYEGEIDQLKRDKHLLMAEVVKLRQEQQNTKSDLQAMEQKLQGTEQKQQHMMAFLSRVMHNPEFIRQLFSQSEMRKELEEFVSKKRRRRIDQGPELDSMGTGSSPEQVSQVMFEPHDPVDSLFNGVPSDLESSSVEANGGKAQQDVASSSSEHGKIKPSNGELNEDFWEDLLHEGGLDEDTRNPAIDDMNLLSQKMGYLNSSSTKSPQ

SEQ ID NO: 1686 - protein, 376 aa, Oryza sativa
MNPLRVIVKEEELDFAAAAAAAAAGEGSPSSWAVGVMDLPRPMEGLGEAGPPPFLCKTYEVVDDPGTDTVISWGFAGNSFVVWDANAFAAVLLPRYFKHSNFSSFVRQLNTYGFRKVDPDRWEFANEGFLRGKKELLKTIKRRRPPPSSPPSSSSSSSSSQHQQQPAAACLEVGQFGRDGVVNRLQRDKSVLIAEVVKLRQEQQTTRAQMQAMEERISAAEQKQQQMTVFLARAMKNPGFLQMLVDRQAGQHGARNRVLEDALSKKRRRPIEYLLTRNGETCAAGESAAMLAADGVAEPDGDTTPRGDGGGGGGGDTESFWMQLLSLGLEEKQREDGVAGGVQESNSGGADVDNDEEDDDDDVDVLVQSIYHLSPK

SEQ ID NO: 1687 - protein, 331 aa, Oryza sativa
MEGLHDAGPPPFLTKTYDMVDDAGTDAAVSWSATSNSFVVWDPHAFATVLLPRFFKHNNFSSFVRQLNTYGFRKVDPDRWEFANENFLRGQRHLLKNIKRRKPPSHTASNQQSLGPYLEVGHFGYDAEIDRLKRDKQLLMAEVVKLRQEQQNTKANLKAMEDRLQGTEQRQQQMMAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGASEQQQIGPQGELNDNFWEELLNEGLVGEENDNPVVEDDMNVLSEKMGYLNSNGPTAGE

SEQ ID NO: 1688 - protein, 283 aa, Oryza sativa
FLVRTNYLNKRSHFYSLRFQGFRKIDPDRWEFANDGFLRGQRHLLKMIKRRRPLSYLPGSQQALGTCLEVGQFGLDEEIDRLKRDKNILLAEVVKLRHKQQSTKANMRAMEERLQHAEQKQVQMMGFLARAMQNPDFFHQLIHQQDKMKGLEDTFSKKRTRSIDIVPFLNPGEVSQGDQLESTLLFDPRPFAELNDEPAKSELENLALNIQGLGKGKQDVNRTRNQPRNQASNETELTDDFWEELLNEGARDDAGIPGMERRRPRYVDALAQKLGYLSNSSQK

SEQ ID NO: 1689 - DNA, 819 bp, Zea mays
acgtatgactatggttgatgacccaaccacgaacgccgttgtgtcatggagtgccgccaacaatagctttgtagtttgggatcctcatatctttgggacggtgctgctgccaaggtacttcaagcacaacaacttctccagctttgttcggcagctcaatacttatgttgccgttcttccgtgtttgtttctgcggctgtggaaccatgcacggagggatgatgcggccgtgtgaaagggcttcagaaaggtggatcctgacagatgggaatttgctaatgaggagtttctgagaggtcagaggcacctcctcaaaaacattaggcgtcggaaacctccacactcatctccaaatcaacaatctcttggctcttacctcgaggtaggacactttggatatgaagaagagattgatcagctgaagagggataaacagctcttgatggctgaggtagtgaagctgaggcaggagcaccaaaatactagatcagatctacaggccatggaagagaaattacaagataccgagcagaagcagcagcagatgatggcattcatggcacgcgtcatgcagaaccctgatttcatgcgtcagctgatctcccagcggaagatgaggaaggagctcgaggatgccatctcgaagaagagaaggcgccgcattgaccagggacatgaagctggtagcatgggcactggttctagcctggagcaagggccacagggagtgtttgaaccgcaggagccggtggaatcactcgccaacggtgtgccatctgatctggagagttcgtctgttgaggcgaagggattggaggt

SEQ ID NO: 1690 - DNA, 2494 bp, Zea mays
  misc_feature (1015)..(1015): n is a, c, g, or t
cattgggtccctcgaggccggccgggatcttcgttctgagctctctctctctctctccctacccaccaaatctcgcagtcgcagcaggtccaggtgctcccgaggaatccattcccaatttgcgttcccactcccaccaccgcttcttcccgtatcccttgtcctccctaatttcctctcacaaaaagcgggtgcggcttcctgccactcacctcggtctcggggggcgccgtgcggcgggcgcccgtgctgctggtttcgctccaggggagaaggggcagagggagtagagcaggttaggtccgtttgcgttttcttttgcgggtttgtaggtcaaaagctccgcgagcactttccgctccacctcctcacgctcggaatcaaatcgatgcccccctgatttggttcctggtatcggtgcatgagcttgctccaagagatctcccttttggttcggcgtcaggggttctgtgaggtcacgcggcttcttcctcttggcgctcctcacatgtccgggcgcttcgatctctgcccactgcgcgagtgattctgctgctgcagcagctgttaggtgcgcgcgggccgttatggggtgaaccgaagcgttcctcgcagggctgtgggtttattacgccgcctgtttgcttccccgcaccttgtccttgtgcccatacttctttgcttttgtcacgcctgaaccgtgtcttcttgtagtatctgaggcttggcagttggcaagtacaaactagcaacttgcttaggtataaagtataaaccagtgtctggtgcagagcccaaaggggtcacgaatcgttgatgcatagatctgcttctggctgagataaggctctaagttcgctctgttgatggggctaccatgagccacgggaacgggatgttgaattctgtcaaggtggagaggtggccagcagcagtcgctgcaaatggccagcctaggccgatggatgtgctccacgacggcagctcgccgccgttccttaccaagacgtatgancatggttgatgacccaaccacgaacgctgttgtgtcatggagtgccgccaacaatagctttgttttgggatcctcatatctttggcacggtgctgctgccaaggtacttcaagcacaacaacttctccagctttgttcggcagctcaatacttatggcttcagaaaggtggatcctgacagatgggaatttgctaatgaggagtttctgagaggtcagaggcacctcctcaaaaacattaggcgtcggaaacctccacactcatctccaaatcaacaatctcttggctcttacctcgaggtaggacactttggatatgaagaagagattgatcagctgaagagggataaacagctcttgatggctgaggtagtgaagctgaggcaggagcaccaaaatactagatcagatctacaggccatggaagagaaattacaagacaccgagcagaagcagcagcagatgatggcattcatggcacgagtcatgcagaaccctgatttcatgcgtcagctgatctcccagcgggagatgaggaaggagctcgaggatgctatctcgaagaagagaaggcgccgcatcgaccagggacatgaagctggtagcatgggcactggttctagcctggagcaagggccacagggagtgtttgaaccgcaggagccggtggaatcagtcgccaacggtctgccatctgatctggagagttcgtctgttgaggcgaagggattcgaggttcgacagggtgtttcttcaggtggttctgagcatctgaatggcaggccaagcggagagttaaatgatgatttctgggaggaccttctgcatgaggggggactcggtgcagatgcaggcaatgctgttggtcaggatgatatgaacatggacatggacccagatgttagcctgcctcaactgaaacaacatggtcccagacattagccgctcttgtgctatcacaatggctgtgactctgtgagtatctttacagttatgctcgttatatccctgtggtgtacctgtttcgatcgtctcttcgaccaaatgtcacgtcgactgcagtctccagttgttaatacagtctgttcagcacgctgatttaagtatttgggtcaagatgttcatataatcctgtggtatccagagatattatagtttgttttcgtaactgtttgcgcagagaccatgctatgttgcctgcaggctatcagtgtatttgttctaacagatcgcaacgctggtacaacgcagtgacctgccagactgggccactatgagattgtagggaaagaccagatagcttgtgtatgtaaaagtggtcattctatcattctatgtatgctgatccatagtagcctatcatgtgcaacgctattgccctttgggatttggcatttcactgtatataacatatcatcggctcatcgccgtattgccgcatccatcggtgtcttggtttacccattgcggccaacccacg

SEQ ID NO: 1691 - DNA, 1398 bp, Zea mays
  misc_feature (11)..(11): n is a, c, g, or t
ccccgggtctncccacccgtctctgcataacaacttctccagcttcgtccgggggctcagcacctatggtttcaggaaggtggatcctgatcggtgggaattcgcgaatgagggctttttacggggacagagacactctcctgagaaacatcaggcgtcgaaaacctcctgctcagaatgccacaaaccagcagtccattgggcctggccttgaggtgggacattttggatatgatgcagagattgacatgtggaagagagacaagcagttactgatggcagaagtggtgaagctaaggcaggagcagcagaacacaaaggcaaatctcaaagcgatggaggataggctacaagggactgaacagaagcagcagcagatgatggcgttcttggcacgtgtcatgcggaatcctgaattcttgaagcacctggtttcccagaatgagatgaggaaggagcttcaagatgctatttcaaagaaaagaagacggcgcatcgaccaagggcctgaagctgatgacttgggggctagtagcagcttggagcaaggttcaccggtcctgtttaatgcccaggacccagttgaattccttgtcgacggaatcccagctgacctcgagagcccagctttcgatggccacggcctgattgggccacatgatattgatattgatattgatattggcagtacctctgagcagcagcaagacatgccccaggaggatctgaatgacaacttctgggagcagttgctgaacgaaggacttggcgaggagaacgatagccctgtaatcgaggatgatatgaatgtgctgtctgagaagatgggttatctcaactcagatggcccaacatctagcaattagtcttggcttcgttgctgttttgttatttccatcttaccagaacccgcagctcctgaattgtgttcactgtgtcagcaagactaggcaattctgcttccgttgctcggtttccatgcccttctgaattcctcgccaatggtagggcttgcttccatgagaattggctggcattcgccatggtgtcaagggagaactgctaggtgcatctgatgtgatctgactagtgattgctgcttgccactggagtggctgttttaggcgacgccagcgatctgttggttgttttacgaccctgcccgtcaggaattcagtctgtagttatgtacagtgacagcgactcagcaagtagtactgatggttatacatgtttctgtcagtggttgtgtgcaaactgtttgtctaatttcatgcggtggaagctttgtagtgttgcggttctgaagtactactggatttcagttcgaattaagtactatactggatttctgttcgaagatctgggtttttttattcacctcaataaagacgacgg

SEQ ID NO: 1692 - DNA, 2460 bp, Zea mays
  misc_feature (2397)..(2397): n is a, c, g, or t
  misc_feature (2422)..(2422): n is a, c, g, or t
cttttttttttttttttttaccaagaatactatacactacacgtctgcactctgcacaaaatgacacagtgtaaccatcacgatcccactcctatatactacaatctacaacaatggagctatcgctaagagaattcactgacccctgtcggagggacaattaagctactgttactagtcgtataggattaattaacgagatcatctctacttcgccgtggtgttattgctcatggagctcaacttctgcgccagcgcgtcgacgtaccaagccggtcgtctcctctccggcggcagcgtctcagcctcggcaccgcccttcatcccttcgttcagcagctcctcccaaaagtcgtcggtgagctccgccgtctcgaacccgccctgctgctggctccgcgcgcggccaccctgcttctcgctcccgtcctgcctgcgcttgccgagcccctggatgttgagcgccaggttctccagctccgacgtggtccctcgctcgtccagctccgcgaacagcgcccgcgtggcggtggggtcgtcgtcgtcgccctgctgctgctcctcctcctgctgctgcaagccgccgttggccggcgcggcgccgatgggccgcctccgcttccgggaggcggcggagagcagcgccgcgccctccagctccctccgcctgccctgctgctgggccagcagctggaacaagtccgggctctgcaccgcccgcgccaggaaccccatcatctgcacctgcttgtgctccgcgtgccgcagccgctcctccatggcccgcatgtccgcccgcgtgctctgctgctcctgccgcagcttcaccacctccgccagcaggatgcttttgtcgcgcctcagccgctccatctctccgtccagccccccgaaccggcccacctccaggcacgacccctgcgactgcgacgcctggaggtacggcggcggcggcgccggcctccgacgcttgatcagccggagaagatgcctctggcccctcaggaatccttcgttcgcgaactcccagctgtccgggtcgatctttctgaagccctgcacgtcgcaaagcgatgaacacgcgcagcgttcagtaagctgcatttccagaagccatcacacactaagaatcgacaaatgccgacgctgaggcgctgagccaattaacaagacaagatggcaaatttatgtaaaacttgaggtttcacataagttttgcgaccgaatttacaggcacgggcagtggtatacactagcagtatattgcttggtggtgagtggtgatcaaaggagtgagtcttctttatctttaggacaaacaagcagtttgtttctttctcgtaggctgtagtagcttcgttcatcccttgtcctggtccatctagctacacagtaacaaggcgaacaaagagcatgtcagaggaatttaacatcttgtcatggagatgctggttctgcaatctcccccattgtcgttctgcttctgaaccattcaaaacatttggccatttttgccattgtatttgctaggccgccaaagaaaaagcaatacgcgttcaacgattgtatcagctccaagtcattgtgaatcacacaaaatgcttatatatatacagacttgttctttcggtaagtaataatagagacagacttgtcgcccgagcccgcccgcgactgtactccccaatgcaagaggcgagatgaactgcagaaccagagcagcgcgcgagcacaaagccaaccagaaacaaaaattcacacgacagcaactgagcaagcagagtacttggggcactcacataggtgttcagctggcggacaaagctggagaagttgttgtgcttaaagaacctggggagcagcacggcggcgaacacgtggggatcccagaccacgaagctgttgccggcgcggccccaggagatgacctcgtcggtggccgggtcggccaccaggtcgaacgtcttggtcaggaacggcggtggcccgacctcgtgcagcccctccatcggccgcggagcgtccgcgtccgcgtccgcgtccgcgtccacgtcctcctcctcctcctcctcctcctcctcctcctcctccggcggccactcctccttcaccgtcaccggcagcatcagctccatctcgccacggctgctgccacccaccaaccaaccaaatgaaacgccaacgtccagaacccccagcgatcaccaggcggtcgcggaggacgcgcagtgccctgcctcgctcgcggagaacccagcgatcaccgcgcggggaaagggaaggggaaaccaaaaaagctgctgtgtcgtctcgctcccccggctgcgcgggaaagtggctgccggcggcgataaatactcctaccggcttgacccttctccaggcctgcccagaggngaatggaacgttctaggccgcgcgncgcgttcgtggccgggcggagctcggaaggttctggac

SEQ ID NO: 1693 - DNA, 994 bp, Zea mays
  misc_feature (985)..(985): n is a, c, g, or t
cttttttttttttttttggtatcctcgagctccttcctcttgtcttgctgctgggccaactgctggaagaactctgggttccgcattgctcttgccaagaaccccatcatctgtacctgcttctgttcagccactcgtagcctttcctccatggctctcacatgatctttagtactttgctgctcctgccttagttttactacttctgtgattaaaatgttcttgtcacgcttcagcctatcaatctcctcctcaaatccaaactcaccaacctccaggcaagaagcaggggcacgttgctgtcgcaatggtgccacagctgatggtggcttccttctctttatcatcttcagcaggtgcctttgacctctgaggaaacccttcatttgcaaactcccccctgtcaggatcaacctttctgaagccataggtgttgagctggcgcacgaagctggagaagttactgtgcttgaagaggcgcgggagcagcccgtcggcgaagacgtgcgggtcccagacgatgaagctgttgccggcgcggctccaggagaggacggcgtcggtggccgggtcctccacaaggtcgaacgtcttggtgaggaaaggcgggggacccacctcgtgcagcccctccatcgggcgcggcgcatccccgccgccacccacaccgtcctgcgtcggcggctgctgctccaggagctcctccttgataatgcccggcgccaccggcttgtccatggcctccgcccaggcccaagaaccccggctcgcgggagccaagcgcccagattgtggcacggaacacggggcaaggactcgattcgagcgattaggagcaggaatcgaccggacgaggagcgaatcgggtattcgggtcggcgcttaggatatttctgtcgggtgggtaggaggtgttgcagcaaagaggacgggggagatgagagcggtcccccggctgtaaaatggggaaaatggtcggtgaatncgggggaag

SEQ ID NO: 1694 - DNA, 1999 bp, Zea mays
ctcgcgggccgatacacgcctcctcgacgcggtatcgccgtatacccgcctcaagtacaaagggaaagctgcgactcgctcggaagtggggtactgtacttcccgctcgctcgctctctgctctggtccttcacgctctaaccttcagttgaggttctctaatcgggcccgctaaagtcgagagacaggttttcgcgaacatttgcatctagccatctctactcaactgaattcttgtgctcttgtggcattcacaaagtccattttcagactgagctagttcagctgtcattttttttttcagccaaaggtcgcgttcttttggacctgctcttgattcgttcgttcgttcgtttggattgattgattgattgattcctttcgacttcccttcaccacccccctgctccgtcaagcgtgcctctgttcttctgccattgctggatcgcgtttgtctgtttgttgggttgctggcgctgcggccatggatcccttccacggcattgtgaaggaggagttcgacttggacttcgacttcacctgcgcgtctgcggcggcggcggcggcggcctcgtgggccgtcgccttgccggagatgccccggccgatggaaggactcggcgaggtgggacccactccgttcctgaccaagacatacgacgtcgtggacgaccccaacaccgacaccatcgtctcttgggggttcgccggaaccagcttcgtcgtctgggacgccaacgccttcgccttggtgatcctcccacgctacttcaagcacagcaacttctccagcttcgtccgccagctcaacacctacgggttcaggaaggttgacccggacaggtgggagttcgcgaacgaggggttccagcgtggccagagggagctcctcaggacgatcaagcgccggcgcccgccgtcgagcccgtcggcgcagcaggggcaggcgccgtcggcctgcctggaggtgcggccgcgcgggcgcgcccgcgggcggccccggcggcagcgcgacagggggatcctgctcgcggaggtggtgaagctgcggcaggagcagcaggcgacgcgcgcgcagatgcaggccatggagaagcgcatcaccacggcggagcagaagcagcagcagatgacggtgttcctcgcgcgtgccatgaagaacccgagcttcatccggatgctggtcgaccgggagggccttggcggctgccgcagggagctcgaggacgcgctctccagaaagcgccgccgccccatcgagtacctcccgcgcgacggcgagagaagcggcactgccacggagtcggcggtgagcgactacatttccggacttccggtcggcgtcaacggcgtggcggaggcggacgacgacgagagacggtgggagagaaggggcggcggcggcggcggcgaggacacggagagcttctgggcgaagttgctcaacctcggcctggaggagaagcacagggagggcagatgcgatggcgaggaggggaacggagctgacgtggacaacgacgtggacgacgacgtggatgtgctggtgcagagcatctaccacttgaacccgaacccgggtagccccggtggcaagtgaaagttccagaacgttccacattccagaacccactatggtctatggaagtggaagctcccagtgggcatcgcaattagtcgtaggcgatagttttttatccggcgcctgacttcttgtcgcggggctatgcaagttgcaaaagtgcttgcgtttggccggttgccaaggaatgttcgggatgctcgtcgaactacgaagcttctagaagatggagcagcgaggctgcagcctactcgtatattactatcagggagcaggcgagcagcaaggctgcagcctactcgtatatttactatcaatggcgcgggcttcttcgctgcggtttaaaaaaaaaaaaaaaaaaaaaaaaaaaaaaaaaaaaaaaaaaaaaaaaaaaaaaaaaaaaaaaaaaaaaaaaaa

SEQ ID NO: 1695 - protein, 338 aa, Oryza sativa
MAHEMMGGFFGHPPPPPATAAVGEEEDEVVEETEEGGHGGGVQGKLCARGHWRPAEDAKLKDLVAQYGPQNWNLIAEKLDGRSGKSCRLRWFNQLDPRINRRAFTEEEEERLMAAHRAYGNKWALIARLFPGRTDNAVKNHWHVLMARRHREQSGAFRRRKPSSSSASPAPAPAPPPPPQPVVALHHHHHRYSQQYSGYSGAAESDESASTCTTDLSLSSGSAAAAAAAAAAANIPCCFYQSTPRASSSSTAACRAPRVAAAADTVAFFPGAGYDFAAAPHAMAPAAASTFAPSARSAFSAPAGRGEPPGAVDQRGGAQATTDSHTIPFFDFLGVGAT

SEQ ID NO: 1696 - DNA, 737 bp, Zea mays
  misc_feature (649)..(649): n is a, c, g, or t
  misc_feature (688)..(688): n is a, c, g, or t
aagctgacagagagagctagcaacgctctgcaagatccgccatctaaactttgcagcactctactccaccactctcctccgtctgcgactgcgactaggtcccaaatggccgctccaccggtggccgccgctctgtctgcgctccatgaggcacaagagacccacggccatgacgacagccgcgctgggcacgcgagaggccactggcggccagccgaggatgccaagctcaaggacctcgtggcgctgtacggccccaagaactggaacctcatcgccagcaaactccacggcagatcagggaaaagctgccggctgcggtggttcaaccagctggacccgcgggtcaaccgccgcccgttctcggcggcggaggagcagcggctggtggcggcgcaccgcgcccacggcaacaagtgggcgctcatcgcgcgcctcttcccaggccgcaccgacaacgccgtcaagaaccactggcacgtcctcacggcgcgcaggcagcgggagcggaccggcgcgccgccgcgccgacgcaagccctcctcgtcgtcacccgccgcccaccaccaccgtgcaccatctcctctgccgttctgcgccggcaaggccacccgaccccgctcggtgcggcgacggcgacggcgacggnggcgggtccgacgagtccgcgtcgtccacctcctccggnaccgacctctcctccctaggctccgtgtgcgcccccgccgtcccctgct

SEQ ID NO: 1697 - DNA, 828 bp, Zea mays
  misc_feature (15)..(15): n is a, c, g, or t
  misc_feature (803)..(803): n is a, c, g, or t
cattgggtacctcgnagccggccgggctgactgacctcagcctcaggctcagctgcaccgatcatccatccccatacaaagacactgtatacatacattttaacaacaacaaggtttagctccgcatggcctattactgcaatgcttgctgcgcagggaagagctgccgcctccgctggttcaaccagctagacccccggatcagcaagcgccccttcagcgacgaggaggaggagcgcctgatggctgcgcaccgcttctacggcaacaagtgggccatgatcgcgcgcctcttccccggccgcacggacaacgccgtgaagaaccactggcacgtcatcatggcgcgcaagtaccgcgagcagtccacggcctaccgccgccgcaagctcaaccaggcagtccagcggaagctcgaggcagcctccgccgcggtcgcaatgccgccgggcgcgggcgcgggagacgtcgccgtcggccagcaccaccacctgctggccgccgccgcggcggcccacgcccacgacgccgcctacagcttcgccgcggacccctacggcttcggcatccgccaccaatactgcaccttcccgttcccgccaggcgccgcttcggctgaggacccgccgccgccagcgttcatagatttcctcggggtcggagccacatgaacgcgcgcgcatgtgcatgcatgctcgacttcaccacgcgccttgcagttgcatgtagtgggatctagctaggacaggtagctcgagcagcctctatctagtatctagctagctacctttgccatatatgangagtaagtacatcgatccaaggctt

SEQ ID NO: 1698 - DNA, 1441 bp, Zea mays
ccacgcgtccggtctcctctccccatcttctctcctggaagccgcctcggtcggacccggacaagatggccgccttcttcggtgctgcaccgccgccggctctcgcttcgttccgccacgaggaggaggaggagcagcatcaggacgccgccgaggaggtgtaccacgtggacgatgtcgacgagggcagcggtgacggccgtggccacggcggcgccggccaggggaagctgtgcgccaggggccactggcgccccgccgaggacgccaagctcaaggagctcgtcgcgcagttcgggccccagaactggaacctcatcgccgagaggctggacggcagatcagggaagagctgccgcctgcggtggttcaaccagctggacccgcggatcaaccggcgcgccttctcggaggaggaggaggagcggctcctggcggcgcaccgcgcgtacggcaacaagtgggctctcatcgcgcgcctcttcccgggccgcaccgacaacgccgtcaagaaccactggcacgtcctcatggcgcgcaggcagcgggagcactcgggcgcgctccgccgccgcaagccctcctcgacctcgccctcgccggcgccggcgccggcgccgcacctggcgcccgtcgtcgtcctccaccaccaccaccactacgccggcggctcccctcccatgccgccgttgcacgccgccgacgcccacacgcagtacacggcagcggcggcggcagcggacacccgcgcgcacagcggcggcgagtccgacgagaccgcctccacgtgcaccaccgacctctccctcgcttccgccgccccctgcttctaccagagtggctacgacgtggccccgcgcgccgcggcgttcgcaccgagcgcgcgctccgccttctccgcgccgccggcgacggcgcgctccgacgacaaggtctcgctgcccttcttcgacttcctcggcgtcggcgcggcgtgatgggggggccggcccgggccggccaggcggcggtgtacaggagggcggaggcggtcaaaggacgagagccccggcggcggtgaacccgtgcccgcgcgtagtttagctttagagcccgagttaaatcatcgagaacagaacatggcctgagcttgagagaggaggagaatggcgatccaccattgaactggtgcccgtggcattgcagactaacagctccgcatccgttcggctgctgatgttgctagtagtaatggtacggtgattactctctgctttgggttgggagagacgaatctgcaagcaccaccagaccaagcaagggcgacgatgggtatgggtggatgtttgcagaagaagaaaaaaccgcttgtaacacaaactgcaggacaaaggcagatcagagatcctctgctaactctctttttacaaaaaaaaaacccaagggcggccgctctagagga

SEQ ID NO: 1699 - DNA, 616 bp, Glycine max
  misc_feature (548)..(548): n is a, c, g, or t
ttcgttctttgacgcccgggcccgtcttgtcctccctccttcttcttctctcccctgcttctctttctccttccaaatcactcctataattttcaagtccaagggggtatttgtgaaggaaccctaaaatataattttttgaccaaagatggggagaggtaagattgcgattcgaaggatcgacaactccactagccggcaagtgactttctcaaagagaagaaatggattgctgaagaaagctagagaattatcaattctttgtgatgctgaagttggattgatggtgttctccagcactgggaagctttatgactatgcaagcacaagcatgaaagcggttattgaacgctacaacaagctaaaagaggaaccccatcacctcatgaatccggcttcagaagcgaagttttggcagacagaagcagcaagcttgaggcagcagcttcagtacttgcaggaatgccacaggcaattaatgggggaagaacttatgggtttgggtattaaagaactacaaagtctggaaaaccaactggagatgagtntaaagggtgtccgcatgataaatgaccagattgtaactaatgagatcgaagaactacgcctaaatgga

SEQ ID NO: 1700 - DNA, 1019 bp, Glycine max
gggcgggtggaagaatttcttccttgatttgagtcttggtttctcataagatgctttcattgtttcttacatacatgctagggttgccttttctttttctgataatttcaaattaaaatctttaagccaatttgtctgtggtctatatgccacaacatttatacgaagacatcgaggtttaaatctgagtccatttttcttgatagcaattgtgaaacacacgcatcctgtatatggatcaatgcaattgcaatctgcccatttttgtagttcctgaaggtgccttgtagtgttgttgctggtgcttggctggcttagctggagattcacaggcacttgcaaatcctctcctatgcctagaccatttgtgagaacagaatctctgtttgtttcgttatcatcttgtgttccatagaccttcttatacagttccacattttcttggtgtatgaggtttccctttcgatttagctcttgtatttcacccattaaaagttgatcctttttcattcggacaccatgaaggctaatttctaattggttctccaaatttggtaattctttgactgtcaagcctgacagttcttcccccatcattttcctgcggtgactttcttgcaaattgtgtaattgttgccttaacattgctgcctccctttgccaaaatttaatttcagaggctgaactcccaagttgacaaggttcttcttttgatttgctgtatcggtccattactgatttcatgctggagctggcgaaatcgtagagttttccggtgctggagaagatcataactccgacttcagcatcgcacaagatcgcaagctccttcgccttcttcagcaaaccgttccttcgcttcgagaacgtcacttgcctgctcgtggaattgtcgatcctccttatcacgatcttacctctccccataccaaaccctaacaatcagatccttccgaaccagaaattcactcgtgaggagcgcgttgattataacagacaaagcgcccttcgagccgaat

SEQ ID NO: 1701 - protein, 99 aa, Oryza sativa
MGRGKIVIRRIDNSTSRQVTFSKRRNGIFKKAKELAILCDAEVGLVIFSSTGRLYEYASTSMKSVIDRYGRAKEEQQHVANPNSELKEFCSVFIYITEN

SEQ ID NO: 1702 - protein, 255 aa, Oryza sativa
MGRGKIAIKRIDNTMNRQVTFSKRRGGLMKKARELAILCDADVGLIVFSCTGRLYDFSSSSMKSIIERYQEAGEEHCRLLNPMSEAKFWQREVTTLRQQVQNLHHNNSFYLSANYLNENSAYYFIRINQYEGENEIFFKAHVEIHVSNKRQLLGEEISNFTVRDLQLLQNQVEMSLHSIRNKKGSLVQKENSELRKKFNIAHQRNIELHKKLNSGESTSSEQVTRSSKDPGESSTPRDSRVCIDLELSQKEVEDE

SEQ ID NO: 1703 - DNA, 1903 bp, Zea mays
  misc_feature (248)..(248): n is a, c, g, or t
aatccttactatattaggcataaaattaggtgtagtttatttatttactggtactacttctttagtcataattaggtgtactagcagctacgccctgacggagacaagcacacacaatagaaaagagcgccctcgtgctcagagtgctcgcctttagtttcgtggctactatatactagttgcgacgatttttattttctttctcttctgggctatcattagcacggccatttaggggtaatgagcancggccaataaacaaagccctgagatgcatggggtagccaatcgggtgtcgccgtgcgcgcgcgcgcgcgtctggcctcctccttccctttccttgctaaataaagcaagtagcagataggggaaagtctgctcgcaagttgcatccgccctgcgccaagaaaagccatcgttcttcccccgcccgcacacatagaagcatcattcccctctcggctagcttcctcctctctccctcctcttcgtcttcctctttccttctcccttgggaaacctgctgcctttgagctttcttcttcgagtgctcccaccagatctcctcctccttaccttctttggcacgttcggcggcgcgcgcggagatagatagatcccgccatcgtcgtcgccgtccttgcttccgatcggagggccacaaccacaacctctcgctccttagcgtgcgcgcgcgagccagggtcaagaagagagctagctataggccggagatcgatgggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgccaaccccggccccgtcctcaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatgaagaagagtaaaactgccgtcttatgatgctgaaggaaactatttattgtgaagagatgatactcagagaaagacatatttgtggcagggagatttgagatatgaacttataaatgtaatgcaaataattttcagactggaatggggtcgtggaattcagaggatgattgctttctagttgcatttgatgtttgatgagacttttctcatgtgaaacgtttattaaaacttcaaaatggtgcagatgttgctactacacttgttaggcttgtataaatatctgcccttgggtactagctttacgaaaacagaaaagaagacagacagccgtgataggggacaatgatgcgatctaggagtacaaacagagtctagtttccactcagttgagttttatattgctctcaagcgttatcaagggtttagtaggatacagatataa

SEQ ID NO: 1704 - DNA, 1031 bp, Zea mays
gcgcgagagagaaagagagcagcttctccatctagctagtagttagagagatgtagtactagctagctagctagtaccaccggcgacaaggtagttaggtttctcctctttctctctctagatctgtgctgctaggaaggatcggagatggggagagggaagatagagatcaagaggatcgacagcgcgacgagccggcaggtgaccttctccaagcgccgcagcgggctgttcaagaaggccaaggagctcgccatcctttgcgatgccgaggtcggcctcgccgtcttctccagcaccggccgcctgtatgacttcgctagcaccagcatgaaatgtgtgattgaaagatacagcgaggcaagagaggaacaccgtcagactatgagcgcaagtgctgaggccaaggcagttgttgggtcagcagctttctggcctgaacgtgggagatttgcagaatttagagaataagctggagacgagcctaagaaatattcgtctgaaaaaggaccaacttattttttatcagattcaagaattaaacaggaagggaagcctcatgcaccaggaaagcatagaactatacaacaaagttaaccttcttcatcaacataacactgaattacagagaaaggtgtatggacaaggagtaaataatgagcaaacaagtactactgttagacacagtacccgggatacagagaatcttccgatcaatcttgagctaagtgtgcaaagggacaaatcagaaacaccaagtgtaggcctgtagggtgagatttttgtccaaacttcaggataacacagagtcagtaaaccagatgatttaataaagaacactgaaagtgccataagactttaaatgcagtgaggatacctaagccgagtgataagaaatggatatcgttggtggaattgtaagacctaacagctaaactttaagctgctagatgcgattgtttatgtatgaagaagaatgttgattttaatttagcttttcatataaaaaaaaaaaaaaaatacccacacac

SEQ ID NO: 1705 - DNA, 2420 bp, Zea mays
gaattcccgggtcgacccacgcgtccgcccacgcgtccggtcgtcctcttctctcgcctccaataattcgtaaccattctccttccaggccgggctcctgctggccggagttcccatctccctctttccttctcggttactatccgtgagtgtgcctgcccccgtgtgtgcgcgtgcaagatcgaccgggcgcagcttcacgatggggcgcggcaagatagtgatccgccggatcgacaactccacgagccggcaggtgacgttctccaagcggcggaacgggatcttcaagaaggcaagggagctcgccatactctgcgacgcagaggtcgggttggtcatcttctccagcaccggtcgtctctatgaatacgccagcacaagcataaagtcagtgattgatcgatatggtcgagcaaaggaggaggagcatgtagcagaccccaacacagagcttaagttctggcaaagggaggcagcaagcttgagacaacaactgcacaacttgcaagaaaatcatcggtacgtcaacaaaaccctgcaagttttacagatgcatcattcagaaaattgccaaatgtaaggaagatcaataaaagaattgtcagcatgagcacaaatacaaaacgtctgagtacagaaacacaagggattttttaaacaagaaaatccattctgctttttaaagaaacatatataaagtggtttaaaacaacaacaaatctgcgctgctggatcaaccttaaggagtaaggaccacgaggtaactagaacacctccaacatcgaacttgtgcagtgtatgaattagtatagcaatatgtgagaataattttagcatacaaaatgcataacaacagaacctagtttagggacgtggtaatgatgccataggataatacatggtttatgcagacatcagttttcacaagcaagagaaatgtaaaaggatgcaaaggcttgtgaacttcatgtgccaaaccatttatcaatagaaaactgtacatttagttatcttatgcattattattaacgtccaaagaagcagatacacaacattattgtaattttgtatgattaacccaaagcagcagatacacaccatcatatttaaatgtatttatttttttgcctactagtttttgagcgctctgatttgtaatcactctattccaagtaacagtactaaaggcatctgcagtgtaggaaatgaaggtgtcataagaccttaaagccgataaggtcagaaagcggtatttaacccaaaaaacttagaaccagaccattagcttaatacctggcctcagcaaattaaaaaaaacacaagcgaaggcaagaaactcctctcccacaggtgtgtggcagacaatggcaactgtggcctcccacaggaggacgcagctgcctcacgctgcagggagtggaaagggcctctagggcctcctgcagctagcggcgaggacctcgcatggaggaaggaggaggcgctgtgagcaggacacttggcgacggggaagacaaagcagcagagaggaagaggcctcattgagctcactttacggccattgggagtgccaggtgccctaacgcatacatagccagaagccgaatccttaaaaaggaacacgatatgatcaagcaacaagacccttttacattaaaatacagtcaaactcgaattgtaaaaactaagtgagattgtttgactggctgtaggcagttgatgggacaaaatctttctggactaggtgtcaagggacttcaaaatctagaaaatcagctagagatgagcatttgttgcatccggacaaaaaaggaccaactcttggttgacgaaattcacgaactgaatcgaaagggaagtctcatccaacaagacaacatgggattacacagaaaggtcaacctaattcgtcaagaaaatgccgaattatataagaagctctatgagaaagaagcagaaggtgaagtcaaccgagattcaacaactccgtacaactttgtagttgcagagggtgccaacgttcctatccatcttgagcttaatattccactgcaagaaaatggtgttgagcaacctgtggctcctaaattagggttgcaattaaatcaatgaagacatgcaggacattgcctttgttctcattgtccttgaagtctgcaactcaaagcagcctaaaatgataggttgtaacaggcctaaaaacattgcaagacaaataaagtatgcatgccagagacagtggcaatggtagtgcaaatctatctcaaataacttgtgttatattgaataatccagcaaatggtttgttttttacacgttatgcaagtttgtttgaccaaaatggtatgtaacatgtacaaatttccaagtgaacttattgaaaaaattctataaaaaaaaaaaaaaagggcggccgc

SEQ ID NO: 1706 - DNA, 1379 bp, Oryza sativa
tttggtgttggtggtaatgctatcactggaagggatttcatttatttacttgataagtacaagccatctttgcagtgggatgagaaaagttcagagcattttttcgtctattcagataaaggtttgagacatgctgtattctacccaacgctgatgtccctttctttacgtttggatgaagctcaagattggggaacagggctttcaatttgggaaattgggcaaggtttggactattttttcgatgttctttaggaatatctcacgtgtgttctttttattttgggagcaatgtcagttagaccacaactattgcaaagtattacaaggtcacccgtggacattatttgtttagcatcaaaactgtcacttcataactgattacatccttctgggaaatgtttccaaacaccaaatttccccttcagtgtactgctgcaaaatttagattaagtgatatgagatttttcatcttctttacagaataaacatggttgcttgtttactttagttacttcacttggtagtactatactgcctcattccttaagcaagtatgatgatgttggtctggttttgttattagcacatcatgctctgtgtatattaatgtaatacactttacatttggtacagcaatcttatagttatgcaactgtgcaattcccattattgtgagccagcttgtgatgcaattctaatagatcaaagaacaataaatagtcatggaataaacacattaattttgcattcagtttttcctccccttttgcatcaggcataagactgaggcaacacaaattatctaaattatagcctacttttagggcctaaatccttttctaaaaaagtttgcttctaaattgtacgctacttttagggcatacaccctttttccccccttatgtattctggtgctttactgcccagaacatttctacttcttttgctgttcttccagggattcttccagctataagttcccacctgttcccaacaagcctgtgcattctgaaaacgagatcttcctcttcttccgtgaaatgaacaaaattctgtgcagtgttattaacttcttttgtttcacaaccatcactggttttggaattctttccctggctaccactgctgctatccattaggcgtgaaaaactccaatgaaatgccgagttgagatcttgtgctagctaagatcctcagacccttgttatgaccttatgttttctagggcccttctctccggccggatgagcaaaactctggtttttaaagagatgggagttggtagtcaccttctgatctagctgtcctgagtactgactaatgctgctggctgttggatttcccctagtcttccattggctcccttatctgtaaga

SEQ ID NO: 1707 - DNA, 1031 bp, Glycine max
tcctctaaagcggccgcttttttttttttttttttttttttttttttacccaaaagaagcaatatctttttattctaacccaatggaagataagagcacaccccaatcaagaagggtgcttctataggataacaatggtgataaggcaaacagaaaaaaaaaggcactctatccaaataagaaaaacagagctcaggaaactagctagcttacattgcatattaagacatcaggctttggctgttggaagtttttgggatttttgattcttgctcatgtgaacatacaatacaaagtggtttttattatataccttgggttgtaagaaaccaaagggtgacagaagagagagagctttgtgaacactttggcttcatctgatgttgaaagacttgtagccggaactccctggtaggttcatctgaattctctccctctcatttgcaagcctgcagtgtgttgtttccttagggtgatggcctttggtgctgccctcattggaagcttccgggttgcttttccggcgccgctcgttgtgtccggccaaccggcggcggcagcttctcttggattcatcaaactctgccaggtcatggaacctgctacattgctggcaaaacctctgccttagccctgcaaccaccacaacaggtgcctttgaatgaaactcacacaccttgtggcggcgatggtacctctttgcatcagttaaatcagcaccacacctctctgcttgacatgaaggtggagaaacccctccactacctccacttgaccctcttctcccaccactactaccaacccctttcttcttctcttcttcagtaatactaacgccactttcatcctcctcctctacttcattttccacttcctcttccactgtgctattctttctcaccctctcaaacaatgctctctccctctccattgtgcaaaggggtggtgacaatgatgaaggatatgcttgttgttgagctaggacttttggagccccttctgtctcttctcgcagccgtacggacgcgtgg

SEQ ID NO: 1708 - DNA, 1403 bp, Oryza sativa
ggtctctctctctccctctctcctcctcctcctcctcctccgccttccacttccacttccactcatgagctcgagctcgagctagctctagctctctccaccctcctccagccaccgcttccacctcccctaggaggctagcacacagcacacagtagcactagctcgtcgtcgatcacgcgcgccaccgcccatggaccgcaaggacaaggcccgcaagaacttctcctcgtcgtcctcctcctcggccgcgtccatggccgcgctcgccgccgcggcggccgcgggggacggcggggcggcgctgccgtcccccatggaggaggacaagaagcccaggctggtggcgtcgtcgctggcgcccgtggcaggcggcggcggcggcggttcctcctcgtccgctgctgttgctgctggcgcgtcttctagctcctcctcctcctcggtggccgcggcggcgaggaggggcgcgggccgtgccggcggtggcgccccgtcgggcggcggcggcgggccgaggtgccaggtggagaggtgcggcgtcgacctcagcgaggctgggcggtacaaccggaggcacaaggtgtgccagacgcactccaaggagcccgtcgtcctcgtcgctggcctccgtcagcgcttctgccagcaatgcagccggttccatgagctgacggagttcgacgacgcgaagaggagctgccggcggcggctggccgggcacaacgagcggcgccggaagagcgcggcggacacggcgcacggcgagaactgccgccacgccgaccaggacgccggccggagccaccagggcaccgggaacccgccgttccagatcagataaacctacctaagcatgctccctctcttctgtcatgcagccatgctagtgtgagtgtgtgtgttcgtgccactactactactacatgtctacatcgatctatctacctatatatatccaccacctacgtcccttcttcctcaaatcaatcaaatctatctatctatctatttatctatccctgaatctatctctatccggtgtgctttgctgctgctgattaactggcagtgtgatcatctccctctactgctgctacatatatgcagtgctatgctggagaggcataaatgtgctatatatatgttctctgccacaaccctaagctaattgtaacctgttgattaagcaggtgttctagggattctctctctctctctctgtgtgagggtgtgtttgatgtgtaattgtactattgcctttgcccaacagaaacttgtaggctgcagtgtgcctatgtatgctgttgtgccgggatggcagtggtaatatatgctgtttgagtcaaaaaaaaaaaaaaaaaaaaaaaaaaactcgagactagttctctctctcctcgtgc

SEQ ID NO: 1709 - DNA, 777 bp, Zea mays
tatgccggactcctcctcctccgccggcacaggcggcatggccccctcgagctcggcggcgccgggccgagctgccaggtcgagcggtgcagcgccgacatgggcgtggagaagcggtacaaccggaggcacaaggtgtgcgacgcgcaccgcaaggcgtccgtcgtcctcctggccggcctccgccagcgcttctgccagcaatgcagccggtaagccccgcctgcctgcttgctcggaggcacatgcacatgggcgcagtgcagtgtgcagtccggccggcgtgcgtgactcgtacgtgagtgagttcgtgacatgctcaaaggcaccggccgctttcagtttgtacgggtactactactactaaactaaacgagcttaattcgaccttgaaaagtaaacttgcttgcctgaagcgcatcgggtcccttgagaaagcttgcagctttttttcttgggtcatggatagcacggtgagctgctggattggatcctaagctagctaggttgctctctcaactcaagatcttgcagaagcgtctctcagtctcatgcaacctctttggaggttattaatcaaaccgtgctagctcctctgcctggagcttctctccgcctgtgtcactctttcttgacccccggccctcgtctgctcgcaggttccacgagctgtcgcacttcgacgacaccaagcgcagctgccgcctgcgcctgggcgggcacaacgagcggcgccgggagaacccggcggaggcgcaagaccagcacggcgggcgg

SEQ ID NO: 1710 - DNA, 1108 bp, Zea mays
gcggcgtccggcgacggctcggacgactccggggcggccaacaacaacggcgcgctgccgctgccgctgccgccgccgcacggggtggaggacaacaacagtcccgcggagctggcgggcgcgggtggcacctcccgggcggtggcgaggagggtcgcggcggccggcgcctccccggcggcggcggcgaggaggggcgccgccttgaacgccgcggcggccggcggcgccgggccgagctgccaggtcgagcggtgcagcgccgacatgggcgtggagaagcggtacaaccggaggcacaaggtgtgcgacgcgcaccgcaaggcgtccgtcgtcctcctggccggcctccgccagcgcttctgccagcaatgcagccggttccacgagctgtcgcacttcgacgacaccaagcgcagctgccgcctgcgcctggcggggcacaacgagcggcgccggaggaaccccgcggaggcgcaggaccagcacggcgggcggggcgacccggggagccaccacctccagatcagataaaaacctactacgtcagcatgctctctctcttctgtcatgcaggacgcacgcacctagcgtcgtcaccgatccatagtccgatatgtgtctcaagtgttgtgtgtgcgcgctctcgccgcctacccctgtcctgcagtgttgcgtagtatatggttctacgacctacacgtactgctgctactactgcgtgctaactttaatctgatggcagtccacagctagctagcacatcacctcctgtaagtaatgtgcttatctatatgtgcaccgaccggaaccggaggcgtgcgtacctacgctgatctgccacgaagcctactagtagttaaatgtaacgtaacctgcaggcaattaagcagggcgctgctatatatagcgtaattaattgtgcgtatgggtatggtggttcgattatcggatgtgtaatccctgtacgtggccgggcccgtgccaaagcgtacggtgacctgtgcaggctctgtgtgtcgatgatgttgtactctgataatgatataatccattgtggtaatgtatgctatttaaaaaaaaaaaaaaaaaaaaaaggcggcgctcg

SEQ ID NO: 1711 - DNA, 1699 bp, Arabidopsis thaliana; identical to SEQ ID NO: 5

SEQ ID NO: 1712 - protein, 334 aa, Arabidopsis thaliana; identical to SEQ ID NO: 6

SEQ ID NO: 1713 - DNA, 1246 bp, Arabidopsis thaliana; identical to SEQ ID NO: 13

SEQ ID NO: 1714 - protein, 352 aa, Arabidopsis thaliana; identical to SEQ ID NO: 14

SEQ ID NO: 1715 - DNA, 831 bp, Arabidopsis thaliana
gtgtcggtgaattttttgaaacttcttctcttttgcggtttcgtgttccactcctctcttcttggcccacgtgttcatcaatctctccctccgcatgtaatcgcttcgccgtcaatatcacatctttcttcttctttatctttaaaatctctttagatcgattcttttgtggattcttgaaatctccggagaaaaccactatggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattaggaaagcaaaaaatagaaacaaaaaaaaaaaaaaaaaaaaa

SEQ ID NO: 1716 - protein, 196 aa, Arabidopsis thaliana
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 1717 - DNA, 1025 bp, Arabidopsis thaliana
cctcttcaattctctgtttcctccaaaatggctacaccaaacgaagtatcagctcttttcctcatcaagaagtatctcctcgacgaattgtctccgttgcctactactgccaccaccaatcgatggatgaacgatttcacgtcatttgatcaaaccggtttcgagttttctgaatttgaaaccaaaccggaaataatcgatctcgtcactcccaaaccggagatttttgatttcgatgtgaaatctgaaattccatctgaatcgaacgattccttcacgttccaatcgaatcctcctcgcgttactgttcaatccaatcgaaaaccgccgttgaagatcgcaccaccgaaccgaaccaagtggattcaattcgcaaccggaaatcctaaaccggaacttcccgtaccggttgtagcagcagaggagaagaggcattacagaggagtgaggatgaggccgtgggggaaattcgcggcggagattcgagacccgactcgtcgtggaactcgtgtttggctcgggacgtttgagacggcgatcgaagcggctagagcttacgacaaagaagcgtttagactacgaggatcaaaggcgattctgaatttcccgcttgaagttgacaagtggaatccacgcgctgaagatggtcgtggcctgtacaacaaacggaagagagacggcgaggaggaggaagtgacggtggttgagaaagtgctaaagacggaggagagttacgacgttagcggcggcgagaatgttgagtcaggtttgacggcgatagatgactgggatttgacggagtttctgagcatgccgcttttatcgccgttatctccacacccaccgtttggttatccacaattgaccgttgtttgaattctatttttctgtttgggtcagcttgttgtatgctgacgtggaattatgctatatcttttgcttattttatgttcacattcgagcaaaatttattcattcgtttatttgttttttaatacaactcttgatatttctaaattctaacc

SEQ ID NO: 1718 - protein, 282 aa, Arabidopsis thaliana
MATPNEVSALFLIKKYLLDELSPLPTTATTNRWMNDFTSFDQTGFEFSEFETKPEIIDLVTPKPEIFDFDVKSEIPSESNDSFTFQSNPPRVTVQSNRKPPLKIAPPNRTKWIQFATGNPKPELPVPVVAAEEKRHYRGVRMRPWGKFAAEIRDPTRRGTRVWLGTFETAIEAARAYDKEAFRLRGSKAILNFPLEVDKWNPRAEDGRGLYNKRKRDGEEEEVTVVEKVLKTEESYDVSGGENVESGLTAIDDWDLTEFLSMPLLSPLSPHPPFGYPQLTVV

SEQ ID NO: 1719 - DNA, 929 bp, Arabidopsis thaliana; identical to SEQ ID NO: 43

SEQ ID NO: 1720 - protein, 213 aa, Arabidopsis thaliana; identical to SEQ ID NO: 44

SEQ ID NO: 1721 - DNA, 803 bp, Arabidopsis thaliana; identical to SEQ ID NO: 45

SEQ ID NO: 1722 - protein, 207 aa, Arabidopsis thaliana; identical to SEQ ID NO: 46

SEQ ID NO: 1723 - DNA, 908 bp, Arabidopsis thaliana; identical to SEQ ID NO: 47
  misc_feature (851)..(851): n is a, c, g, or t

SEQ ID NO: 1724 - protein, 216 aa, Arabidopsis thaliana; identical to SEQ ID NO: 48

SEQ ID NO: 1725 - DNA, 909 bp, Arabidopsis thaliana; identical to SEQ ID NO: 49

SEQ ID NO: 1726 - protein, 201 aa, Arabidopsis thaliana; identical to SEQ ID NO: 50

SEQ ID NO: 1727 - DNA, 820 bp, Arabidopsis thaliana
gagtggaaaatcaaaatactgttgttgattagggttaattaaattagaagaatggtgaggggaaagacagagatgaagaggatagagaacgcaacgagcaggcaagtgactttctcaaaaagaagaaatggacttttgaagaaagcttttgaattatcagtcctttgtgatgctgaagttgccctaatcatcttctctcctagaggcaaactctatgagttctctagctcctccagtatacctaaaacagtagaaagatatcaaaagcgaatacaagatctcgggtctaaccataagagaaatgataattcacagcaatcgaaggacgaaacctatggcttggcgagaaagatcgaacatttggagatttcgacacgaaaaatgatgggagaaggacttgacgcatcttctatagaagagttacaacaattggagaaccagttggacagaagcttaatgaaaataagagccaaaaagtaccagttattacgagaagaaactgagaaattaaaagaaaaggagaggaacctcattgcagaaaataaaatgctgatggagaagtgtgagatgcaaggaagaggaataataggaagaatatcatcatcatcatcaacatcagaactggatatagatgacaatgaaatggaagtggtgactgatttgttcattggacctcctgagactcgacacttcaaaaagtttcctccttcaaactaacatatatagtacaatgcttatatagatattatgtagggaattacttttttccctgaagaaaaattgatgttacttactgaatttagcagttgcataaaaaaaa

SEQ ID NO: 1728 - protein, 221 aa, Arabidopsis thaliana
MVRGKTEMKRIENATSRQVTFSKRRNGLLKKAFELSVLCDAEVALIIFSPRGKLYEFSSSSSIPKTVERYQKRIQDLGSNHKRNDNSQQSKDETYGLARKIEHLEISTRKMMGEGLDASSIEELQQLENQLDRSLMKIRAKKYQLLREETEKLKEKERNLIAENKMLMEKCEMQGRGIIGRISSSSSTSELDIDDNEMEVVTDLFIGPPETRHFKKFPPSN

SEQ ID NO: 1729 - DNA, 959 bp, Arabidopsis thaliana; identical to SEQ ID NO: 63

SEQ ID NO: 1730 - protein, 227 aa, Arabidopsis thaliana; identical to SEQ ID NO: 64

SEQ ID NO: 1731 - DNA, 1098 bp, Arabidopsis thaliana; identical to SEQ ID NO: 65

SEQ ID NO: 1732 - protein, 234 aa, Arabidopsis thaliana; identical to SEQ ID NO: 66

SEQ ID NO: 1733 - DNA, 883 bp, Arabidopsis thaliana; identical to SEQ ID NO: 69

SEQ ID NO: 1734 - protein, 196 aa, Arabidopsis thaliana; identical to SEQ ID NO: 70

SEQ ID NO: 1735 - DNA, 2217 bp, Arabidopsis thaliana
  misc_feature (2192)..(2192): n is a, c, g, or t
atttctaaaaatagttaaactgttggtgatttttgtggaactgattaattaacacaattggagaaaacaaattgaaacttttttgtttgttagagagttaaggagaaattttatctaaccaagctgtgtaaatctcttgtagtttttctgccgatatacattttcattgtgttgagggtaaacgataatcaagaacgagagagagagagagcaagagcaagagatttctactacagaagatttattatattgatcattttgtgtgatcaacccataaaaacagagagacatagacaagtccatgtttcgatgtttcgatctctcttactgtctaaacggcgaaataaaaagtctgatgggtgtcacttattgcatgtatattagtaaatcagcttgagcccaagttaaagctgaaacttgggtttgcaatggctggtattgataataaagctgctgtaatgggagaatggttcgactgtagtactactaaccacaggaagagatcgaaagcggaacttggtagagagttttctttaaattacatcaagaatgaggattctttgcaaaccacctttcaagaaagttcacgaggagctcttcgtgaaaggattgctgcgagatccgggtttaatgcaccgtggttaaacactgaggatattcttcagtcgaaatctttaaccatctcttctcctggtcttagtcctgcaactctgttagagtctcctgttttcctctcaaaccctttgctatctccaacaaccgggaagctctcatcagtaccttctgataaggctaaagctgagttatttgacgacattaccacatccttagccttccaaaccatttcaggaagtggccttgatcctactaacatcgctttagaacccgatgattcccaagactatgaagaaagacagctcggcggtttaggagactcgatggcttgttgtgcacctgcagatgatggatacaactggagaaaatatggacaaaagctagttaaaggaagtgagtatccgcggagctattacaagtgcacgcacccgaattgtgaggccaagaagaaggttgaacggtctcgggaaggtcatattatagagatcatatacacaggagatcatatacacagcaaacctccacctaaccgccggtcagggattggatcatccggtactggccaagacatgcaaatagatgcaaccgaatacgaaggttttgctggaaccaatgagaacatagaatggacatcacctgtatctgcagagctcgaatacggaagccattcaggatcaatgcaggttcaaaacgggactcatcagttcgggtatggtgatgcagcagctgatgccttatatagagatgaaaacgaagatgatcgcacgtcccacatgagtgtttccctgacttacgatggagaggtagaagagtccgaatcaaagagaaggaaactagaagcttatgcaacagaaacgagtggatcaaccagagccagccgtgagccaagagttgtggtgcagaccacaagtgacattgacatcctcgatgatggttatcgctggcgcaagtatgggcaaaaagtcgttaaaggaaacccgaatccaaggagctactataaatgcacagctaatggatgtaccgtaacgaagcatgtagagagagcctctgatgacttcaagagcgtactaacaacttatataggcaagcacacccacgttgtaccagcagcacgcaacagcagccacgtcggtgcaggcagttcagggactctccaaggcagtttagcgactcagacccacaaccacaatgtgcactatccaatgccacacagtagatctgagggactggccacagccaactcatctctatttgacttccagtcacacctgaggcatcctacaggtttctccgtttacataggccaatctgagctttctgatctttcaatgcctggtctaactattgggcaagagaagcttaccagcctgcaggcgcctgacattggggatccaactggcctaatgttgcagttagcagcacagccgaaggtggaaccagtgtcaccacaacagggacttgatttgtcagcgagctcattgatatgcagagagatgttgagtagattacgacagatatgaaacaaatctctttgttcactgattgctcaaatttttgaataaatgaaaaattgaganaaaaaaaaaaaaaaaaaaaaaaaaa

SEQ ID NO: 1736 - protein, 568 aa, Arabidopsis thaliana
MAGIDNKAAVMGEWFDCSTTNHRKRSKAELGREFSLNYIKNEDSLQTTFQESSRGALRERIAARSGFNAPWLNTEDILQSKSLTISSPGLSPATLLESPVFLSNPLLSPTTGKLSSVPSDKAKAELFDDITTSLAFQTISGSGLDPTNIALEPDDSQDYEERQLGGLGDSMACCAPADDGYNWRKYGQKLVKGSEYPRSYYKCTHPNCEAKKKVERSREGHIIEIIYTGDHIHSKPPPNRRSGIGSSGTGQDMQIDATEYEGFAGTNENIEWTSPVSAELEYGSHSGSMQVQNGTHQFGYGDAAADALYRDENEDDRTSHMSVSLTYDGEVEESESKRRKLEAYATETSGSTRASREPRVVVQTTSDIDILDDGYRWRKYGQKVVKGNPNPRSYYKCTANGCTVTKHVERASDDFKSVLTTYIGKHTHVVPAARNSSHVGAGSSGTLQGSLATQTHNHNVHYPMPHSRSEGLATANSSLFDFQSHLRHPTGFSVYIGQSELSDLSMPGLTIGQEKLTSLQAPDIGDPTGLMLQLAAQPKVEPVSPQQGLDLSASSLICREMLSRLRQI

SEQ ID NO: 1737 - DNA, 1454 bp, Arabidopsis thaliana
cgtcgacgatcagattcttgcgtatagctgtatatatacaccaagatacactcatcatcgtcatatatagattatgtgcagcgtctctgagcttcttgacatggaaaacttccaaggagacttaaccgacgtcgtacgaggaatcggaggccacgtgttatcaccggagactcctccctcgaacatctggcctcttcctctgtcacatccaacaccatcaccgtcagatcttaacataaaccccttcggagatccctttgtgagcatggacgatccactcctccaagaactaaactccatcacaaactccggctatttctccaccgtaggagataacaacaacaacattcacaacaacaatggtttcttggttccaaaggtatttgaggaggatcatataaagagtcaatgtagtatcttcccaagaatccggatctcgcatagtaacatcatccacgattcttctccgtgtaattctccggccatgtcggctcacgttgtcgcagccgcagcagccgcctcgccgagaggcatcatcaacgtagacacaaacagtcctagaaactgtctattggttgatggtaccacgttctcctcgcagattcagatatcttcccctcggaatctaggccttaaaagaaggaagagtcaggcaaagaaggtggtgtgtattccggccccggctgcaatgaacagccgatcaagcggagaagtggttccatcggatctatgggcttggcgtaaatacggtcaaaaacctatcaaaggctctccttttccaaggggttattatagatgcagcagctcaaaaggttgttcagcaagaaagcaagtcgaaagaagccgaaccgatccaaacatgttggtgattacatatacctccgaacataaccatccttggcccatccaacgcaacgctctcgccggctccacacgctcctccacctcctcctcatctaaccctaatccttccaaaccctcaaccgcaaacgtaaactcctcatccattggctcccaaaacaccatctacttgccttcctccaccactcctcctcctaccctctcatcctccgccatcaaagatgaacgaggggacgatatggagttggaaaacgtagatgatgatgatgataaccagattgctccatacagaccggagcttcatgatcatcagcaccaaccagatgatttctttgcagatcttgaagagctagaaggagattctctaagcatgttgctttctcatggctgtggcggcgacgggaaggataaaacgaccgcgtccgatgggatcagcaatttcttcgggtggtcgggagataataattataataattacgacgaccaagactcaaggtcgttatagtatagtgttaattacaggtaaacaaattatattaaattaagttgagcttgtgaaaatgaagatcatatggtctggtcaggttgggggc

SEQ ID NO: 1738 - protein, 430 aa, Arabidopsis thaliana
MCSVSELLDMENFQGDLTDVVRGIGGHVLSPETPPSNIWPLPLSHPTPSPSDLNINPFGDPFVSMDDPLLQELNSITNSGYFSTVGDNNNNIHNNNGFLVPKVFEEDHIKSQCSIFPRIRISHSNIIHDSSPCNSPAMSAHVVAAAAAASPRGIINVDTNSPRNCLLVDGTTFSSQIQISSPRNLGLKRRKSQAKKVVCIPAPAAMNSRSSGEVVPSDLWAWRKYGQKPIKGSPFPRGYYRCSSSKGCSARKQVERSRTDPNMLVITYTSEHNHPWPIQRNALAGSTRSSTSSSSNPNPSKPSTANVNSSSIGSQNTIYLPSSTTPPPTLSSSAIKDERGDDMELENVDDDDDNQIAPYRPELHDHQHQPDDFFADLEELEGDSLSMLLSHGCGGDGKDKTTASDGISNFFGWSGDNNYNNYDDQDSRSL

SEQ ID NO: 1739 - DNA, 825 bp, Arabidopsis thaliana; identical to SEQ ID NO: 107

SEQ ID NO: 1740 - protein, 274 aa, Arabidopsis thaliana; identical to SEQ ID NO: 108

SEQ ID NO: 1741 - DNA, 687 bp, Arabidopsis thaliana; identical to SEQ ID NO: 123

SEQ ID NO: 1742 - protein, 228 aa, Arabidopsis thaliana; identical to SEQ ID NO: 124

SEQ ID NO: 1743 - DNA, 2240 bp, Arabidopsis thaliana; identical to SEQ ID NO: 127

SEQ ID NO: 1744 - protein, 608 aa, Arabidopsis thaliana; identical to SEQ ID NO: 128

SEQ ID NO: 1745 - DNA, 1033 bp, Arabidopsis thaliana
ctctcttattctctcactcttttttttttatattcctctctctctaaatctataaaatatatttaaaaacttgatcgtatataataaagtaaataaagaataataacaaaaaaaatggagaaaagaggaggaggaagtagtggaggttcgggatcatcagcagaagcagaagtgagaaaaggaccatggacgatggaagaagatcttattcttatcaactatatcgccaaccacggcgatggtgtttggaattctctcgccaaatctgcaggtctaaaacgaaccgggaaaagttgccggctccggtggctgaactatctccgccccgacgtacgacggggaaacatcactccagaagagcaacttatcatcatggaacttcatgctaagtggggaaacaggtggtcgaaaatcgccaaacatcttccaggaagaacggacaacgagatcaaaaatttctgtaggacaagaattcaaaaatacatcaagcaatcggatgtaacaacaacatcgtccgttggatctcatcatagctcagagatcaacgatcaagctgcaagcacgtcgagccataatgtcttttgtacacaagatcaagcgatggagacttattctcctacaccgacatcatatcaacataccaatatggaattcaactatggtaactattcggccgcggcagtgacggcaaccgtggattatccagtaccgatgaccgttgatgatcaaaccggtgaaaactattggggcatggatgatatttggtcatcaatgcatttattgaatggtaattgattgatcggtggacaaaacatggaatattaattgagtattatatatgatttttaggagtactattattagtacgtgacatgtatatgtttttgcctcgttgtagaggtttggggttataattaatatataatgttatctaatatgcaaccttgatacatatttggatctttattgaacccatgttatacataaataaaattgttgaaggggtcataaaaaaaaaaaaaaaaaaaaaaaa

SEQ ID NO: 1746 - protein, 226 aa, Arabidopsis thaliana
MEKRGGGSSGGSGSSAEAEVRKGPWTMEEDLILINYIANHGDGVWNSLAKSAGLKRTGKSCRLRWLNYLRPDVRRGNITPEEQLIIMELHAKWGNRWSKIAKHLPGRTDNEIKNFCRTRIQKYIKQSDVTTTSSVGSHHSSEINDQAASTSSHNVFCTQDQAMETYSPTPTSYQHTNMEFNYGNYSAAAVTATVDYPVPMTVDDQTGENYWGMDDIWSSMHLLNGN

SEQ ID NO: 1747 - DNA, 584 bp, Arabidopsis thaliana; identical to SEQ ID NO: 139

SEQ ID NO: 1748 - protein, 94 aa, Arabidopsis thaliana; identical to SEQ ID NO: 140

SEQ ID NO: 1749 - DNA, 407 bp, Arabidopsis thaliana; identical to SEQ ID NO: 141

SEQ ID NO: 1750 - protein, 112 aa, Arabidopsis thaliana; identical to SEQ ID NO: 142

SEQ ID NO: 1751 - DNA, 489 bp, Arabidopsis thaliana
atggtgactgtaaaccctagccaagctcattgtttgcctatgaaaatgagtctaccgggtttcaatactcttccccacacggcaacaacgataccggtttccatacggagcaataggacgatgtcgttttttgaggatccaacaaagaaggttagaaagccttacactatcaccaaatctagagagaactggacggagcaagaacacgacaagttccttgaagcccttcatctatttgaccgggattggaagaaaataaaggcctttgttggatcaaaaacagtgatacagatacgaagccacgcacagaagtactttctcaaagttcagaagaatgggactaaagaacatctcccacctcctcgaccaaagaggaaagccaatcacccatatccacaaaaagctcctaaatgtggcaaccttaaaccttttatctttctacttccgcttttgttactttatctcattttctcatggttatgtttttga

SEQ ID NO: 1752 - protein, 162 aa, Arabidopsis thaliana
MVTVNPSQAHCLPMKMSLPGFNTLPHTATTIPVSIRSNRTMSFFEDPTKKVRKPYTITKSRENWTEQEHDKFLEALHLFDRDWKKIKAFVGSKTVIQIRSHAQKYFLKVQKNGTKEHLPPPRPKRKANHPYPQKAPKCGNLKPFIFLLPLLLLYLIFSWLCF

SEQ ID NO: 1753 - DNA, 1046 bp, Arabidopsis thaliana; identical to SEQ ID NO: 155

SEQ ID NO: 1754 - protein, 273 aa, Arabidopsis thaliana; identical to SEQ ID NO: 156

SEQ ID NO: 1755 - DNA, 660 bp, Arabidopsis thaliana; identical to SEQ ID NO: 169

SEQ ID NO: 1756 - protein, 219 aa, Arabidopsis thaliana; identical to SEQ ID NO: 170

SEQ ID NO: 1757 - DNA, 731 bp, Arabidopsis thaliana; identical to SEQ ID NO: 173

SEQ ID NO: 1758 - protein, 214 aa, Arabidopsis thaliana; identical to SEQ ID NO: 174

SEQ ID NO: 1759 - DNA, 918 bp, Arabidopsis thaliana; identical to SEQ ID NO: 181

SEQ ID NO: 1760 - protein, 269 aa, Arabidopsis thaliana; identical to SEQ ID NO: 182

SEQ ID NO: 1761 - DNA, 1099 bp, Arabidopsis thaliana
acagttgtacaaaaaagcaggcgtggtaccggaccggtaattcccggggatatcgtcgtacccacgcgtccgctcgacacgcaacttccttcctcttcagactcctctgactttactatatataacacacacactttcatttcttgtttcttcaaatcaaatcttttcatttacaattatctttcttctcaatttagaacttagtagctagtcttcaagataatggcacttgaaactcttacttctccaagattatcttctccgatgccgactctgtttcaagattcagcactagggtttcatggaagcaaaggcaaacgatctaagcgatcaagatctgaattcgaccgtcagagtctcacggaggatgaatatatcgctttatgtctcatgcttcttgctcgcgacggagatagaaaccgtgaccttgacctgccttcttcttcgtcttcacctcctctgcttcctcctcttcctactccgatctacaagtgtagcgtctgtgacaaggcgttttcgtcttaccaggctcttggtggacacaaggcaagtcaccggaaaagcttttcgcttactcaatctgccggaggagatgagctgtcgacatcgtcggcgataaccacgtctggtatatccggtggcgggggaggaagtgtgaagtcgcacgtttgctctatctgtcataaatcgttcgccaccggtcaagctctcggcggccacaaacggtgccactacgaaggaaagaacggaggcggtgtgagtagtagcgtgtcgaattctgaagatgtggggtctacaagccacgtcagcagtggccaccgtgggtttgacctcaacataccgccgataccggaattctcgatggtcaacggagacgaagaggtgatgagtcctatgccggcgaagaaactccggtttgacttcccggagaaaccctaaacataaacctaggaaaaactttacagaattcattttataggaaattgttttactgtatatacaaatatcgattttgattgatgttcttcttcactgaaaaattatgattctttgttgtatacttgatgtttctgaaaaagatataactttttattaaaaa

SEQ ID NO: 1762 - protein, 238 aa, Arabidopsis thaliana
MALETLTSPRLSSPMPTLFQDSALGFHGSKGKRSKRSRSEFDRQSLTEDEYIALCLMLLARDGDRNRDLDLPSSSSSPPLLPPLPTPIYKCSVCDKAFSSYQALGGHKASHRKSFSLTQSAGGDELSTSSAITTSGISGGGGGSVKSHVCSICHKSFATGQALGGHKRCHYEGKNGGGVSSSVSNSEDVGSTSHVSSGHRGFDLNIPPIPEFSMVNGDEEVMSPMPAKKLRFDFPEKP

SEQ ID NO: 1763 - DNA, 889 bp, Arabidopsis thaliana; identical to SEQ ID NO: 235

SEQ ID NO: 1764 - protein, 193 aa, Arabidopsis thaliana; identical to SEQ ID NO: 236

SEQ ID NO: 1765 - DNA, 977 bp, Arabidopsis thaliana
ataaaaaacccttcatacaatataaaatttctttagacatacaatatattatactattacagatgcaatgcatcattagttacaaactattaaactaaatatcccccgtctctctcttgctatataaagaagatcatttacacatctccttaagcaaattaaacccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaattaaagagagatatatgattaagattatatgtactatagtggcgtatttcattgggatcatgaaggggaaaaaacgagacatatagtattcttgatgcaatttgagttttgtaatttatttaggtttatgtatgttttcgaag

SEQ ID NO: 1766 - protein, 211 aa, Arabidopsis thaliana
MSINPTMSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 1767 - DNA, 774 bp, Arabidopsis thaliana
atggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctga

SEQ ID NO: 1768 - protein, 257 aa, Arabidopsis thaliana
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 1769 - DNA, 2526 bp, Arabidopsis thaliana; identical to SEQ ID NO: 249

SEQ ID NO: 1770 - protein, 841 aa, Arabidopsis thaliana; identical to SEQ ID NO: 250

SEQ ID NO: 1771 - DNA, 2559 bp, Arabidopsis thaliana
atgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttga

SEQ ID NO: 1772 - protein, 852 aa, Arabidopsis thaliana
MMMVHSMSRDMMNRESPDKGLDSGKYVRYTPEQVEALERVYTECPKPSSLRRQQLIRECPILSNIEPKQIKVWFQNRRCREKQRKEAARLQTVNRKLNAMNKLLMEENDRLQKQVSNLVYENGHMKHQLHTASGTTTDNSCESVVVSGQQHQQQNPNPQHQQRDANNPAGLLSIAEEALAEFLSKATGTAVDWVQMIGMKPGPDSIGIVAISRNCSGIAARACGLVSLEPMKVAEILKDRPSWLRDCRSVDTLSVIPAGNGGTIELIYTQMYAPTTLAAARDFWTLRYSTCLEDGSYVVCERSLTSATGGPTGPPSSNFVRAEMKPSGFLIRPCDGGGSILHIVDHVDLDAWSVPEVMRPLYESSKILAQKMTVAALRHVRQIAQETSGEVQYGGGRQPAVLRTFSQRLCRGFNDAVNGFVDDGWSPMGSDGAEDVTVMINLSPGKFGGSQYGNSFLPSFGSGVLCAKASMLLQNVPPAVLVRFLREHRSEWADYGVDAYAAASLRASPFAVPCARAGGFPSNQVILPLAQTVEHEESLEVVRLEGHAYSPEDMGLARDMYLLQLCSGVDENVVGGCAQLVFAPIDESFADDAPLLPSGFRIIPLEQKSTPNGASANRTLDLASALEGSTRQAGEADPNGCNFRSVLTIAFQFTFDNHSRDSVASMARQYVRSIVGSIQRVALAIAPRPGSNISPISVPTSPEALTLVRWISRSYSLHTGADLFGSDSQTSGDTLLHQLWNHSDAILCCSLKTNASPVFTFANQTGLDMLETTLVALQDIMLDKTLDEPGRKALCSEFPKIMQQGYAHLPAGVCASSMGRMVSYEQATVWKVLEDDESNHCLAFMFVNWSFV

SEQ ID NO: 1773 - DNA, 2502 bp, Arabidopsis thaliana
atgggaggaggaagcaataatagtcacaatatggacaacgggaagtacgtgaggtacactcctgaacaagtggaagctctggagagactctacaatgactgtcctaaaccgagctctatgcgccgccaacagctaatccgcgaatgtcctatcctctccaacatcgagcctaaacagataaaagtctggttccagaaccgcaggtgtagagaaaaacagcgaaaagaggcgtcacgacttcaagctgtgaataggaagctaacggcaatgaacaagcttttgatggaagagaatgaccgcttgcaaaagcaagtgtctcacttggtttatgagaacagctattttcgccaacatcctcaaaaccaggggaatttggctaccacagatactagctgtgagtcagtggtgacgagtggtcaacaccacttgacccctcaacatcagcctcgtgatgctagtcctgctggattattgtccattgcggatgaaactttaacagagttcatttccaaggcgactggaaccgctgtcgagtgggtccaaatgcctgggatgaagcctggtccggattccataggaatcgttgctatttctcatggatgcacgggaatcgctgctcgtgcttgcggccttgtgggtcttgatcccacaagggtcgcggagatcctaaaggataagccttgttggttgcgtgattgcagatctctggatatagttaacgtactatccactgcaaatggtggaacccttgaactaatctacatgcagctttatgcgccgacaacactggcaccagctcgtgacttctggatgctacgttacacatctgtaatggaagacgggagccttgtgatatgcgaacgatcactgaacaatacacaaaacgggccaagtatgcctccgtctcctcatttcgttagggcagagattttaccaagtggttacctcattagaccttgcgaaggaggtggatccattcttcacattgtcgatcatttcgatcttgagccatggagtgtgccagaagttcttcgttctctctatgagtcctccactttactcgcccaaagaactacaatggccgctctgcgctatttgaggcaaatatctcaagagatttcacaacctaacgtaacaggttggggaagaagaccagcggctcttagagcacttagccaaaggcttagcaaaggattcaacgaagcagtgaatgggttcagcgatgaaggatggtccatcctagagagtgatggtatcgatgatgtcactcttcttgtgaactcctctcccacaaagatgatgatgacttcaagtctcccatttgccaatggctacacttctatgcctagcgcggtcttatgtgccaaagcttccatgttattacaaaatgttccaccttcgattctgctgcggttcttgagggaacatagacaagaatgggcagacaatagcatcgatgcatattcggccgcagccatcaaagcaggcccttgtagcttaccaatccctcgcccagggagctttggtggtcaagtcattcttcctctagctcacactatagagaatgaagagtttatggaagtcattaagcttgagagcttggggcactaccaagaagacatgatgatgcctgctgatatcttccttctgcaaatgtgcagtggggtggatgagaacgcagttgaatcatgcgcagagcttatatttgcaccaatcgacgcatctttctctgatgatgcaccaatcattccttccggtttccgcatcattcctctagattccaaatcagaggggttgagtcctaaccgaacgctagacctagcgtcggctctagacgtagggagcagaacagccggagattcatgtggaagcagaggaaactcaaagtccgttatgactatagcgtttcagctagcttttgagatgcatatgcaagagaatgtagcctcaatggctagacagtatgtaagaagtgtgatcgcgtcggttcaacgggtcgcacttgctctctctccttcttctcatcagctaagtggcttgcgtcctccacccgcgtcacccgaagctcacactctcgctcgctggatctctcactcttatagatgttaccttggcgttgatcttctcaaacctcatggaactgatcttctcaagtctctttggcaccatcctgacgctgtcatgtgttgctcactcaaggccttatctccggtattcacatttgcgaaccaagctggtttagacatgctggagacgacgttggtggcacttcaagatatcactctcgacaagatcttcgacaacaacaacgggaagaagactttatcctccgaattccctcagatcatgcaacaggggtttatgtgtatggatggaggaatatgcatgtcgagcatgggaagagcagtaacgtacgagaaggctgttgggtggaaagtgttgaacgacgacgaagatcctcattgtatctgcttcatgttcctcaactggtcttttatatga

SEQ ID NO: 1774 - protein, 833 aa, Arabidopsis thaliana
MGGGSNNSHNMDNGKYVRYTPEQVEALERLYNDCPKPSSMRRQQLIRECPILSNIEPKQIKVWFQNRRCREKQRKEASRLQAVNRKLTAMNKLLMEENDRLQKQVSHLVYENSYFRQHPQNQGNLATTDTSCESVVTSGQHHLTPQHQPRDASPAGLLSIADETLTEFISKATGTAVEWVQMPGMKPGPDSIGIVAISHGCTGIAARACGLVGLDPTRVAEILKDKPCWLRDCRSLDIVNVLSTANGGTLELIYMQLYAPTTLAPARDFWMLRYTSVMEDGSLVICERSLNNTQNGPSMPPSPHFVRAEILPSGYLIRPCEGGGSILHIVDHFDLEPWSVPEVLRSLYESSTLLAQRTTMAALRYLRQISQEISQPNVTGWGRRPAALRALSQRLSKGFNEAVNGFSDEGWSILESDGIDDVTLLVNSSPTKMMMTSSLPFANGYTSMPSAVLCAKASMLLQNVPPSILLRFLREHRQEWADNSIDAYSAAAIKAGPCSLPIPRPGSFGGQVILPLAHTIENEEFMEVIKLESLGHYQEDMMMPADIFLLQMCSGVDENAVESCAELIFAPIDASFSDDAPIIPSGFRIIPLDSKSEGLSPNRTLDLASALDVGSRTAGDSCGSRGNSKSVMTIAFQLAFEMHMQENVASMARQYVRSVIASVQRVALALSPSSHQLSGLRPPPASPEAHTLARWISHSYRCYLGVDLLKPHGTDLLKSLWHHPDAVMCCSLKALSPVFTFANQAGLDMLETTLVALQDITLDKIFDNNNGKKTLSSEFPQIMQQGFMCMDGGICMSSMGRAVTYEKAVGWKVLNDDEDPHCICFMFLNWSFI

SEQ ID NO: 1775 - DNA, 2821 bp, Arabidopsis thaliana; identical to SEQ ID NO: 283

SEQ ID NO: 1776 - protein, 842 aa, Arabidopsis thaliana; identical to SEQ ID NO: 284

SEQ ID NO: 1777 - DNA, 1507 bp, Arabidopsis thaliana
aaaaaatcactgtttcataacacgtttttctctctcacccaccaaaaaaaaatcttttgttcttgttaccaaaaaatctcgtgataaatctcttcaaactttgttttattttcttcttgattctctcgaaatctctctcaacaaacccagaaactttccttgattcgcaagcttttcttccttttatattcttcattttgatgcgaatatagagagagtccataaaagaaacagtaatggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgcttaatatgatgatgagagtgaagaagaaaccatcaagcaaatatctatggtgtgactgaaaaattttggtgttacttttttttctttcataagttcatgagcttttttgtttcttttttttaataatttatttagttttgtcaggagcttgtaaaacagttttggagaaatagtggaaaaatagtttaattaaaaaaaaaaaaaaaaaaa

SEQ ID NO: 1778 - protein, 354 aa, Arabidopsis thaliana
MDEYIDFRPLKYTEHKTSMTKYTKKSSEKLSGGKSLKKVSICYTDPDATDSSSDEDEEDFLFPRRRVKRFVNEITVEPSCNNVVTGVSMKDRKRLSSSSDETQSPASSRQRPNNKVSVSGQIKKFRGVRQRPWGKWAAEIRDPEQRRRIWLGTFETAEEAAVVYDNAAIRLRGPDALTNFSIPPQEEEEEEEPEPVIEEKPVIMTTPTPTTSSSESTEEDLQHLSSPTSVLNHRSEEIQQVQQPFKSAKPEPGVSNAPWWHTGFNTGLGESDDSFPLDTPFLDNYFNESPPEMSIFDQPMDQIFCENDDIFNDMLFLGGETMNIEDELTSSSIKDMGSTFSDFDDSLISDLLVA

SEQ ID NO: 1779 - DNA, 1262 bp, Arabidopsis thaliana
ctcgagctacgtcaggggtctctttctgtttgtttgttttcttgtttccttctctctctctctttctttctttgtcttcctttcccaggttgtttttttttgctctctctgccttcttgactttcaaaagactctttctttcttttggattgattttggattctagggctctctttcttttagtgggtttttgttgttgttgttgtggtctctctgatgattactgaacttgagatggggaaaggtgagagtgagcttgagcttggtctagggctgagtcttggcggtggaacggcggccaagattggtaaatcaggtggtggtggcgcgtggggagagcgtggaaggcttttgacggctaaggattttccttctgttggttctaaacgtgctgctgattctgcttctcatgctggttcatctcctcctcgttcaagtcaagttgttggatggcctcctatagggtcacacaggatgaacagtttggttaataaccaagctacaaagtcagcaagagaagaagaagaagctggtaagaagaaagtgaaagatgatgaacctaaagatgtgacaaagaaagtgaatgggaaagtacaagttggatttattaaggtgaacatggatggagttgctataggaagaaaagtggatttgaatgctcattcttcttacgagaatttggcgcaaacattggaagatatgttctttcgcactaatccgggtactgtcgggttaaccagtcagttcactaaaccgttgaggcttttagatggatcgtctgagtttgtacttacttatgaagataaggaaggagattggatgcttgttggtgatgttccatggagaatgttcatcaactcggtgaaaaggctacgtgtgatgaaaacctctgaagctaatggactcgctgcacgaaatcaagaaccaaacgagagacagcgaaagcagccggtttagatctcttttcgacgttacggtgttacaggttttatattttggggttttgcaagtctgagatacttctgaagcaagcataagctagattgatcttatatccagtttgtgtattttcttggttcttataatggtttttactggttttctttagtttttttttttgctgtcttttaattttcggttgcgatttcactatatactatggatggaagagaatgctctttatatcttttactacactgtaaatatttgaagcttatctaatatcgtttttaagggttaaaaaaccctgacgtagcctcgag

SEQ ID NO: 1780 - protein, 246 aa, Arabidopsis thaliana
MITELEMGKGESELELGLGLSLGGGTAAKIGKSGGGGAWGERGRLLTAKDFPSVGSKRAADSASHAGSSPPRSSQVVGWPPIGSHRMNSLVNNQATKSAREEEEAGKKKVKDDEPKDVTKKVNGKVQVGFIKVNMDGVAIGRKVDLNAHSSYENLAQTLEDMFFRTNPGTVGLTSQFTKPLRLLDGSSEFVLTYEDKEGDWMLVGDVPWRMFINSVKRLRVMKTSEANGLAARNQEPNERQRKQPV

SEQ ID NO: 1781 - DNA, 832 bp, Arabidopsis thaliana
gagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 1782 - protein, 141 aa, Arabidopsis thaliana
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 1783 - DNA, 486 bp, Arabidopsis thaliana
atggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaa

SEQ ID NO: 1784 - protein, 161 aa, Arabidopsis thaliana
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 1785 - DNA, 1832 bp, Arabidopsis thaliana; identical to SEQ ID NO: 351

SEQ ID NO: 1786 - protein, 367 aa, Arabidopsis thaliana; identical to SEQ ID NO: 352

SEQ ID NO: 1787 - DNA, 1360 bp, Arabidopsis thaliana; identical to SEQ ID NO: 353

SEQ ID NO: 1788 - protein, 330 aa, Arabidopsis thaliana; identical to SEQ ID NO: 354

SEQ ID NO: 1789 - DNA, 1457 bp, Arabidopsis thaliana
cttttttgaagcccttttgacacaaaagaccagaacaagttgaagaaatatgaatacaacctcgacacattttgttccaccgagaaggtttgaagtttacgagcctctcaaccaaatcggtatgtgggaagaaagtttcaagaacaatggagacatgtatacgcctggctctatcataatcccgactaacgaaaaaccagacagcttgtcagaggatacttctcatgggacagaaggaactcctcacaagtttgaccaagaggcttccacatctagacatcctgataagatacagagaaggctagcacagaatcgagaggcagctaggaaaagtcgtttgcgcaagaaagcttatgttcagcagctagagactagccggttaaagctaattcatttagagcaagaactcgatcgtgctagacaacagggtttctatgtggggaacggagtagataccaatgctcttagtttctcagataacatgagctcagggattgttgcatttgagatggaatatggacattgggtggaagaacagaacaggcaaatatgtgaactaagaacggttttacatggacaagttagtgatatagagcttcgttctctagtcgagaatgccatgaaacattactttcaactcttccgaatgaagtcagccgctgcaaaaatcgatgttttctatgtcatgtccggaatgtggaaaacttcagcagagcggtttttcttgtggataggcggatttagaccctcagagcttctcaaggttctgttaccgcattttgatcctttgacggatcaacaacttttggatgtatgtaatctgaggcaatcatgtcaacaatcagaagatgcgttatcccaaggtatggagaaactgcaacatacattagcagagagtgtagcagccgggaaacttggtgaaggaagttatattcctcaaatgacttgtgctatggagagattggaggctttggtcagctttgtaaatcaagctgatcatctgagacatgagacattgcaacagatgcatcggatcttaaccacgcgacaagcggctagaggtttgttagcattaggggagtatttccaaaggcttcgagctttgagttcgagttgggcggctaggcaacgtgaaccaacgtaattaaggtgtttagatgtcaagaaaggtttgagaccttaacaatcaagaatggagtttgctggtgagtggatttttgggtcaagaacaagagcaataacacaagctgctgtgtgatgatgaatcttgtcttgcggctaaaggaaatgtttgaggaaagttgtacatatgatcagcaacgtaaagtttatagctttttagaaaccaacttttcgatggttgttcttttttttttgtatgtaatattatagataagcttgtggtatatatgattttaatgtgacattacgaacttgatttataaccatggtaaaat

SEQ ID NO: 1790 - protein, 364 aa, Arabidopsis thaliana
MNTTSTHFVPPRRFEVYEPLNQIGMWEESFKNNGDMYTPGSIIIPTNEKPDSLSEDTSHGTEGTPHKFDQEASTSRHPDKIQRRLAQNREAARKSRLRKKAYVQQLETSRLKLIHLEQELDRARQQGFYVGNGVDTNALSFSDNMSSGIVAFEMEYGHWVEEQNRQICELRTVLHGQVSDIELRSLVENAMKHYFQLFRMKSAAAKIDVFYVMSGMWKTSAERFFLWIGGFRPSELLKVLLPHFDPLTDQQLLDVCNLRQSCQQSEDALSQGMEKLQHTLAESVAAGKLGEGSYIPQMTCAMERLEALVSFVNQADHLRHETLQQMHRILTTRQAARGLLALGEYFQRLRALSSSWAARQREPT

SEQ ID NO: 1791 - DNA, 1638 bp, Arabidopsis thaliana; identical to SEQ ID NO: 355

SEQ ID NO: 1792 - protein, 330 aa, Arabidopsis thaliana; identical to SEQ ID NO: 356

SEQ ID NO: 1793 - DNA, 978 bp, Arabidopsis thaliana; identical to SEQ ID NO: 379

SEQ ID NO: 1794 - protein, 325 aa, Arabidopsis thaliana; identical to SEQ ID NO: 380

SEQ ID NO: 1795 - DNA, 2311 bp, Arabidopsis thaliana; identical to SEQ ID NO: 397

SEQ ID NO: 1796 - protein, 640 aa, Arabidopsis thaliana; identical to SEQ ID NO: 398

SEQ ID NO: 1797 - DNA, 1557 bp, Arabidopsis thaliana; identical to SEQ ID NO: 407

SEQ ID NO: 1798 - protein, 368 aa, Arabidopsis thaliana; identical to SEQ ID NO: 408

SEQ ID NO: 1799 - DNA, 984 bp, Arabidopsis thaliana; identical to SEQ ID NO: 431

SEQ ID NO: 1800 - protein, 327 aa, Arabidopsis thaliana; identical to SEQ ID NO: 432

SEQ ID NO: 1801 - DNA, 1310 bp, Arabidopsis thaliana
attagatccatttcagagctaagcgtactaattagtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagtaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctgaagagtttgctttaatcacatggttctaattttaggatcctcatctctattttttttttgggttttccaaattaactcgcttagattatcgtgagataaatcagtaataattttatttattttccctctttaatttacaattaatgatggggttgcttttaaa

SEQ ID NO: 1802 - protein, 323 aa, Arabidopsis thaliana
MVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKLNKVNQDSHQELDRSSLSSSPSSSSANSNSNISRGQWERRLQTDIHLAKKALSEALSPAVAPIITSTVTTTSSSAESRRSTSSASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEKWLFEDSGGQIGDILLDENTNFF

SEQ ID NO: 1803 - DNA, 1056 bp, Arabidopsis thaliana; identical to SEQ ID NO: 443

SEQ ID NO: 1804 - protein, 351 aa, Arabidopsis thaliana; identical to SEQ ID NO: 444

SEQ ID NO: 1805 - DNA, 2526 bp, Arabidopsis thaliana; identical to SEQ ID NO: 463

SEQ ID NO: 1806 - protein, 645 aa, Arabidopsis thaliana; identical to SEQ ID NO: 464

SEQ ID NO: 1807 - DNA, 228 bp, Arabidopsis thaliana; identical to SEQ ID NO: 467

SEQ ID NO: 1808 - protein, 75 aa, Arabidopsis thaliana; identical to SEQ ID NO: 468

SEQ ID NO: 1809 - DNA, 925 bp, Arabidopsis thaliana
ccacgcgtccgcgtcaatctttgagtttggtagagaaatggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaaggcgtatatgggtcagccaatgtggcaacaaccaggacctgagcagcaggatcctgacaattagcttggcctaataaactagccgtctaattcgaagctctccccggtggatctactcaagaagaagaatgttaatagaaaactattgcgacataaaaagtttggtgtagtagaataatttctgttttatgatccatggatttatcaattgttattcagtttggtttatcttgtcatcaaactgttttcggtcaatgtaacaaattcataaattgagaattgaacttacaaaaggcta

SEQ ID NO: 1810 - protein, 217 aa, Arabidopsis thaliana
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPKAYMGQPMWQQPGPEQQDPDN

SEQ ID NO: 1811 - DNA, 1036 bp, Arabidopsis thaliana; identical to SEQ ID NO: 567
  misc_feature (1012)..(1012): n is a, c, g, or t

SEQ ID NO: 1812 - protein, 196 aa, Arabidopsis thaliana; identical to SEQ ID NO: 568

SEQ ID NO: 1813 - DNA, 1210 bp, Arabidopsis thaliana; identical to SEQ ID NO: 569
  misc_feature (1194)..(1196): n is a, c, g, or t

SEQ ID NO: 1814 - protein, 240 aa, Arabidopsis thaliana; identical to SEQ ID NO: 570

SEQ ID NO: 1815 - DNA, 890 bp, Arabidopsis thaliana
cattcaaaaacatcatatatatacacaaacacactttgatacaacaaaaaaaaacagaacacaaacaaaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattgttttccggtcgaatgagattttccccctttttttttttctttttgggtcgctgtt

SEQ ID NO: 1816 - protein, 232 aa, Arabidopsis thaliana
MSNNNNSPTTVNQETTTSREVSITLPTDQSPQTSPGSSSSPSPRPSGGSPARRTATGLSGKHSIFRGIRLRNGKWVSEIREPRKTTRIWLGTYPVPEMAAAAYDVAALALKGPDAVLNFPGLALTYVAPVSNSAADIRAAASRAAEMKQPDQGGDEKVLEPVQPGKEEELEEVSCNSCSLEFMDEEAMLNMPTLLTEMAEGMLMSPPRMMIHPTMEDDSPENHEGDNLWSYK

SEQ ID NO: 1817 - DNA, 1177 bp, Arabidopsis thaliana
ctttttcttccctgttttagatagactcttagagtctctctagagtcaccggaacaatcacaaaagcgacgacatattactcattcctacaaatactcatgttggacctcaacctcggaatcttgtcgacacacaacgaagatgaagattgcaaagtaccaacttccatcttcattcaagaagaagattccattaatccctcaaacgacaacttgtctttgattacatttggaatccttaaacgaaacgtcgaaatccttcctcctccccctcctcctcctcctcctcctcctccttcggaaaatgaactctccggccccggaaatgagtggttggatctttcgtcgatgcaaagaaataaacaagaaacgttggtgatgaagaaaaaaagtcgacgtggcccaagatcaagaagctctcattatcgtggcgttaccttttaccgtcgaaccggccgttgggaatctcatatttgggactgtggaaaacaagtttatttgggtggtttcgacacagcctacacagccgcaagagcgtacgaccgagctgctatcagattccggggactccaagcagatatcaactttatcgtggatgattacaaacaagacattgaaaagatgaagaatttaagcaaagaagagtttgtgcaatctcttagacgagcgagtgcaagcttagcaagaggaggttctaaatacaaaaacacccatatgagaaatgatcacatccatctcttccaaaacaggggattgaatgcagcagcagcaaaatgcaatgagataagaaagatggaaggggatattaagttgggtgcccatagtaaaggaaatgagcacaacgatctcgagctaagtcttgggatatcttcatcgtcaaaagttagaattttggaaccagcagattattacatgggtttgaatcgatcggtgacgagtttgcatgggaagccgttgccgggatatctaccgatcacagaaattaaaccgttaaagacagttgtagcatcatcaggattccctttcattaccatgatcaatccttcttctttgtccttatcttgttttgatccatgaggtgatcactatttacttttaaaattttcccctttttattgataatctattgaatgacggaatgattatgtgacttatatctttttataaaccatattctt

SEQ ID NO: 1818 - protein, 325 aa, Arabidopsis thaliana
MLDLNLGILSTHNEDEDCKVPTSIFIQEEDSINPSNDNLSLITFGILKRNVEILPPPPPPPPPPPPSENELSGPGNEWLDLSSMQRNKQETLVMKKKSRRGPRSRSSHYRGVTFYRRTGRWESHIWDCGKQVYLGGFDTAYTAARAYDRAAIRFRGLQADINFIVDDYKQDIEKMKNLSKEEFVQSLRRASASLARGGSKYKNTHMRNDHIHLFQNRGLNAAAAKCNEIRKMEGDIKLGAHSKGNEHNDLELSLGISSSSKVRILEPADYYMGLNRSVTSLHGKPLPGYLPITEIKPLKTVVASSGFPFITMINPSSLSLSCFDP

SEQ ID NO: 1819 - DNA, 1519 bp, Arabidopsis thaliana; identical to SEQ ID NO: 627

SEQ ID NO: 1820 - protein, 335 aa, Arabidopsis thaliana; identical to SEQ ID NO: 628

SEQ ID NO: 1821 - DNA, 1077 bp, Arabidopsis thaliana
atggctgataataaggtcaatctttcgattaatggacaatcaaaagtgcctccaggtttcagattccatcccaccgaagaagaacttctccattactatctccgtaagaaagttaactctcaaaagatcgatcttgatgtcattcgtgaagttgatctaaacaagcttgagccttgggatattcaagaggaatgtagaatcggttcaacgccacaaaacgactggtacttcttcagccacaaggacaagaagtatccaaccgggaccaggacgaaccgggcaacagtcgctggattctggaaagctaccggacgtgacaaaatcatctgcagttgtgtccggagaattggactgaggaagacactcgtgttctacaaaggaagagctcctcacggtcagaaatccgactggatcatgcatgagtatcgcctcgacgatactccaatgtctaatggctatgctgatgttgttacagaagatccaatgagctataacgaagaaggttgggtggtatgtcgagtgttcaggaagaagaactatcaaaagattgacgattgtcctaaaatcactctatcttctttacctgatgacacggaggaagagaaggggcccacctttcacaacactcaaaacgttaccggtttagaccatgttcttctctacatggaccgtaccggttctaacatttgcatgcccgagagccaaacaacgactcaacatcaagatgatgtcttattcatgcaactcccaagtcttgagacacctaaatccgagagcccggtcgaccaaagtttcctgactccaagcaaactcgatttctctcccgttcaagagaagataaccgaaagaccggtttgcagcaactgggctagtcttgaccggctcgtagcttggcaattgaacaatggtcatcataatccgtgtcatcgtaagagttttgatgaagaagaagaaaatggtgatactatgatgcagcgatgggatcttcattggaataatgatgataatgttgatctttggagtagtttcactgagtcttcttcgtctttagacccacttcttcatttatctgtatga

SEQ ID NO: 1822 - protein, 358 aa, Arabidopsis thaliana
MADNKVNLSINGQSKVPPGFRFHPTEEELLHYYLRKKVNSQKIDLDVIREVDLNKLEPWDIQEECRIGSTPQNDWYFFSHKDKKYPTGTRTNRATVAGFWKATGRDKIICSCVRRIGLRKTLVFYKGRAPHGQKSDWIMHEYRLDDTPMSNGYADVVTEDPMSYNEEGWVVCRVFRKKNYQKIDDCPKITLSSLPDDTEEEKGPTFHNTQNVTGLDHVLLYMDRTGSNICMPESQTTTQHQDDVLFMQLPSLETPKSESPVDQSFLTPSKLDFSPVQEKITERPVCSNWASLDRLVAWQLNNGHHNPCHRKSFDEEEENGDTMMQRWDLHWNNDDNVDLWSSFTESSSSLDPLLHLSV

SEQ ID NO: 1823 - DNA, 1022 bp, Arabidopsis thaliana; identical to SEQ ID NO: 651

SEQ ID NO: 1824 - protein, 271 aa, Arabidopsis thaliana; identical to SEQ ID NO: 652

SEQ ID NO: 1825 - DNA, 3832 bp, Arabidopsis thaliana
gtaaaatttagcagagagaagaatgaaacaaataattatagcaccgtcacgtcgccgccgtatttcgttaccggaaaaaaaaaaatcattcttcaacataaaaataaaaacagtctctttctttctatctttgtctatctttgattattctctgtgtacccatgttctgcaacagttgagcaagtgcatgccccatatctctctgtttctcatttcccgatctttgcattaatcatatacttcgcctgagatctcgattaagccagcttatagaagaagaaacggcaccagcttctgtcgttttagttagctcgagatctgtgtttctttttttcttggcttctgagcttttggcggtggtgggtttttctggagaaacccaaacgactatcaaagttttgttttttacaattttaagtgggagttatgagtggggtggattaagtaagttacaagtatgaaggagttgaagattcgaagaagcggttttgaagtcggcgagaccaagattgcgagcttatttggctgatgatttatttcagggaagaagaaataaatctgttttttttagggtttttagatttggttggtgaatgggtgggaggtggagggaaacagttaaaaaagttatgcttttagtgtctcttcttcataattacatttgggcatcttgaaatctttggatctttgaagaaacaaagttgtgttttttttttgttctttgttgtttgctttttaagttagaataaaaaatgagattatcttcagctgggtttaatcctcaacctcatgaaggagagaaaagagttcttaattctgagctctggcatgcttgtgctggtcctcttgtctcactacctcctgttggaagcagagttgtgtattttcctcaaggtcacagtgaacaggttgctgcttcgaccaacaaagaagtagatgctcatataccaaattatccgagcttgcatccgcagcttatctgtcagcttcataatgttacaatgcatgctgatgtggagactgatgaagtctatgcacagatgactttgcaaccgttgaatgcgcaagagcaaaaagatccttaccttcccgcggaattaggtgtcccaagtagacagcctacaaactatttctgtaaaactctgactgctagtgatacaagcactcacggaggtttttctgtacctcgccgagctgctgagaaagttttccctcccttggattactcgcagcagccaccagctcaagagttaatggcgagggatctgcatgataatgaatggaagttcaggcatattttccgaggccaaccaaagagacatctccttaccacgggttggagcgtatttgtgagtgctaaaaggcttgttgctggtgactctgttcttttcatctggaacgataagaatcaattacttcttggtataagacgagccaaccgaccacaaactgtcatgccttcatctgttttgtcaagtgacagtatgcatttaggccttcttgctgcagcagctcatgctgccgctacaaacagccgattcaccatcttctataacccgagggcgagtccatcagagtttgttatacccctggctaagtatgtgaaagcggtttatcacactcgcgtctctgttggtatgcggtttaggatgctgtttgaaactgaagaatctagtgttcgtcggtacatgggtacaataactggcatttgtgatctagatcctactcgttgggctaattcgcattggcgatctgtcaaggttgggtgggacgaatctactgcaggagagagacagccaagggtttcattgtgggagattgagcctttaacaacattccctatgtatccatctccttttcctctcaggcttaaacggccgtggcctcctggtctcccatctttccatggccttaaagaagatgatatgggtatgagtatgagttcaccgcttatgtgggatcgaggactccaatctctaaactttcaaggtatgggagtaaacccgtggatgcagccgagacttgatacgtcgggcttgcttggtatgcaaaatgatgtgtaccaagcaatggctgcagctgcccttcaagacatgagaggcattgatcctgcaaaagctgctgcttcacttcttcagttccaaaattcgccggggttctcaatgcaatctccgtccttagtgcagccgcagatgctgcagcagcaactctctcagcagcagcaacaactctctcagcagcagcagcagcagcaacagctctcccaacagcagcagcaacagctctctcaacagcagcagcagcagctctctcaacagcagcagcaacaactctctcagcagcagcagcaacaggcgtatcttggcgttcctgaaacccaccagcctcagtctcaggctcaatcacagtcaaacaatcatctttctcagcagcagcagcaagtagtggataatcataatccgtctgcgtccagtgctgctgttgtttccgctatgtctcaatttggttctgcttctcagcccaacacgtcaccactccagtccatgacctctctgtgtcatcagcaaagcttctccgataccaacggaggaaacaatcctatttctccacttcacactcttctcagtaacttctctcaagacgaatcttctcaactgctccacctcactagaacaaactctgcaatgacttcatccggttggccatcaaagcgtcctgcagttgattcatcgttccagcactctggagccggtaataataacactcaatccgtattggagcaactgggacagtcccacacaagcaacgttcctccaaacgctgtctcgttgcctccatttcccggtggtagagagtgctcgatcgagcaagaaggaagcgcctcagacccgcatagccatcttctctttggagtcaatatagattcatcttctcttttgatgccgaacggaatgtcaaaccttagaagcattggtattgaaggtggtgactccacgactttacccttcacatcatctaatttcaacaatgatttctcgggtaatcttgcaatgacaacaccttctagttgcatagatgaatcgggttttctacaatcctcagaaaacctcggttccgagaacccacaatctaacacctttgtgaaggtgtacaagtcagggtcttttggaagatcgttagatatatcaaagtttagcagctaccacgagctgcgaagcgagcttgctcgcatgtttggcctcgaaggccaattagaagaccctgtgagatcaggctggcagcttgtatttgttgaccgagagaacgacgttcttctcctcggcgatgacccttggccggagtttgtgagcagcgtgtggtgcattaagatactgtcaccacaagaagtgcaacaaatgggaaaaagaggccttgagcttctcaactccgcgccatcttccaacaatgtcgataagctcccgagcaacgggaactgtgacgactttgggaaccggtcagacccgaggaatctcggtaacggtatcgcatcagttgggggttcattcaactactagaagtagatggaaacctccctttttattcaagttaagtttcaatcttataaattagtagtgagatcatcttagtttaattactagcaaaaatctctctttattacttataaaaaagggagatttgcctttgcctttgatggaaacaaaaactatataatccctctgtcgactcgtaatactgtaattataagatcttttggtctttttcttatatgaatatttttactgaactctatatatgtcactttccttaaaaaaaaaaaaaaaaaaaaaaaaaa

SEQ ID NO: 1826 - protein, 933 aa, Arabidopsis thaliana
MRLSSAGFNPQPHEGEKRVLNSELWHACAGPLVSLPPVGSRVVYFPQGHSEQVAASTNKEVDAHIPNYPSLHPQLICQLHNVTMHADVETDEVYAQMTLQPLNAQEQKDPYLPAELGVPSRQPTNYFCKTLTASDTSTHGGFSVPRRAAEKVFPPLDYSQQPPAQELMARDLHDNEWKFRHIFRGQPKRHLLTTGWSVFVSAKRLVAGDSVLFIWNDKNQLLLGIRRANRPQTVMPSSVLSSDSMHLGLLAAAAHAAATNSRFTIFYNPRASPSEFVIPLAKYVKAVYHTRVSVGMRFRMLFETEESSVRRYMGTITGICDLDPTRWANSHWRSVKVGWDESTAGERQPRVSLWEIEPLTTFPMYPSPFPLRLKRPWPPGLPSFHGLKEDDMGMSMSSPLMWDRGLQSLNFQGMGVNPWMQPRLDTSGLLGMQNDVYQAMAAAALQDMRGIDPAKAAASLLQFQNSPGFSMQSPSLVQPQMLQQQLSQQQQQLSQQQQQQQQLSQQQQQQLSQQQQQQLSQQQQQQLSQQQQQQAYLGVPETHQPQSQAQSQSNNHLSQQQQQVVDNHNPSASSAAVVSAMSQFGSASQPNTSPLQSMTSLCHQQSFSDTNGGNNPISPLHTLLSNFSQDESSQLLHLTRTNSAMTSSGWPSKRPAVDSSFQHSGAGNNNTQSVLEQLGQSHTSNVPPNAVSLPPFPGGRECSIEQEGSASDPHSHLLFGVNIDSSSLLMPNGMSNLRSIGIEGGDSTTLPFTSSNFNNDFSGNLAMTTPSSCIDESGFLQSSENLGSENPQSNTFVKVYKSGSFGRSLDISKFSSYHELRSELARMFGLEGQLEDPVRSGWQLVFVDRENDVLLLGDDPWPEFVSSVWCIKILSPQEVQQMGKRGLELLNSAPSSNNVDKLPSNGNCDDFGNRSDPRNLGNGIASVGGSFNY

SEQ ID NO: 1827 - DNA, 1239 bp, Arabidopsis thaliana
caaatatggaatacagctgtgtagacgacagtagtacaacgtcagaatctctctccatctctactactccaaagccgacaacgacgacggagaagaaactctcttctccgccggcgacgtcgatgcgtctctacagaatgggaagcggcggaagcagcgtcgttttggattcagagaacggcgtcgagaccgagtcacgtaagcttccttcgtcgaaatataaaggcgttgtgcctcagcctaacggaagatggggagctcagatttacgagaagcatcagcgagtttggctcggtactttcaacgaggaagaagaagctgcgtcttcttacgacatcgccgtgaggagattccgcggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttaccggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattctttttttttggtttttttcttcaatttgtttctcctttttcaatattttgtattgaaatgacaagttgtaaattaggacaagacaagaaaaaatgacaactagacaaaatagtttttgtttaaaaaaaaaaaaaaaaaaaa

SEQ ID NO: 1828 - protein, 361 aa, Arabidopsis thaliana
MEYSCVDDSSTTSESLSISTTPKPTTTTEKKLSSPPATSMRLYRMGSGGSSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 1829 - DNA, 1059 bp, Arabidopsis thaliana; identical to SEQ ID NO: 665

SEQ ID NO: 1830 - protein, 300 aa, Arabidopsis thaliana; identical to SEQ ID NO: 666

SEQ ID NO: 1831 - DNA, 913 bp, Arabidopsis thaliana; identical to SEQ ID NO: 669

SEQ ID NO: 1832 - protein, 243 aa, Arabidopsis thaliana; identical to SEQ ID NO: 670

SEQ ID NO: 1833 - DNA, 1291 bp, Arabidopsis thaliana
cctgtaaattcagatttgctttctttggtaatcttttggatcaagatccatctattttttcttcaatggcacaactccctcctaaaatccccaacatgacacaacattggcctgatttctcttcccaaaagctctctcctttctctaccccaaccgcaaccgctgtcgccaccgctacaaccaccgtacaaaacccctcatgggtcgacgaattcctcgacttctcagcgtctcgccgtggcaaccaccgtcgttccatcagcgactctatcgcattcctcgaagctccaacagtcagcatcgaagaccaccaattcgacaggttcgatgacgaacagttcatgtcgatgttcaccgacgacgacaaccttcatagcaatccttcccatatcaacaacaaaaataacaatgtggggcccacgggatcttcctcgaacacatccacgccgtccaatagcttcaacgacgataacaaagaattaccaccgtccgatcataacatgaacaataatatcaacaacaactataacgatgaagtccaaagccaatgcaagatggagccagaagatggtacggcgtcgaataacaattccggtgatagctccggcaaccggattctcgatcccaaaagggttaagagaatattagcaaatcggcaatcagcacagagatcaagggtgaggaaactgcaatacatatcagagctcgaacgtagcgtcacttcgttgcaggcggaagtgtcagtgttatcgccaagagttgcattcttggatcatcaacgtttgcttcttaacgttgacaacagcgctctcaagcaacgaatcgctgctttatctcaagacaagcttttcaaagacgcacatcaagaagcattgaagagagaaatagagagacttcgacaagtgtataatcaacaaagcctcacgaatgtggaaaatgcaaatcatttatcggcgaccggagccggtgctactccggccgtcgacatcaagtcgtccgttgaaacagagcagctcctcaatgtctcataaattaaccatcatgcatcatcatcaacatttctctcttttagcttcttggcaaaagttcttgactataaaatctctttcgggtaagaaattcaggagatatacattttttattctaatcacattgtttttaagttgtgatgaattcagtttgatgtatcttatttattttgtttatgtcgtctttttttcttggggttgatggaagggaatcatcaattgttgtttgtacaaagaactagttgaatttttttttttttttt

SEQ ID NO: 1834 - protein, 321 aa, Arabidopsis thaliana
MAQLPPKIPNMTQHWPDFSSQKLSPFSTPTATAVATATTTVQNPSWVDEFLDFSASRRGNHRRSISDSIAFLEAPTVSIEDHQFDRFDDEQFMSMFTDDDNLHSNPSHINNKNNNVGPTGSSSNTSTPSNSFNDDNKELPPSDHNMNNNINNNYNDEVQSQCKMEPEDGTASNNNSGDSSGNRILDPKRVKRILANRQSAQRSRVRKLQYISELERSVTSLQAEVSVLSPRVAFLDHQRLLLNVDNSALKQRIAALSQDKLFKDAHQEALKREIERLRQVYNQQSLTNVENANHLSATGAGATPAVDIKSSVETEQLLNVS

SEQ ID NO: 1835 - DNA, 923 bp, Arabidopsis thaliana; identical to SEQ ID NO: 705

SEQ ID NO: 1836 - protein, 262 aa, Arabidopsis thaliana; identical to SEQ ID NO: 706

SEQ ID NO: 1837 - DNA, 1473 bp, Arabidopsis thaliana; identical to SEQ ID NO: 717

SEQ ID NO: 1838 - protein, 311 aa, Arabidopsis thaliana; identical to SEQ ID NO: 718

SEQ ID NO: 1839 - DNA, 1342 bp, Arabidopsis thaliana; identical to SEQ ID NO: 727

SEQ ID NO: 1840 - protein, 292 aa, Arabidopsis thaliana; identical to SEQ ID NO: 728

SEQ ID NO: 1841 - DNA, 2215 bp, Arabidopsis thaliana; identical to SEQ ID NO: 745

SEQ ID NO: 1842 - protein, 592 aa, Arabidopsis thaliana; identical to SEQ ID NO: 746

SEQ ID NO: 1843 - DNA, 1374 bp, Arabidopsis thaliana; identical to SEQ ID NO: 765
  misc_feature (1144)..(1144): n is a, c, g, or t
  misc_feature (1209)..(1209): n is a, c, g, or t
  misc_feature (1212)..(1212): n is a, c, g, or t
  misc_feature (1238)..(1238): n is a, c, g, or t
  misc_feature (1254)..(1254): n is a, c, g, or t
  misc_feature (1260)..(1261): n is a, c, g, or t
  misc_feature (1296)..(1296): n is a, c, g, or t
  misc_feature (1322)..(1322): n is a, c, g, or t
  misc_feature (1325)..(1325): n is a, c, g, or t
  misc_feature (1360)..(1360): n is a, c, g, or t

SEQ ID NO: 1844 - protein, 358 aa, Arabidopsis thaliana; identical to SEQ ID NO: 766

SEQ ID NO: 1845 - DNA, 3174 bp, Arabidopsis thaliana; identical to SEQ ID NO: 789

SEQ ID NO: 1846 - protein, 1057 aa, Arabidopsis thaliana; identical to SEQ ID NO: 790

SEQ ID NO: 1847 - DNA, 911 bp, Arabidopsis thaliana; identical to SEQ ID NO: 809

SEQ ID NO: 1848 - protein, 153 aa, Arabidopsis thaliana; identical to SEQ ID NO: 810

SEQ ID NO: 1849 - DNA, 1662 bp, Arabidopsis thaliana; identical to SEQ ID NO: 847

SEQ ID NO: 1850 - protein, 553 aa, Arabidopsis thaliana; identical to SEQ ID NO: 848

SEQ ID NO: 1851 - DNA, 925 bp, Arabidopsis thaliana
ccacgcgtccgtaccttttacaatttgtttatatattttacgtatctatctttgttccatggagggttcgtccaaagggctgcgaaaaggtgcttggactactgaagaagatagtctcttgagacagtgcattaataagtatggagaaggcaaatggcaccaagttcctgtaagagctgggctaaaccggtgcaggaaaagttgtagattaagatggttgaactatttgaagccaagtatcaagagaggaaaacttagctctgatgaagtcgatcttcttcttcgccttcataggcttctagggaataggtggtctttaattgctggaagattacctggtcggaccgcaaatgacgtcaagaattactggaacactcatctgagtaagaaacatgaaccgtgttgtaagataaagatgaaaaagagagacattacgcccattcctacaacaccggcactaaaaaacaatgtttataagcctcgacctcgatccttcacagttaacaacgactgcaaccatctcaatgccccaccaaaagttgacgttaatcctccatgccttggacttaacatcaataatgtttgtgacaatagtatcatatacaacaaagataagaagaaagaccaactagtgaataatttgattgatggagataatatgtggttagagaaattcctaaggaaagccaagaggtagatattttggttcctgaagcgacgacaacagaaaagggggacaccttggcttttgacgttgatcaactttggagtcttttcgatggagagactgtgaaatttgattagtgtttcgaacatttgtttgcgtttgtgtataggtttgctttcaccttttaatttgtgtgttttgataaataagctaatagtttttagcattttaatgaaatatttcaagtttccgtgttac

SEQ ID NO: 1852 - protein, 212 aa, Arabidopsis thaliana
MEGSSKGLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKKHEPCCKIKMKKRDITPIPTTPALKNNVYKPRPRSFTVNNDCNHLNAPPKVDVNPPCLGLNINNVCDNSIIYNKDKKKDQLVNNLIDGDNMWLEKFLRKAKR

SEQ ID NO: 1853 - DNA, 1230 bp, Arabidopsis thaliana
atggctagtcggagagaagtacggtgccggtgcggcagacggatgtgggttcaaccagacgcccgtaccgtccaatgctcaacctgccacaccgtcacgcagctctactcgctagtggacatagctcgcggtgcaaaccgcataattcatgggtttcaacagctacttagacaacaccaaccgcaacatcatgaacaacaacaacaacaaatgatggctcaaccgccaccacggctgcttgagcctcttccctcgccgtttgggaagaagagagcagttttatgcggcgtgaactataagggaaaaagttatagcttgaaaggttgcatcagtgatgctaagtccatgagatctttattggttcaacaaatgggtttccctattgactctattctcatgctcacagaagatgaagccagcccgcagagaataccgacgaagagaaacattaggaaggcgatgagatggttagttgaagggaacagagcaagggactcactagtgttccatttctctggtcatggatctcagcagaatgactacaacggagacgagatcgatggtcaagatgaagccttgtgccctttagaccatgaaacagaaggaaaaatcattgatgacgagattaaccggatactcgtgaggcctctcgtccatggagctaagcttcacgctgtcatcgacgcctgtaacagcgggactgtccttgatttacccttcatttgcaggatggagaggaatggttcttatgaatgggaagaccatagatcagtcagagcttacaaaggaacagatggtggagcagctttctgtttcagtgcttgtgacgatgatgaatccagtggttacactcctgtgttcacggggaagaacacaggagccatgacttatagcttcataaaggcggtgaagacagctggaccagcacccacgtatggccacctgcttaaccttatgtgttctgcaatacgagaggcccagtctcgcctcgcctttaacggggactacacaagctctgatgcatccgcggagccactgctaacatcatctgaggaatttgacgtgtacgcgacaaagtttgtactctgaatgctgtacatatgatgctgcaaatagctcggaaacgtttctatgtgtatgtatcatgtaatgattatgttgcatagcctctctcttcttacgagcaataagctatgaaataattgattcgctaagaaatttaaaatgaaa

SEQ ID NO: 1854 - protein, 362 aa, Arabidopsis thaliana
MASRREVRCRCGRRMWVQPDARTVQCSTCHTVTQLYSLVDIARGANRIIHGFQQLLRQHQPQHHEQQQQQMMAQPPPRLLEPLPSPFGKKRAVLCGVNYKGKSYSLKGCISDAKSMRSLLVQQMGFPIDSILMLTEDEASPQRIPTKRNIRKAMRWLVEGNRARDSLVFHFSGHGSQQNDYNGDEIDGQDEALCPLDHETEGKIIDDEINRILVRPLVHGAKLHAVIDACNSGTVLDLPFICRMERNGSYEWEDHRSVRAYKGTDGGAAFCFSACDDDESSGYTPVFTGKNTGAMTYSFIKAVKTAGPAPTYGHLLNLMCSAIREAQSRLAFNGDYTSSDASAEPLLTSSEEFDVYATKFVL

SEQ ID NO: 1855 - DNA, 537 bp, Arabidopsis thaliana
atggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagggtgacacaaagggatcagcaaaaggtggggatccaaatgcaaagaaagatgggcaatcaagccaaaatggccagttctcgcagcttgctcaccaaggtccttatgggaactctcaagtaacttttcctctcttctcttcacactcaagcaatacgcatcattctcttctaatttgttaa

SEQ ID NO: 1856 - protein, 178 aa, Arabidopsis thaliana
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREGDTKGSAKGGDPNAKKDGQSSQNGQFSQLAHQGPYGNSQVTFPLFSSHSSNTHHSLLIC

SEQ ID NO: 1857 - DNA, 839 bp, Arabidopsis thaliana
ctctgcctctctctctctctcaaaacccatctcgaaagtctttctctttcgagggtttagatcctccatggaaggcggcggagttgctgacgtggctgtccccggtacgaggaagagagacagaccttacaaaggaattaggatgaggaagtggggaaagtgggtggcggagattcgtgagcctaacaagcgctctaggttatggcttggctcttactctactcccgaggcggcggcgcgagcttacgacacggcggttttctatcttagaggacctacggcgaggcttaacttccctgagcttcttcctggggagaaattctccgacgaggatatgtcggctgcgaccatcaggaagaaagccacggaggtcggtgctcaggttgatgctttgggcacggcggtgcaaaataaccgccaccgtgtttttggtcagaatcgagatagtgatgtggataataagaattttcatcggaattatcaaaacggtgaacgagaagaagaagaagaagatgaggatgacaagagattgaggagtggcggccggttattggatcgggttgacttgaataaattacccgacccggaaagctccgatgaagaatgggaaagcaaacattaaaaatatatagtttggagcggtggctgttgctaacgtacgccaacggcttgcttctacgaatcattagcgccgtttatgatttttttttttttttttttcattatctgaaaatttagggctttttagttattaatttttgttttgtttttttcctttcttgcgagttttgcggtttatggaattttaggctattgcttaacgaaaaaaaaaaaaaaaa

SEQ ID NO: 1858 - protein, 184 aa, Arabidopsis thaliana
MEGGGVADVAVPGTRKRDRPYKGIRMRKWGKWVAEIREPNKRSRLWLGSYSTPEAAARAYDTAVFYLRGPTARLNFPELLPGEKFSDEDMSAATIRKKATEVGAQVDALGTAVQNNRHRVFGQNRDSDVDNKNFHRNYQNGEREEEEEDEDDKRLRSGGRLLDRVDLNKLPDPESSDEEWESKH

SEQ ID NO: 1859 - DNA, 844 bp, Arabidopsis thaliana
tctctctcccactctcactttctctcctattcttagttcgtgtcagaaacacacagagaaattaagaaccctaatttaaaacagaagaatggtacattcgaagaagttccgaggtgtccgccagcgtcagtggggttcttgggtttctgagattcgtcatcctctcttgaagagaagagtgtggctaggaacattcgacacggcggaaacagcggctagagcctacgaccaagccgcggttctaatgaacggccagagcgcgaagactaacttccccgtcatcaaatcgaacggttcaaattccttggagattaactctgcgttaaggtctcccaaatcattatcggaactattgaacgctaagctaaggaagaactgtaaagaccagacaccgtatctgacgtgtctccgcctcgacaacgacagctcacacatcggcgtctggcagaaacgcgccgggtcaaaaacgagtccaaactgggtcaagcttgttgaactaggtgacaaagttaacgcacgtcccggtggtgatattgagactaataagatgaaggtacgaaacgaagacgttcaggaagatgatcaaatggcgatgcagatgatcgaggagttgcttaactggacctgtcctggatctggatccattgcacaggtctaaaggagaatcattgaattatatgatcaagataataatatagttgagggttaataataatcgagggtaagtaatttacgtgtagctaataattaatataattttcgaacatatatatgaatatatgatagctctagaaatgagtacgtatatatacgtaaacatttttcctcaaatatagtatatgtg

SEQ ID NO: 1860 - protein, 189 aa, Arabidopsis thaliana
MVHSKKFRGVRQRQWGSWVSEIRHPLLKRRVWLGTFDTAETAARAYDQAAVLMNGQSAKTNFPVIKSNGSNSLEINSALRSPKSLSELLNAKLRKNCKDQTPYLTCLRLDNDSSHIGVWQKRAGSKTSPNWVKLVELGDKVNARPGGDIETNKMKVRNEDVQEDDQMAMQMIEELLNWTCPGSGSIAQV

SEQ ID NO: 1861 - DNA, 820 bp, Arabidopsis thaliana
gaagactccaacataattcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttcc

SEQ ID NO: 1862 - protein, 221 aa, Arabidopsis thaliana
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLVVT

SEQ ID NO: 1863 - DNA, 1218 bp, Arabidopsis thaliana
atgaaaagtttggctagtgcggttggagggaagacggcgagggcatgtgatagctgcgtgaagaggcgggcacgttggtattgcgcagctgatgatgcctttctttgccatgcttgtgacggttcggtccactcggcaaaccctcttgctcgtaggcacgagagagttcgcttgaaatcggctagcgccggaaagtatcgccatgcctcgccgcctcaccaagccacgtggcatcagggatttacacgtaaagctcggaccccacgtggaggcaagaagagccacacgatggtttttcatgatcttgtgccggagatgagcacggaggatcaagcggagagttacgaggtggaagagcagctcatatttgaggtgccggtgatgaactcgatggttgaggagcaatgctttaaccaatccctggagaaacagaatgagtttccaatgatgcccttaagtttcaagagtagtgacgaagaagatgacgacaacgctgagagttgtctgaatggtttgttcccaaccgacatggaactagctcagttcacagctgacgtggagactctactcggtggaggggatcgagagtttcattccatagaagaactagggttaggtgagatgttaaagatcgaaaaagaggaggtggaggaagagggagttgtgacaagagaagtgcatgatcaagatgaaggtgatgagacatccccatttgaaataagctttgactacgagtacacacacaagaccacattcgatgaaggagaagaagatgagaaagaagacgtgatgaagaatgtgatggagatgggagtgaatgagatgagtggtgggattaaagaagagaagaaggagaaggctcttatgcttagattggactatgaatcagtcatttccacttggggaggccaagggatcccatggaccgcccgggtgccatctgaaatagacctcgacatggtttgtttcccaacccataccatgggtgaaagtggagcagaggctcatcatcacaaccacttccgcggcctagggttacacctaggagatgctggggatggaggaagagaggctagggtttcaagataccgagagaaaaggaggacaaggttgttctccaagaagataaggtacgaggtacgtaaattgaatgcagagaaaaggcctcgcatgaaaggaaggttcgtcaagagatcttcaattggtgttgctcactaa

SEQ ID NO: 1864 - protein, 405 aa, Arabidopsis thaliana
MKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNAEKRPRMKGRFVKRSSIGVAH

SEQ ID NO: 1865 - DNA, 1424 bp, Arabidopsis thaliana
tcgacagagttgtgttgggcgtggaacttggactagttccacatatcaggttatatagatcttctctttcaacttctgattcgtccagaagctttcctaatctgagatctgacatggaacaccaaggttggagttttgaggagaattatagtttgtccactaatagaagatctatcaggccacaagatgaactagtggagttattatggcgagatggacaagtggttctgcagagccaaactcatagagaacaaacccaaacccagaaacaagatcatcatgaagaagccctaagatccagcacctttcttgaagatcaagaaactgtctcttggatccaataccctccagatgaagacccattcgaacccgacgacttctcctcccacttcttctcaaccatggatcccctccagagaccaacctcagagacggttaagcctaagtccagtcctgaacctcctcaagtcatggttaagcctaaggcctgtcctgaccctcctcctcaagtcatgcctcctccaaaatttaggttaacaaattcatcatcggggattagggaaacagaaatggaacagtactcggtaacgaccgttggacctagccattgcggaagcaacccatcacagaacgatctcgatgtctcaatgagtcatgatcgaagcaaaaacatagaagaaaagcttaatccgaacgcaagttcctcatcaggtggctcctctggttgcagctttggcaaagatatcaaagaaatggctagtggaagatgcatcacaaccgaccgtaagagaaaacgtataaatcacactgacgaatctgtatctctatcagatgcaatcggtaacaagtcgaaccaacgatcaggatcaaaccgaaggagtcgagcagctgaagttcataatctctccgaaaggaggaggagagataggatcaatgagagaatgaaggctttgcaagaactaatacctcactgcagtaaaactgataaagcttcgattttagacgaagccatagattatttgaaatcacttcagttacagcttcaagtgatgtggatggggagtggaatggcggcggcggcggcttcggctccgatgatgttccccggagttcaacctcagcagttcatacgtcagatacagagcccggtacagttacctcgatttccggttatggatcagtctgcaattcagaacaatcccggtttagtttgccaaaacccggtacaaaaccagatcatctccgaccggtttgctagatacatcggtgggttcccacacatgcaggccgcgactcagatgcagccgatggagatgttgagatttagttcaccggcgggacagcaaagtcaacaaccgtcgtctgtgccgacgaagaccaccgacggttctcgtttggaccactaggttggtgagccactttgc

SEQ ID NO: 1866 - protein, 430 aa, Arabidopsis thaliana
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERRRRDRINERMKALQELIPHCSKTDKASILDEAIDYLKSLQLQLQVMWMGSGMAAAAASAPMMFPGVQPQQFIRQIQSPVQLPRFPVMDQSAIQNNPGLVCQNPVQNQIISDRFARYIGGFPHMQAATQMQPMEMLRFSSPAGQQSQQPSSVPTKTTDGSRLDH

SEQ ID NO: 1867 - DNA, 2511 bp, Arabidopsis thaliana
atggcaatgtcttgcaaggatggtaagttgggatgtttggataatgggaagtatgtgaggtatacacctgaacaagttgaagcacttgagaggctttatcatgactgtcctaaaccgagttctattcgccgtcagcagttgatcagagagtgtcctattctctctaacattgagcctaaacagatcaaagtgtggtttcagaaccgaagatgtagagagaaacaaaggaaagaggcttcacggcttcaagctgtgaatcggaagttgacggcaatgaacaagctcttgatggaggagaatgacaggttgcagaagcaagtgtcacagctggtccatgaaaacagctacttccgtcaacatactccaaatccttcactcccagctaaagacacaagctgtgaatcggtggtgacgagtggtcagcaccaattggcatctcaaaatcctcagagagatgctagtcctgcaggacttttgtccattgcagaagaaactttagcagagtttctttcaaaggcaactggaaccgctgttgagtgggttcagatgcctggaatgaagcctggtccggattccattggaatcatcgctatttctcatggttgcactggtgtggcagcacgcgcctgtggcctagtgggtcttgagcctacaagggttgcagagattgtcaaggatcgtccttcgtggttccgcgaatgtcgagctgttgaagttatgaacgtgttgccaactgccaatggtggaaccgttgagctgctttatatgcagctctatgcaccaactacattggccccaccacgcgatttctggctgttacgttacacctctgttttagaagatggcagccttgtggtgtgcgagagatctcttaagagcactcaaaatggtcctagtatgccactggttcagaattttgtgagagcagagatgctttccagtgggtacttgatacggccttgtgatggtggtggctcaatcatacacatagtggatcatatggatttggaggcttgtagcgtgcctgaggtcttgcgcccgctctatgagtcacccaaagtacttgcacagaagacaacaatggcggcactgcgtcagctcaagcaaatagctcaggaggttactcagactaatagtagtgttaatgggtggggacggcgtcctgctgccttaagagctctcagccagaggctaagcagaggcttcaatgaagctgtaaatggtttcactgatgaaggatggtcagtgataggagatagcatggatgatgtcacaatcactgtaaactcttctccagacaagctaatgggtctaaatcttacatttgccaatggctttgctcctgtaagcaatgttgttttatgcgcaaaagcatcaatgcttttacagaatgttcctccggcgatcctgcttcggtttctgagggagcataggtcagaatgggctgacaacaacattgatgcgtatctagcagcagcagttaaagtagggccttgtagtgcccgagttggaggatttggagggcaggttatacttccacttgctcatactattgagcatgaagagtttatggaagtcatcaaattggaaggtcttggtcattcccctgaagatgcaatcgttccaagagatatcttccttcttcaactttgtagcggaatggatgaaaatgctgtaggaacctgtgcggaacttatatttgctccaatcgatgcttcgtttgcggatgatgcacctctgcttccttctggttttcgtattatccctcttgattccgcaaaggaagtatctagcccaaaccgaaccttggatcttgcttcggcactggaaattggttcagctggaacaaaagcctcaactgatcaatcaggaaactccacatgtgcaagatctgtgatgacaatagcatttgagtttggtatcgagagccatatgcaagaacatgtagcatccatggctaggcagtatgttcgaggtatcatatcatcggtgcagagagtagcattggctctttctccttctcatatcagctcacaagttggtctacgcactcctttgggtactcctgaagcccaaacacttgctcgttggatttgccagagttacaggggctacatgggtgttgagctacttaaatcaaacagtgacggcaatgaatctattcttaagaatctttggcatcacactgatgctataatctgctgctcaatgaaggccttgcccgtcttcacatttgcaaaccaggcgggacttgacatgctggagactacattagttgctcttcaagacatctctttagagaagatatttgatgacaatggaagaaagactctttgctctgagttcccacagatcatgcaacagggcttcgcgtgccttcaaggcgggatatgtctctcaagcatggggagaccagtttcgtatgagagagcagttgcttggaaagtactcaatgaagaagaaaatgctcattgcatctgctttgtgttcatcaattggtcctttgtgtga

SEQ ID NO: 1868 - protein, 836 aa, Arabidopsis thaliana
MAMSCKDGKLGCLDNGKYVRYTPEQVEALERLYHDCPKPSSIRRQQLIRECPILSNIEPKQIKVWFQNRRCREKQRKEASRLQAVNRKLTAMNKLLMEENDRLQKQVSQLVHENSYFRQHTPNPSLPAKDTSCESVVTSGQHQLASQNPQRDASPAGLLSIAEETLAEFLSKATGTAVEWVQMPGMKPGPDSIGIIAISHGCTGVAARACGLVGLEPTRVAEIVKDRPSWFRECRAVEVMNVLPTANGGTVELLYMQLYAPTTLAPPRDFWLLRYTSVLEDGSLVVCERSLKSTQNGPSMPLVQNFVRAEMLSSGYLIRPCDGGGSIIHIVDHMDLEACSVPEVLRPLYESPKVLAQKTTMAALRQLKQIAQEVTQTNSSVNGWGRRPAALRALSQRLSRGFNEAVNGFTDEGWSVIGDSMDDVTITVNSSPDKLMGLNLTFANGFAPVSNVVLCAKASMLLQNVPPAILLRFLREHRSEWADNNIDAYLAAAVKVGPCSARVGGFGGQVILPLAHTIEHEEFMEVIKLEGLGHSPEDAIVPRDIFLLQLCSGMDENAVGTCAELIFAPIDASFADDAPLLPSGFRIIPLDSAKEVSSPNRTLDLASALEIGSAGTKASTDQSGNSTCARSVMTIAFEFGIESHMQEHVASMARQYVRGIISSVQRVALALSPSHISSQVGLRTPLGTPEAQTLARWICQSYRGYMGVELLKSNSDGNESILKNLWHHTDAIICCSMKALPVFTFANQAGLDMLETTLVALQDISLEKIFDDNGRKTLCSEFPQIMQQGFACLQGGICLSSMGRPVSYERAVAWKVLNEEENAHCICFVFINWSFV

SEQ ID NO: 1869 - DNA, 1564 bp, Arabidopsis thaliana; identical to SEQ ID NO: 933

SEQ ID NO: 1870 - protein, 450 aa, Arabidopsis thaliana; identical to SEQ ID NO: 934

SEQ ID NO: 1871 - DNA, 1136 bp, Arabidopsis thaliana
cccttttcctctctttctccaaatctctgaaaattttcaccagaatctctgttctttttttcaccagaatctctctgtttaaaataataggtgatgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtgtgatatttttgccattaaccaaacaccggtttggttgc

SEQ ID NO: 1872 - protein, 335 aa, Arabidopsis thaliana
MMMDEFMDLRPVKYTEHKTVIRKYTKKSSMERKTSVRDSARLVRVSMTDRDATDSSSDEEEFLFPRRRVKRLINEIRVEPSSSSTGDVSASPTKDRKRINVDSTVQKPSVSGQNQKKYRGVRQRPWGKWAAEIRDPEQRRRIWLGTFATAEEAAIVYDNAAIKLRGPDALTNFTVQPEPEPVQEQEQEPESNMSVSISESMDDSQHLSSPTSVLNYQTYVSEEPIDSLIKPVKQEFLEPEQEPISWHLGEGNTNTNDDSFPLDITFLDNYFNESLPDISIFDQPMSPIQPTENDFFNDLMLFDSNAEEYYSSEIKEIGSSFNDLDDSLISDLLLV

SEQ ID NO: 1873 - DNA, 943 bp, Arabidopsis thaliana
cgagaaaaggaaaaaaaaaaatagaaagagaaaacgcttagtatctccggcgacttgaacccaaacctgaggatcaaattagggcacaaagccctctcggagagaagccatgggaagaaaaaaactagaaatcaagcgaattgagaacaaaagtagccgacaagtcaccttctccaaacgtcgcaacggtctcatcgagaaagctcgtcagctttctgttctctgtgacgcatccgtcgctcttctcgtcgtctccgcctccggcaagctctacagcttctcctccggcgataacctggtcaagatccttgatcgatatgggaaacagcatgctgatgatcttaaagccttggatcatcagtcaaaagctctgaactatggttcacactatgagctacttgaacttgtggatagcaagcttgtgggatcaaatgtcaaaaatgtgagtatcgatgctcttgttcaactggaggaacaccttgagactgccctctccgtgactagagccaagaagaccgaactcatgttgaagcttgttgagaatcttaaagaaaaggagaaaatgctgaaagaagagaaccaggttttggctagccagatggagaataatcatcatgtgggagcagaagctgagatggagatgtcacctgctggacaaatctccgacaatcttccggtgactctcccactacttaattagccaccttaaatcggcggttgaaatcaaaatccaaaacatatataattatgaagaaaaaaaaaataagatatgtaattattccgctgataagggcgagcgtttgtatatcttaatactctctctttggccaagagactttgtgtgtgatacttaagtagacggaactaagtcaatactatctgttttaagacaaaaggttgatgaactttgtaccttattcgtgtgagaaaaaaaaaaaaaaaa

SEQ ID NO: 1874 - protein, 196 aa, Arabidopsis thaliana
MGRKKLEIKRIENKSSRQVTFSKRRNGLIEKARQLSVLCDASVALLVVSASGKLYSFSSGDNLVKILDRYGKQHADDLKALDHQSKALNYGSHYELLELVDSKLVGSNVKNVSIDALVQLEEHLETALSVTRAKKTELMLKLVENLKEKEKMLKEENQVLASQMENNHHVGAEAEMEMSPAGQISDNLPVTLPLLN

SEQ ID NO: 1875 - DNA, 705 bp, Arabidopsis thaliana
atgaaaaaaaattatcaaaagaagaatataaaggtggtgagcacaagcaaatatttgaagaaaagtgacatcgacaaagtaaactggacagaatctgaggacataaaattgaaagagataatggcgcttggacccaaaaacaaatggacaaaggtcgcaaaaaaattcgaaggaagaacaggaaaacaatgcagagagaggtggtataaccatgctcgtcctaacattaagaaaactgcttggagtgaagaagaagatcaaattttgattgaagcacacaaagtacttggtaccaaatgggtcgagatcgcacagcaacttccggggaggagcgataacaatattaagaaccattggaacaccacaaagcgtcgggtgcaaaataaaagaggtggaactgtcaaccctgtcggcaataacatccttgaaaactacataaggtgtatcacaatcaacaacgaagattttcttaagaccgatggatcttatggtgaaccgacaaacattgagagtgatgatgactctaaagatatgttatacggggagatgaatttgagtctagagactataacgacgcagaccaccaaaccattgaccaatgcttctacaacatcaccttatgttcagatgccagaagataattatactatggaggattgtgaatcactggaggacattctagagctgctgcgttggtgggaataa

SEQ ID NO: 1876 - protein, 234 aa, Arabidopsis thaliana
MKKNYQKKNIKVVSTSKYLKKSDIDKVNWTESEDIKLKEIMALGPKNKWTKVAKKFEGRTGKQCRERWYNHARPNIKKTAWSEEEDQILIEAHKVLGTKWVEIAQQLPGRSDNNIKNHWNTTKRRVQNKRGGTVNPVGNNILENYIRCITINNEDFLKTDGSYGEPTNIESDDDSKDMLYGEMNLSLETITTQTTKPLTNASTTSPYVQMPEDNYTMEDCESLEDILELLRWWE

SEQ ID NO: 1877 - DNA, 1356 bp, Arabidopsis thaliana
atgcagagcagcttcaaaaccgttcctttcactcctgatttctactctcaatcctcttacttcttcagaggagatagttgtcttgaggagtttcatcaaccagtcaatggttttcaccatgaagaagctatcgatttaagtccaaatgtcactattgcttcagctaacttacactacacgacgtttgatacggttatggattgtggtggtggtggtggtggcttgagggagagacttgaaggaggagaagaggagtgtttggacacagggcaattagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaagggatgctattggctacaaattgttcagatcaatccaatgtgaaatctagtgatcaaaggacacttcgtcgacttgctcagaaccgggaggctgctaggaaaagtcggttgaggaaaaaggcctatgttcagcaacttgagaatagtcgaatcaggcttgcacagctagaggaagagctcaaaagagctcgccaacagggatctttggttgaaagaggagtttcagcggatcacacgcatttggcagcaggaaatggtgtcttttcatttgaattggaatatacacgttggaaggaggaacatcaaagaatgatcaacgacttaagatcgggtgtgaattcgcagttaggtgacaacgatctacgcgttctagtggatgctgtgatgagtcactatgatgaaatattcaggctaaagggaattggcactaaagttgaagtctttcatatgctctcaggcatgtggaagacacctgccgagagatttttcatgtggttaggtggatttagatcatcagagttacttaagatattggggaaccatgtggatccattgacggaccagcagttgataggcatttgcaaccttcagcaatcgtctcaacaagcagaggatgcattgtcacaaggcatggaagctctacaacaatcacttctcgagacgctttcttctgcttctatgggtccaaactcttcagcaaatgttgcagattatatgggtcatatggctatggctatgggcaaacttggcactcttgaaaacttccttcgccaggctgatttattgaggcaacaaactctgcaacagcttcacagaattctcaccacacgacaagctgctcgcgcctttttggtcatccacgattatatttctcggcttagagcacttagctctctatggttagccagacctagagactaa

SEQ ID NO: 1878 - protein, 451 aa, Arabidopsis thaliana
MQSSFKTVPFTPDFYSQSSYFFRGDSCLEEFHQPVNGFHHEEAIDLSPNVTIASANLHYTTFDTVMDCGGGGGGLRERLEGGEEECLDTGQLVYQKGTRLVGGGVGEVNSSWCDSVSAMADNSQHTDTSTDIDTDDKTQLNGGHQGMLLATNCSDQSNVKSSDQRTLRRLAQNREAARKSRLRKKAYVQQLENSRIRLAQLEEELKRARQQGSLVERGVSADHTHLAAGNGVFSFELEYTRWKEEHQRMINDLRSGVNSQLGDNDLRVLVDAVMSHYDEIFRLKGIGTKVEVFHMLSGMWKTPAERFFMWLGGFRSSELLKILGNHVDPLTDQQLIGICNLQQSSQQAEDALSQGMEALQQSLLETLSSASMGPNSSANVADYMGHMAMAMGKLGTLENFLRQADLLRQQTLQQLHRILTTRQAARAFLVIHDYISRLRALSSLWLARPRD

SEQ ID NO: 1879 - DNA, 318 bp, Arabidopsis thaliana; identical to SEQ ID NO: 939

SEQ ID NO: 1880 - protein, 105 aa, Arabidopsis thaliana; identical to SEQ ID NO: 940

SEQ ID NO: 1881 - DNA, 1059 bp, Arabidopsis thaliana; identical to SEQ ID NO: 943

SEQ ID NO: 1882 - protein, 196 aa, Arabidopsis thaliana; identical to SEQ ID NO: 944

SEQ ID NO: 1883 - DNA, 818 bp, Arabidopsis thaliana; identical to SEQ ID NO: 945

SEQ ID NO: 1884 - protein, 200 aa, Arabidopsis thaliana; identical to SEQ ID NO: 946

SEQ ID NO: 1885 - DNA, 834 bp, Arabidopsis thaliana; identical to SEQ ID NO: 947

SEQ ID NO: 1886 - protein, 198 aa, Arabidopsis thaliana; identical to SEQ ID NO: 948

SEQ ID NO: 1887 - DNA, 1182 bp, Arabidopsis thaliana
atgttgttgctggtggactgctccagctgtcgtacgccgcttcaccttcctcccggagccacccgaatccgctgcgccatttgtcacgccttcactctcatcgcccccgagccccgtctccaatctcacgcgtcggcgagcccttttcctttccccaactcatctccggctccatccactttcatctacccgccgccaacaccttctccgtacactcacgcgccgcatgcaccgtctccattcaaccacgcgcctccagattcttacccgttcactcacgcgcctccagcatcgtctccattcaaccacgcgccgccgggtcctccaccgccggtacatggacagaagcgagcggtgatagtcggggtttcttacaagaacacaaaggacgaactcaaaggatgtatcaatgacgcaaactgcatgaagttcatgttgatgaagcgtttccaattccctgaatcttgcattcttatgctcaccgaagaagaagcggacccaatgagatggccaacgaagaacaacataacaatggcgatgcattggcttgttcttagctgcaaaccgggagattccctcgtctttcacttctccggtcacggcaacaaccagatggacgacaacggcgacgaggttgacggcttcgatgagactcttctcccggtggaccacaggacttcaggtgtcatcgtggacgatgagatcaatgctacaatcgtacggccgctcccttatggagttaagctccatgccatcgtcgacgcttgtcatagtggtaccgtcatggacttaccttatctttgtagaatggacaggctcggaaactatgaatgggaagaccatcggcctaaaacaggaatgtggaaaggtacgagtggcggtgaagtcttctccttcacaggctgcgatgatgaccagacctcggctgacactccggccatagaacgtggccacgggatgacttatgggagcttgctgaatgcaatgagatcaacggttcatgagatcttcgacaaaaacaaaggtagagagcttgtggaagtgggaggtgctgattttctctctactcttcttggtttgctcatcttaggcgcttctcctcctgatgaggaagaggaagtaaaccaagcccctcaaaaaactcaggtgatccattcatctatactaattatttttatctaa

SEQ ID NO: 1888 - protein, 393 aa, Arabidopsis thaliana
MLLLVDCSSCRTPLHLPPGATRIRCAICHAFTLIAPEPRLQSHASASPFPFPNSSPAPSTFIYPPPTPSPYTHAPHAPSPFNHAPPDSYPFTHAPPASSPFNHAPPGPPPPVHGQKRAVIVGVSYKNTKDELKGCINDANCMKFMLMKRFQFPESCILMLTEEEADPMRWPTKNNITMAMHWLVLSCKPGDSLVFHFSGHGNNQMDDNGDEVDGFDETLLPVDHRTSGVIVDDEINATIVRPLPYGVKLHAIVDACHSGTVMDLPYLCRMDRLGNYEWEDHRPKTGMWKGTSGGEVFSFTGCDDDQTSADTPAIERGHGMTYGSLLNAMRSTVHEIFDKNKGRELVEVGGADFLSTLLGLLILGASPPDEEEEVNQAPQKTQVIHSSILIIFI

SEQ ID NO: 1889 - DNA, 729 bp, Arabidopsis thaliana
atgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttga

SEQ ID NO: 1890 - protein, 242 aa, Arabidopsis thaliana
MKIWCAVCDKEEASVFCCADEAALCNGCDRHVHFANKLAGKHLRFSLTSPTFKDAPLCDICGERRALLFCQEDRAILCRECDIPIHQANEHTKKHNRFLLTGVKISASPSAYPRASNSNSAAAFGRAKTRPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 1891 - DNA, 1155 bp, Arabidopsis thaliana
attcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagatta

SEQ ID NO: 1892 - protein, 333 aa, Arabidopsis thaliana
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKKQRVL

SEQ ID NO: 1893 - DNA, 762 bp, Arabidopsis thaliana
atggacgaggctaccggagaaacagaaactcaagatttcatgaacgtcgaatccttctctcagcttcctttcattcgccgtcctaaagataagaaccctaaacccattcgtgtcttcggaaaagatttcaccggcagagatttctctattactaccggtcaagaagactacaccgatccttaccagaccaaaaacaaagaagaagaagaggaagaagaccaaaccggagacaacagtacggacaataatagcatcagccacaacaggagattcgagtgtcactattgctttagaaattttcctacttcacaagccctaggtggacaccaaaacgctcacaaacgcgaacgtcagcttgccaaacgcggtgtttcctcttacttttatcatcctgacaataacccttacagttaccgtcattacccgtcgtggaccaatggtccgttaaccgcggctaggtcctatggaggattttcttctggtcctaagccgtcggggtattattcacgacccagctatgggagtcagttaggactatggcgtctaccgcctcgcgttcaaggcgtttataactcaaacgcagcgtttactagtaatggctcttcttcttcttctaattcgactttaccgttgttgacccgttctcaaactcaactatcatcgcaagtgggtggctccgctgctcagaacagaatgtcatcgtacggttacggattgagccctaacgtgcaagatcatgtgagtctcgatcttcatctttaa

SEQ ID NO: 1894 - protein, 253 aa, Arabidopsis thaliana
MDEATGETETQDFMNVESFSQLPFIRRPKDKNPKPIRVFGKDFTGRDFSITTGQEDYTDPYQTKNKEEEEEEDQTGDNSTDNNSISHNRRFECHYCFRNFPTSQALGGHQNAHKRERQLAKRGVSSYFYHPDNNPYSYRHYPSWTNGPLTAARSYGGFSSGPKPSGYYSRPSYGSQLGLWRLPPRVQGVYNSNAAFTSNGSSSSSNSTLPLLTRSQTQLSSQVGGSAAQNRMSSYGYGLSPNVQDHVSLDLHL

SEQ ID NO: 1895 - DNA, 1014 bp, Arabidopsis thaliana
atggagccaaagtgtgaccattgtgcaacctcgcaagcattgatttactgcaaatccgatttggctaaactatgcctaaactgcgacgtccatgtacactctgcgaatcctctgtctcacaggcacatacgctctttgatctgcgagaaatgcttctcacagccagccgcaatccgctgtctcgacgagaaggtttcatactgccaaggatgtcattggcacgaaagcaactgttcggagttaggacacagagttcagagcttgaatcctttctctggttgtccttctcctacagattttaacagaatgtggtcttcaattcttgaacctcctgtctccggcttgcttagtccgttcgttggttcttttcccttgaatgatctcaacaataccatgttcgataccgcttattccatggtaccacacaacatcagttacactcagaatttcagtgataatttgtctttcttttccacggaatctaagggatatcctgatatggttcttaaacttgaagaaggagaagaagatctatgtgaagggcttaacttggatgatgcaccattaaactttgacgtaggagatgatattatcggatgttcatcagaagtacacatagaaccggaccatacggcatcgccaccaggtcagcaaatgaacatcaacactggacttcagcttcctctatcacctgtcttgttcggacaaatccatccatctcttaacatcactggtgaaaacaatgcagctgattaccaggattgtgggatgtctccagggtttataatgagtgaagcgccatgggaaacgaattttgaagttagttgtccacaagcaagaaacgaggctaagttgagatacaaggagaagaaattaaagcgctcttttgggaaacagattcgatatgcatctcgcaaagcaagagctgacacgaggaaaagagtgaaaggaagatttgtgaaagctggtgacagttatgattatgatccatcatcaccgacgacgaacaattga

SEQ ID NO: 1896 - protein, 337 aa, Arabidopsis thaliana
MEPKCDHCATSQALIYCKSDLAKLCLNCDVHVHSANPLSHRHIRSLICEKCFSQPAAIRCLDEKVSYCQGCHWHESNCSELGHRVQSLNPFSGCPSPTDFNRMWSSILEPPVSGLLSPFVGSFPLNDLNNTMFDTAYSMVPHNISYTQNFSDNLSFFSTESKGYPDMVLKLEEGEEDLCEGLNLDDAPLNFDVGDDIIGCSSEVHIEPDHTASPPGQQMNINTGLQLPLSPVLFGQIHPSLNITGENNAADYQDCGMSPGFIMSEAPWETNFEVSCPQARNEAKLRYKEKKLKRSFGKQIRYASRKARADTRKRVKGRFVKAGDSYDYDPSSPTTNN

SEQ ID NO: 1897 - DNA, 525 bp, Arabidopsis thaliana; identical to SEQ ID NO: 951

SEQ ID NO: 1898 - protein, 174 aa, Arabidopsis thaliana; identical to SEQ ID NO: 952

SEQ ID NO: 1899 - DNA, 1126 bp, Arabidopsis thaliana
cctcttcttttatgttcatcgccgtcgaagtttctccggtaatggaagacatcacacggcagagcaaaaaaacttcggttgagaatgaaaccggcgatgatcagtcagcaacatcagtagtccttaaagctaaacgcaaacgccgatcgcaaccacgagacgctccaccccaacgtagctccgtccatagaggcgtcacaaggcatcgatggactggaaggtacgaagcacatttgtgggataagaatagttggaacgaaactcagaccaagaaaggaagacaagtatatttaggggcatatgacgaggaagatgcagcagcacgtgcctacgacttagcagcattgaaatattggggacgagacaccatcttgaacttccctgtaaattttctcggaatcctattgtgtaattatgaagaagacatcaaagaaatggaaagccagtcaaaggaagagtatattggatctttgagaagaaaaagtagtgggttttcacgaggtgtatcaaaatacagaggcgttgcaaagcatcaccacaatgggagatgggaagctcgaatcggaagagtgtttggcaataaatatttataccttggaacttacgcgacgcaagaagaagcagctatagcgtacgatatcgcagctatcgagtaccgtggactcaacgccgttactaacttcgacatcagccgttatctgaaactcccggtgccggagaaccctatcgataccgcgaataatctcctcgagagtccgcattctgatcttagcccatttataaaacctaaccacgagtctgacttatcacagagtcaatcttcgtcagaggacaacgatgatcggaaaacaaagctcttgaagtcgtcacctttagtggcagaggaggtaatcggaccatcgacgccacctgagattgctccgcctcgtcggagcttcccggaagatatccagacgtatttcgggtgtcaaaactccggcaagttaacggcggaggaagatgatgttatcttcggtgatttagattctttccttacgcctgatttctacagcgagttaaatgattgctaaagtgttgttcttctgataagttttgttttttagttgttcagaatctcggttgtgaa

SEQ ID NO: 1900 - protein, 352 aa, Arabidopsis thaliana
MFIAVEVSPVMEDITRQSKKTSVENETGDDQSATSVVLKAKRKRRSQPRDAPPQRSSVHRGVTRHRWTGRYEAHLWDKNSWNETQTKKGRQVYLGAYDEEDAAARAYDLAALKYWGRDTILNFPVNFLGILLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYLKLPVPENPIDTANNLLESPHSDLSPFIKPNHESDLSQSQSSSEDNDDRKTKLLKSSPLVAEEVIGPSTPPEIAPPRRSFPEDIQTYFGCQNSGKLTAEEDDVIFGDLDSFLTPDFYSELNDC

SEQ ID NO: 1901 - DNA, 845 bp, Arabidopsis thaliana
accacaaaacagagcaacacacaacacaaagcttcatttcaattctgtttcgagaaccctttgagaaccagatcggagatggaaaacgacgatatcaccgtggcggagatgaagccaaagaagcgtgctggacggaggattttcaaggagacacgtcacccaatctacagaggcgtgcggcgtagggacggcgacaaatgggtatgcgaagtccgtgaaccgattcatcagcgtcgagtctggctcggaacttatccgacggcagatatggccgcacgtgctcacgacgtggcggttcttgctctgcgcgggagatccgcgtgtttgaatttctccgattctgcttggaggttgccggtgccggcatccactgatccggacacgatcaggcgcacggcggccgaagcagcggagatgttcaggccgccggagtttagtacaggaattacggttttaccctcagccagtgagtttgacacgtcggatgaaggagtcgctggaatgatgatgaggctcgcggaggagccgttgatgtcgccgccaagatcgtacattgatatgaatacgagtgtgtacgtggacgaagaaatgtgttacgaagatttgtcactttggagttactaaaatacgtatgtgttaaaaaaccaaagatcgtatgtgtatgtatgcataataaatgggcttaatgatgggcatagatatgataggtccagcctatatgttaaatgtgttttattttttggtttatctagtttcctaggtatttaccaaattgtattagtataagttttattaagaaataatcaaaaatgttgttgccaaaaaaaaaaaaaaaaaaaaaaaaa

SEQ ID NO: 1902 - protein, 181 aa, Arabidopsis thaliana
MENDDITVAEMKPKKRAGRRIFKETRHPIYRGVRRRDGDKWVCEVREPIHQRRVWLGTYPTADMAARAHDVAVLALRGRSACLNFSDSAWRLPVPASTDPDTIRRTAAEAAEMFRPPEFSTGITVLPSASEFDTSDEGVAGMMMRLAEEPLMSPPRSYIDMNTSVYVDEEMCYEDLSLWSY

SEQ ID NO: 1903 - DNA, 1065 bp, Arabidopsis thaliana
gtctctcattttcataattccattttcaggattgtctctcaatcttttattcttctcattcaccggtaatggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaatcgtattttctacaagttttgttttgattatctacacaatacatcaatatattct

SEQ ID NO: 1904 - protein, 313 aa, Arabidopsis thaliana
MAKVSGRSKKTIVDDEISDKTASASESASIALTSKRKRKSPPRNAPLQRSSPYRGVTRHRWTGRYEAHLWDKNSWNDTQTKKGRQVYLGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 1905 - DNA, 1383 bp, Arabidopsis thaliana
ttcttgcttagtatcattctttgtcgtgttcttttaattaaccttttgcaatttgtcttgtgtttctcacaacacaaaaacttgtaaaagtgttaaaaaatcaagatctgaaaaatcttatcaccgcttctaggtttttcagttttttttcttccttttcctgatctaaattaacttatatttcttagggtttcacttcttgaaacatttaatcagaattaattaacctctctagggctttcatggcgaatccatggtggacaggacaagtgaacctatccggcctcgaaacgacgccgcctggttcctctcagttaaagaaaccagatctccacatctccatgaacatggccatggactcaggtcacaataatcatcaccatcaccaagaagtcgataacaacaacaacgacgacgatagagacaacttgagtggagacgaccacgagccacgtgaaggagccgtagaagcccccacgcgccgtccacgtggacgtcctgctggttccaagaacaaaccaaagccaccgatcttcgtcactcgcgattctccaaatgctctcaagagccatgtcatggagatcgctagtgggactgacgtcatcgaaaccctagctacttttgctaggcggcgtcaacgtggcatctgcatcttgagcggaaatggcacagtggctaacgtcaccctccgtcaaccctcgaccgctgccgttgcggcggctcctggtggtgcggctgttttggctttacaagggaggtttgagattctttctttaaccggttctttcttgccaggaccggctccacctggttccaccggtttaacgatttacttagccggtggtcaaggtcaggttgttggaggaagcgtggtgggcccattgatggcagcaggtccggtgatgctgatcgccgccacgttctctaacgcgacttacgagagattgccattggaggaggaagaggcagcagagagaggcggtggtggaggcagcggaggagtggttccggggcagctcggaggcggaggttcgccactaagcagcggtgctggtggaggcgacggtaaccaaggacttccggtgtataatatgccgggaaatcttgtttctaatggtggcagtggtggaggaggacagatgagcggccaagaagcttatggttgggctcaagctaggtcaggattttaacgtgcgttaaaatggtttttaatttacagaagttaacaataagattataatgatgtttattatgatgatgaaaaccagtcagttgctacttgttactagtgagctatatagtttgtggacattatattatgttctctcttgactatgattattatttgctaaatttcacttagctaaaaaaaaaaaaaaaaaa

SEQ ID NO: 1906 - protein, 315 aa, Arabidopsis thaliana
MANPWWTGQVNLSGLETTPPGSSQLKKPDLHISMNMAMDSGHNNHHHHQEVDNNNNDDDRDNLSGDDHEPREGAVEAPTRRPRGRPAGSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSGGVVPGQLGGGGSPLSSGAGGGDGNQGLPVYNMPGNLVSNGGSGGGGQMSGQEAYGWAQARSGF

SEQ ID NO: 1907 - DNA, 1361 bp, Arabidopsis thaliana
ttttttttccctttcctcgttcaaaaaaagtacttgcagagtcactcactctcagtctcagcacatgaattaatttgaagcttccctagaattctttcacatcaattaatacgacaccgtctcgggtgaagaatctctcctctcttgccctaaagcgagttagggtttaacacacaaagcataccctttagatttgtgtctcttagctctgtttttgtcggcttgtgtaaccgatcaactcaagctattggctcctcacctcctgaaatttgacttctccaatggatctcaaagtttctcttatatgaattctatcttcaccctcacaatatctttatatatatgagccacaagaacaagaagagtcagtagatgcggctgccatggacggtggttacgatcaatccggaggagcttctagatactttcacaacctcttcaggcctgagcttcatcaccagcttcaacctcagcctcaacttcaccctttgcctcagcctcagcctcaacctcagcctcagcagcagaattcagatgatgaatctgactccaacaaggatccgggttccgacccagttacctctggttcaaccgggaaacgtccacgtggacgtcctccgggatccaagaacaagccgaagccaccggtgatagtgactagagatagccccaacgtgcttagatctcatgttcttgaagtctcatctggagccgacatagtcgagagcgttaccacttacgctcgcaggagaggaagaggagtctccattctcagtggtaacggcacggtggctaacgtcagtctccggcagccggcaacgacagcggctcatggggcaaatggtggaaccggaggtgttgtggctctacatggaaggtttgagatactttccctcacaggtacggtgttgccgccccctgcgccgccaggatccggtggtctttctatctttctttccggcgttcaaggtcaggtgattggaggaaacgtggtggctccgcttgtggcttcgggtccagtgatactaatggctgcatcgttctctaatgcaactttcgaaaggcttccccttgaagatgaaggaggagaaggtggagagggaggagaagttggagagggaggaggaggagaaggtggtccaccgccggccacgtcatcatcaccaccatctggagccggtcaaggacagttaagaggtaacatgagtggttatgatcagtttgccggtgatcctcatttgcttggttggggagccgcagccgcagccgcaccaccaagaccagccttttagaattgaaaattatgtccgtaacatagctgtaaccaaatttcatttctcaaaattaaaagaaaaaaaaaa

SEQ ID NO: 1908 - protein, 302 aa, Arabidopsis thaliana
MDGGYDQSGGASRYFHNLFRPELHHQLQPQPQLHPLPQPQPQPQPQQQNSDDESDSNKDPGSDPVTSGSTGKRPRGRPPGSKNKPKPPVIVTRDSPNVLRSHVLEVSSGADIVESVTTYARRRGRGVSILSGNGTVANVSLRQPATTAAHGANGGTGGVVALHGRFEILSLTGTVLPPPAPPGSGGLSIFLSGVQGQVIGGNVVAPLVASGPVILMAASFSNATFERLPLEDEGGEGGEGGEVGEGGGGEGGPPPATSSSPPSGAGQGQLRGNMSGYDQFAGDPHLLGWGAAAAAAPPRPAF

SEQ ID NO: 1909 - DNA, 687 bp, Arabidopsis thaliana
atggccgaatcgcaaaccggtggtggtggtggtggaagccatgagagtggcggtgatcagagcccgaggtctttgaatgttcgtgagcaggacaggtttcttccgattgctaacataagccgtatcatgaagagaggtttacctctaaatggcaaaatcgctaaagatgctaaagagactatgcaggaatgtgtctctgaattcatcagcttcgtcaccagcgaggctagtgataagtgccaaagagagaaaaggaagaccatcaatggagatgatttgctttgggctatggccactttaggattcgaagattacatcgatcccctcaaggtttacctgatgcgatatagagagatggagggtgacactaaaggatcaggaaaaggcggggaatcgagtgcaaagagagatggtcaaccaagccaagtgtctcagttctcgcaggttcctcaacaaggctcattctcacagggtccttatggaaactctcaatctctgaggttcggcaatagcatcgagcatcttgaagtgttaatgagtagtactaggacactattcatcacaatcttccgagactcgactatgcctgttgtgtctgagaatctgagtgatccactttccatagatatggattgtgaagctatttatcaccacttcattggcctgttgattctttcatgcaagtga

SEQ ID NO: 1910 - protein, 228 aa, Arabidopsis thaliana
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQSLRFGNSIEHLEVLMSSTRTLFITIFRDSTMPVVSENLSDPLSIDMDCEAIYHHFIGLLILSCK

SEQ ID NO: 1911 - DNA, 850 bp, Arabidopsis thaliana; identical to SEQ ID NO: 957

SEQ ID NO: 1912 - protein, 181 aa, Arabidopsis thaliana; identical to SEQ ID NO: 958

SEQ ID NO: 1913 - DNA, 762 bp, Arabidopsis thaliana
atggagggttcgtccaaagggttgaggaaaggtgcatggactgctgaagaagatagtctcttgaggcagtgtattggtaagtatggagaaggcaaatggcatcaagttcctttaagagctgggctaaatcggtgcaggaaaagttgtagactaagatggttaaactatttgaagccaagtatcaagagaggaaaatttagttctgatgaagttgatcttcttcttcgtcttcataagcttctaggaaataggtggtccttgattgctggtcgattacctggtcggaccgctaatgatgtcaagaactactggaacacccatctgagtaagaagcatgaaccgtgttgtaaaactaagataaaaaggataaatattataacccctcctaatacaccggcccaaaaagtttgtgaaaatagtatcacatgtaacaaagatgatgagaaagatgattttgtggataattttatggttggagataatatatggttggagcgtttgctagacgagggccaagaggtagatgtgctggttacagaagcggcggcaacagaaaaggagggcactttggcgtttgacgttgagcaactttggaatttgttcgatggagagactgtgatctttgattagtgtttataaacgtttgtgttctcttgtttgtgaggtttctctatttaatttagtatctattttctaaattaactaatatcttatagtattttaggcaaaccttatgtttccgtttctgtgcggccgctctag

SEQ ID NO: 1914 - protein, 209 aa, Arabidopsis thaliana
MEGSSKGLRKGAWTAEEDSLLRQCIGKYGEGKWHQVPLRAGLNRCRKSCRLRWLNYLKPSIKRGKFSSDEVDLLLRLHKLLGNRWSLIAGRLPGRTANDVKNYWNTHLSKKHEPCCKTKIKRINIITPPNTPAQKVCENSITCNKDDEKDDFVDNFMVGDNIWLERLLDEGQEVDVLVTEAAATEKEGTLAFDVEQLWNLFDGETVIFD

SEQ ID NO: 1915 - DNA, 741 bp, Arabidopsis thaliana
atgggcgaatcacccaaagggttgagaaaaggtacatggactactgaagaagatattctcttgaggcaatgcattgataagtatggagaaggcaaatggcatcgagttcctttaagaactggtctcaatcggtgccgaaagagttgtagacttagatggttgaattatttgaagccaagtattaagagaggaaaactctgctccgatgaagttgatcttgttcttcgccttcataaacttctaggaaataggtggtccttgatcgctggtagattgcctggtcggactgctaatgatgtcaagaattactggaacactcatttgagtaagaagcacgatgaacgatgctgtaagacgaagatgataaacaaaaacattacttctcatcctacttcatcggcccaaaaaatcgatgttttaaagcctcggcctcgatccttctccgataaaaatagttgcaacgatgtcaatatcttgccaaaagttgacgttgttcctttacatcttggactcaacaacaattatgtttgtgaaagtagtattacatgtaacaaagatgagcaaaaagataagcttattaatattaatctattggatggagataatatgtggtgggaaagtttactggaggcagatgtgttgggtccagaagctacggaaacagcaaagggtgtgaccttaccgcttgactttgagcaaatttgggctcggtttgatgaagagactttagaactgaattag

SEQ ID NO: 1916 - protein, 246 aa, Arabidopsis thaliana
MGESPKGLRKGTWTTEEDILLRQCIDKYGEGKWHRVPLRTGLNRCRKSCRLRWLNYLKPSIKRGKLCSDEVDLVLRLHKLLGNRWSLIAGRLPGRTANDVKNYWNTHLSKKHDERCCKTKMINKNITSHPTSSAQKIDVLKPRPRSFSDKNSCNDVNILPKVDVVPLHLGLNNNYVCESSITCNKDEQKDKLININLLDGDNMWWESLLEADVLGPEATETAKGVTLPLDFEQIWARFDEETLELN

SEQ ID NO: 1917 - DNA, 999 bp, Arabidopsis thaliana
atgaggatggagatggtgcatgctgacgtggcgtctctctccataacaccttgcttcccgtcttctttgtcttcgtcctcacatcatcactataaccaacaacaacattgtatcatgtcggaagatcaacaccattcgatggatcagaccacttcatcggactacttctctttaaatatcgacaatgctcaacatctccgtagctactacacaagtcatagagaagaagacatgaaccctaatctaagtgattacagtaattgcaacaagaaagacacaacagtctatagaagctgtggacactcgtcaaaagcttcggtgtctagaggacattggagaccagctgaagatactaagctcaaagaactagtcgccgtctacggtccacaaaactggaacctcatagctgagaagctccaaggaagatccgggaaaagctgtaggcttcgatggtttaaccaactagacccaaggataaatagaagagccttcactgaggaagaagaagagaggctaatgcaagctcataggctttatggtaacaaatgggcgatgatagcgaggcttttccctggtaggactgataattctgtgaagaaccattggcatgttataatggctcgcaagtttagggaacaatcttcttcttaccgtaggaggaagacgatggtttctcttaagccactcattaaccctaatcctcacattttcaatgattttgaccctacccggttagctttgacccaccttgctagtagtgaccataagcagcttatgttaccagttccttgcttcccaggttatgatcatgaaaatgagagtccattaatggtggatatgttcgaaacccaaatgatggttggcgattacattgcatggacacaagaggcaactacattcgatttcttaaaccaaaccgggaagagtgagatatttgaaagaatcaatgaggagaagaaaccaccatttttcgattttcttgggttggggacggtgtga

SEQ ID NO: 1918 - protein, 332 aa, Arabidopsis thaliana
MRMEMVHADVASLSITPCFPSSLSSSSHHHYNQQQHCIMSEDQHHSMDQTTSSDYFSLNIDNAQHLRSYYTSHREEDMNPNLSDYSNCNKKDTTVYRSCGHSSKASVSRGHWRPAEDTKLKELVAVYGPQNWNLIAEKLQGRSGKSCRLRWFNQLDPRINRRAFTEEEEERLMQAHRLYGNKWAMIARLFPGRTDNSVKNHWHVIMARKFREQSSSYRRRKTMVSLKPLINPNPHIFNDFDPTRLALTHLASSDHKQLMLPVPCFPGYDHENESPLMVDMFETQMMVGDYIAWTQEATTFDFLNQTGKSEIFERINEEKKPPFFDFLGLGTV

SEQ ID NO: 1919 - DNA, 528 bp, Arabidopsis thaliana
atggcgacccaagattctcaagggattaaactctttggcaaaaccataacattcaacgccaacatcacacagacgataaaaaaagaagagcagcaacaacaacaacagccagagctacaagcaacaacagccgttagatcaccctcatcggatctgacggctgagaagcgtccagacaagatcataccatgtccgagatgcaagagcatggagactaagttttgttacttcaacaactacaacgttaatcaaccaagacacttctgcaaaggttgtcaacgttactggaccgccggtggagctctccggaatgttcccgtcggtgccggtcgtcggaagtcaaaacctcccggacgtgtcggtgggttcgctgagttgcttggagctgcgactggagctgttgatcaggtcgagctagatgctttgctagtggaagagtggagagctgctacggcgtctcacggtggtttccggcatgattttccggtgaagaggctccgttgttacaccgatggtcaatcttgttaa

SEQ ID NO: 1920 - protein, 175 aa, Arabidopsis thaliana
MATQDSQGIKLFGKTITFNANITQTIKKEEQQQQQQPELQATTAVRSPSSDLTAEKRPDKIIPCPRCKSMETKFCYFNNYNVNQPRHFCKGCQRYWTAGGALRNVPVGAGRRKSKPPGRVGGFAELLGAATGAVDQVELDALLVEEWRAATASHGGFRHDFPVKRLRCYTDGQSC

SEQ ID NO: 1921 - DNA, 841 bp, Arabidopsis thaliana
tttcaacagtaatttaagttaaccggagtctctttttgttttccggcgaatttttggtactttgagttatgaataatgatgatattattctggcggagatgaggcctaagaagcgtgcgggaaggagagtgtttaaggagacacgtcacccagtttacagaggcataaggcggaggaacggtgacaaatgggtctgcgaagtcagagaaccgacgcaccaacgccgcatttggctcgggacttatcccacagcagatatggcagcgcgtgcacacgacgtggcggttttagctctgcgtgggagatccgcatgtttgaatttcgccgactccgcttggcggcttccggtgccggaatccaatgatccggatgtgataagaagagttgcggcggaagctgcggagatgtttaggccggtggatttagaaagtggaattacggttttgccttgtgcgggagatgatgtggatttgggttttggttcgggttccggctctggttcgggatcggaggagaggaattcttcttcgtatggatttggagactacgaagaagtctcaacgacgatgatgagactcgcggaggggccactaatgtcgccgccgcgatcgtatatggaagacatgactcctactaatgtttacacggaagaagagatgtgttatgaagatatgtcattgtggagttacagatattaagtgggactcacatatctactatacataatatttagcttttatgtaagaggtatttatgtgagttttaagattgtagatgtgtcccaggcgttagaagtttccttgatggtatggaatctttgtacctataaaattataaaatt

SEQ ID NO: 1922 - protein, 209 aa, Arabidopsis thaliana
MNNDDIILAEMRPKKRAGRRVFKETRHPVYRGIRRRNGDKWVCEVREPTHQRRIWLGTYPTADMAARAHDVAVLALRGRSACLNFADSAWRLPVPESNDPDVIRRVAAEAAEMFRPVDLESGITVLPCAGDDVDLGFGSGSGSGSGSEERNSSSYGFGDYEEVSTTMMRLAEGPLMSPPRSYMEDMTPTNVYTEEEMCYEDMSLWSYRY

SEQ ID NO: 1923 - DNA, 1005 bp, Arabidopsis thaliana
atgaacatatcagtaaacggacagtcacaagtacctcctggctttaggtttcacccaaccgaggaagagctcttgaagtattacctccgcaagaaaatctctaacatcaagatcgatctcgatgttattcctgacattgatctcaacaagctcgagccttgggatattcaagagatgtgtaagattggaacgacgccgcaaaacgattggtacttttatagccataaggacaagaagtatcccaccgggactagaaccaacagagccaccacggtcggattttggaaagcgacgggacgtgacaagaccatatataccaatggtgatagaatcgggatgcgaaagacgcttgtcttctacaaaggtcgagcccctcatggtcagaaatccgattggatcatgcacgaatatagactcgacgagagtgtattaatctcctcgtgtggcgatcatgacgtcaacgtagaaacgtgtgatgtcataggaagtgacgaaggatgggtggtgtgtcgtgttttcaagaaaaataacctttgcaaaaacatgattagtagtagcccggcgagttcggtgaaaacgccgtcgttcaatgaggagactatcgagcaacttctcgaagttatggggcaatcttgtaaaggagagatagttttagaccctttcttaaaactccctaacctcgaatgccataacaacaccaccatcacgagttatcagtggttaatcgacgaccaagtcaacaactgccacgtcagcaaagttatggatcccagcttcatcactagctgggccgctttggatcggctcgttgcctcacagttaaatgggcccaactcgtattcaataccagccgttaatgagacttcacaatcaccgtatcatggactgaaccggtccggttgtaataccggtttaacaccagattactatataccggagattgatttatggaacgaggcagatttcgcgagaacgacatgccacttgttgaacggtagtggataa

SEQ ID NO: 1924 - protein, 334 aa, Arabidopsis thaliana
MNISVNGQSQVPPGFRFHPTEEELLKYYLRKKISNIKIDLDVIPDIDLNKLEPWDIQEMCKIGTTPQNDWYFYSHKDKKYPTGTRTNRATTVGFWKATGRDKTIYTNGDRIGMRKTLVFYKGRAPHGQKSDWIMHEYRLDESVLISSCGDHDVNVETCDVIGSDEGWVVCRVFKKNNLCKNMISSSPASSVKTPSFNEETIEQLLEVMGQSCKGEIVLDPFLKLPNLECHNNTTITSYQWLIDDQVNNCHVSKVMDPSFITSWAALDRLVASQLNGPNSYSIPAVNETSQSPYHGLNRSGCNTGLTPDYYIPEIDLWNEADFARTTCHLLNGSG

SEQ ID NO: 1925 - DNA, 1167 bp, Arabidopsis thaliana
ctgtttttgtatccgtgtaaattaatcacacggtagtttttgatgaaaagacaacaatcggagaacaatctggtctgctgctaaaatttaataaattgttttgtctaattgtctccacccataaaaaagcgcgaattcaattcaccgactaaagacattctccggtggagaccccgatgcaatccactcatataagcggcggaagtagcggtggtggtggtggaggaggaggagaggtgagtcgaagtggattatctcggatccgttcagctccagctacttggattgaaaccctactcgaagaagatgaagaagaaggtttaaaacctaacctttgtttaacagagctgcttactggtaataataactctggaggagtgataacgagtcgtgacgactcgttcgagttcctgagttctgttgagcaaggattgtataatcatcatcaaggtggtggctttcaccgtcagaatagttctccggctgattttcttagtgggtctggttctgggactgatgggtatttctctaattttggtattccggcgaattatgactatttgtcgaccaacgttgatatttctccgactaaacggtctagagatatggaaacacagttttcttctcagctgaaagaagagcaaatgagtggtgggatatcaggaatgatggatatgaacatggacaagatttttgaggattcagttccttgtagggttcgtgctaaacgtggttgtgctactcatcctcgtagcattgctgaacgggtgagaagaacgcgaataagtgatcggattaggaggctgcaagagcttgttcctaacatggataagcaaaccaacactgcagacatgttggaagaagctgtggagtatgtgaaggctcttcaaagccagatccaggaattgacagagcagcagaagagatgcaaatgcaaacctaaagaagaacaataatgtatcctttaggatttgatatatctgtattttatttttgtactatctaaaaatggtgatgatctgttcgaaaattcgaaacatgatcttatatattgaactagaaaaaatagatatatatgaattttagctgtaaaatttttgtacaataaggagaaaaagatttagaagagtcaataaaaagatgatgtttacaagtcaaaaaaaaaaa

SEQ ID NO: 1926 - protein, 259 aa, Arabidopsis thaliana
MQSTHISGGSSGGGGGGGGEVSRSGLSRIRSAPATWIETLLEEDEEEGLKPNLCLTELLTGNNNSGGVITSRDDSFEFLSSVEQGLYNHHQGGGFHRQNSSPADFLSGSGSGTDGYFSNFGIPANYDYLSTNVDISPTKRSRDMETQFSSQLKEEQMSGGISGMMDMNMDKIFEDSVPCRVRAKRGCATHPRSIAERVRRTRISDRIRRLQELVPNMDKQTNTADMLEEAVEYVKALQSQIQELTEQQKRCKCKPKEEQ

SEQ ID NO: 1927 - DNA, 653 bp, Arabidopsis thaliana
caaatcagaaaatatagagtttgaaggaaactaaaagatggtacattcgaggaagttccgaggtgtccgccagcgacaatggggttcttgggtctctgagattcgccatcctctattgaagagaagagtgtggcttggaactttcgaaacggcagaagcggctgcaagagcatacgaccaagcggctcttctaatgaacggccaaaacgctaagaccaatttccctgtcgtaaaatcagaggaaggctccgatcacgttaaagatgttaactctccgttgatgtcaccaaagtcattatctgagcttttgaacgctaagctaaggaagagctgcaaagacctaacgccttctttgacgtgtctccgtcttgatactgacagttcccacattggagtttggcagaaacgggccgggtcgaaaacaagtccgacttgggtcatgcgcctcgaacttgggaacgtagtcaacgaaagtgcggttgacttagggttgactacgatgaacaaacaaaacgttgagaaagaagaagaagaagaagaagctattattagtgatgaggatcagttagctatggagatgatcgaggagttgctgaattggagttgacttttgactttaacttgttgcaagtccacaaggggtaagggttttc

SEQ ID NO: 1928 - protein, 189 aa, Arabidopsis thaliana
MVHSRKFRGVRQRQWGSWVSEIRHPLLKRRVWLGTFETAEAAARAYDQAALLMNGQNAKTNFPVVKSEEGSDHVKDVNSPLMSPKSLSELLNAKLRKSCKDLTPSLTCLRLDTDSSHIGVWQKRAGSKTSPTWVMRLELGNVVNESAVDLGLTTMNKQNVEKEEEEEEAIISDEDQLAMEMIEELLNWS

SEQ ID NO: 1929 - DNA, 866 bp, Arabidopsis thaliana
gtgtttgtagttgaaacttattcttccctttttttgtttttaggtatggagactctgcatccattctctcacctacctatctctgaccaccggttcgttgttcaagagatggtgagcttacacagctcgagtagcggtagctggactaaagaagagaacaagatgttcgaacgagctcttgcgatatacgctgaagactcgcctgatcgctggtttaaagttgcttccatgatccctggaaagactgtttttgatgttatgaagcaatatagtaagcttgaagaagacgttttcgatattgaagcaggacgtgttcccattcctggttatcctgcagcttcttctcccttggggtttgacacggacatgtgtcgtaaacggcctagtggagctagaggatctgatcaagatcgaaagaaaggagtcccttggacagaggaagaacacaggagattcttgttaggccttctcaagtacggtaaaggagattggagaaacatatcgagaaacttcgtggtgtcaaagacgccaacgcaagtggcgagccacgcccaaaagtattaccagagacagctctccggagccaaggacaaacgcaggccaagtatccatgacatcacaaccggcaatcttctcaatgccaatctcaaccgttccttttccgatcatagagatattctccctgatttagggtttatcgataaggatgatacggaggagggagtaatatttatgggtcagaatctctcttcagaaaatctgttttctccatcaccaacttcattcgaagctgccattaacttcgccggagaaaatgtcttcagtgccggagcttaaggcaacatagaatccccaaactcagcggc

SEQ ID NO: 1930 - protein, 263 aa, Arabidopsis thaliana
METLHPFSHLPISDHRFVVQEMVSLHSSSSGSWTKEENKMFERALAIYAEDSPDRWFKVASMIPGKTVFDVMKQYSKLEEDVFDIEAGRVPIPGYPAASSPLGFDTDMCRKRPSGARGSDQDRKKGVPWTEEEHRRFLLGLLKYGKGDWRNISRNFVVSKTPTQVASHAQKYYQRQLSGAKDKRRPSIHDITTGNLLNANLNRSFSDHRDILPDLGFIDKDDTEEGVIFMGQNLSSENLFSPSPTSFEAAINFAGENVFSAGA

SEQ ID NO: 1931 - DNA, 252 bp, Arabidopsis thaliana; identical to SEQ ID NO: 959

SEQ ID NO: 1932 - protein, 83 aa, Arabidopsis thaliana; identical to SEQ ID NO: 960

SEQ ID NO: 1933 - DNA, 735 bp, Arabidopsis thaliana
atggaggagctggattttagttcaaaaacaacaacttctcgtctaaagctatttggatttagtgttgatggagaagaagatttctccgatcaatcagtcaaaactaacctatcttctgtatcaccggaacgtggcgagtttccggcaggatcttccggaagaagtggcggtggtgtacgaagccgaggcggaggaggaggaggaggagaacgtaagtatgagtgtcagtattgttgtagagagtttggtaactcacaagccttaggtggtcaccaaaacgctcacaagaaagagcgtcaacagcttaaacgtgctcagcttcaagctacacgaaacgcagccgcaaatttctcaaacgctggatcagcgtctcagtttttaaggaatcctatagtctctgcttttgctcctccgcctcatcttttatcatcatccgccgtgcctcagcctatgggaggtccttggatgtatcttccacgtgtttctccatctcaacttcacgtgtctcatggctgcgtcatccaagatggttcgggtggtgcgggtgctggtgggttctcgtacgagtatggggctcgtgattcagggtttggagtagttggggctcagatgagacatgttcaggcccatgggccgagaccatcggttaatgggttttcaagagaagtaggaactacttttgatgatggtttagggttggatttgcatctcagtcttgcacctgctggtcattga

SEQ ID NO: 1934 - protein, 244 aa, Arabidopsis thaliana
MEELDFSSKTTTSRLKLFGFSVDGEEDFSDQSVKTNLSSVSPERGEFPAGSSGRSGGGVRSRGGGGGGGERKYECQYCCREFGNSQALGGHQNAHKKERQQLKRAQLQATRNAAANFSNAGSASQFLRNPIVSAFAPPPHLLSSSAVPQPMGGPWMYLPRVSPSQLHVSHGCVIQDGSGGAGAGGFSYEYGARDSGFGVVGAQMRHVQAHGPRPSVNGFSREVGTTFDDGLGLDLHLSLAPAGH

SEQ ID NO: 1935 - DNA, 998 bp, Arabidopsis thaliana
cgggaattaaatgcaagaaacatagaggagaccgtacttcgaagttgcaaatttaacactaagttgaagaatctagaaatagaaagccaaaatcttcctttacttcaactctacaatttcaatcttttctctgtacttagccatccagagtcataaccaccactatattaaaatgaagacttatgatttcatgaacgtcaactctttctctcctaaggaaagacccattcgcctctttggcttcgagtttggagcttctcatgaagaatctgagtccaaagacaattacaacgagaacaatgaaagcatcaaagacgataacaaagaaaaaagattcaagtgccactattgtttccggaacttccctacttcacaagccctaggcggccatcaaaacgctcacaagagagaacgtcaacaaactaaacgcttcaacctccattcaaacgcagccgctttcttccaccgccaacaaaaccacattgctgcttctaggctctacgaggatcgctatagccttgaagctgttcaaatcaacgacgcgagattagggttatgtcgtatgtataactcatctgcgagttttaatcgtgaccgttcatcttattataatagatatattccttggttcatcggtgatcaccagactagaccaacgtatgtcggtggtggtagcagcagccatggtctgttttacgagtccaagaagaatgtaccggaccacgtgagtttggatctacgcctctagttccattcttttagtatctctctctagctagttcttaaaaaaaaaaaaagagagactagttttttttccttctttcaaatactttttattttattttagtctacttgattaattatgaatttatgatagtgtatccccgtagatatcatgttatattaacagttaaacaattttatggagatgaactttaacttcagatagtttctttctgagatttaaagtcttaaatattatcgacgcattccaatct

SEQ ID NO: 1936 - protein, 191 aa, Arabidopsis thaliana
MKTYDFMNVNSFSPKERPIRLFGFEFGASHEESESKDNYNENNESIKDDNKEKRFKCHYCFRNFPTSQALGGHQNAHKRERQQTKRFNLHSNAAAFFHRQQNHIAASRLYEDRYSLEAVQINDARLGLCRMYNSSASFNRDRSSYYNRYIPWFIGDHQTRPTYVGGGSSSHGLFYESKKNVPDHVSLDLRL

SEQ ID NO: 1937 - DNA, 2693 bp, Arabidopsis thaliana
catcttctttctagtctctctctctctcttcaccgcgtacacagtaacacagaccctttttccctcttactcaaggttcttctttgtcatcttgttgccgaatccacaaagaggagaataaagattcgacctttattagatattaacgactctggatttttgggtttttggagttggatccacatgggttcttatccggatggattccctggatccatggacgagttggatttcaataaggactttgatttgcctccctcctcaaaccaaaccttaggtttagctaatgggttctatttagatgacttagatttctcatccttggatcctccagaggcatatccctcccagaacaacaacaacaacaacatcaacaacaaagctgtagcaggagatctgttatcatcttcatctgatgacgctgatttctctgattctgttttgaagtatataagccaagttcttatggaagaggatatggaagagaagccttgtatgtttcatgacgctttggctcttcaagctgctgagaaatctctctatgaggctcttggtgagaaatacccttcttcgtcttctgcttcttctgtggatcatcctgagagattggctagtgatagccctgacggttcttgttcaggtggtgcttttagtgattacgctagcaccactaccactacttcctctgattctcactggagtgttgatggtttggagaatagaccttcttggttacatacacctatgccgagtaattttgttttccagtctacttctaggtccaacagtgtcaccggtggtggtggtggtggtaatagtgcggtttacggttcaggttttggcgatgatttggtttcgaatatgtttaaagatgatgaattggctatgcagttcaagaaaggggttgaggaagctagtaagttccttcctaagtcttctcagctctttattgatgtggatagttacatccctatgaattctggttccaaggaaaatggttctgaggtttttgttaagacggagaagaaagatgagacagagcatcatcatcatcatagctatgctcctcctcccaacagattaactggtaagaaaagccattggcgcgacgaagatgaagatttcgttgaagaaagaagtaacaagcaatcagctgtttatgttgaggaaagcgagctttctgaaatgtttgataagatcttggtatgtggccctgggaaacctgtatgcattcttaaccagaactttcctacagaatccgctaaagtcgtgaccgcacagtcaaatggagcaaagattcgtgggaagaaatcaacttctactagtcatagtaacgattctaagaaagaaactgctgatttgaggactcttttggtgttatgtgcacaagctgtatcagtggatgatcgtagaaccgccaacgaaatgctaaggcagatacgagagcattcttcgcctctaggcaatggttcagagcggttggctcattattttgcaaatagtcttgaagcacgcttagctgggaccggtacacagatctacaccgctttatcttcgaagaaaacgtctgcagcagacatgttgaaggcttaccagacatacatgtcggtctgccctttcaagaaagctgctatcatatttgctaaccacagcatgatgcgtttcactgcaaacgccaacacgatccacataatagatttcggaatatcttacggttttcagtggcctgctctgattcatcgcctctcgctcagcagacctggtggttcgcctaagcttcgaattaccggtatagagcttcctcagcgcggttttagaccagcggaagagttcaggagacaggtcatcgcttggctcgatactgtcagcgacacaatgttccgtttgagtacaacgcaattgctcagaaatggggaaacgatccaagtcgaagacttaaagcttcgacaaggagagtatgtggttgtgaactctttgttccgtttcaggaaccttctagatgagaccgttctggtaaacagcccgagagatgcagttttgaagctgataagaaaaataaacccgaatgtcttcattccagcgatcttaagcgggaattacaacgcgccattctttgtcacgaggttcagagaagcgttgtttcattactcggctgtgtttgatatgtgtgactcgaagctagctagggaagacgagatgaggctgatgtatgagaaagagttttatgggagagagattgtgaatgttgtggcttgtgaaggaacagagagagtggagagaccagagacatataagcagtggcaggcgagactgatccgagccggatttagacagcttccgcttgagaaggaactgatgcagaatctgaagttgaaaatcgaaaacgggtacgataaaaacttcgatgttgatcaaaacggtaactggttacttcaagggtggaaaggtagaatcgtgtatgcttcatctctatgggttccttcgtcttcatagatgttgtttcttacgttctaagcgactgggatttatgtagggcttttctgttgatagtctctcgccaacacgagtggattaagttcagagttagggttcttgaacactagaatgttgttatattatgcttgtgacatagcgtgtgtaagagtgtagcctaagagatatagtactcattgcatgatcttttgctatatgtt

SEQ ID NO: 1938 - protein, 769 aa, Arabidopsis thaliana
MGSYPDGFPGSMDELDFNKDFDLPPSSNQTLGLANGFYLDDLDFSSLDPPEAYPSQNNNNNNINNKAVAGDLLSSSSDDADFSDSVLKYISQVLMEEDMEEKPCMFHDALALQAAEKSLYEALGEKYPSSSSASSVDHPERLASDSPDGSCSGGAFSDYASTTTTTSSDSHWSVDGLENRPSWLHTPMPSNFVFQSTSRSNSVTGGGGGGNSAVYGSGFGDDLVSNMFKDDELAMQFKKGVEEASKFLPKSSQLFIDVDSYIPMNSGSKENGSEVFVKTEKKDETEHHHHHSYAPPPNRLTGKKSHWRDEDEDFVEERSNKQSAVYVEESELSEMFDKILVCGPGKPVCILNQNFPTESAKVVTAQSNGAKIRGKKSTSTSHSNDSKKETADLRTLLVLCAQAVSVDDRRTANEMLRQIREHSSPLGNGSERLAHYFANSLEARLAGTGTQIYTALSSKKTSAADMLKAYQTYMSVCPFKKAAIIFANHSMMRFTANANTIHIIDFGISYGFQWPALIHRLSLSRPGGSPKLRITGIELPQRGFRPAEEFRRQVIAWLDTVSDTMFRLSTTQLLRNGETIQVEDLKLRQGEYVVVNSLFRFRNLLDETVLVNSPRDAVLKLIRKINPNVFIPAILSGNYNAPFFVTRFREALFHYSAVFDMCDSKLAREDEMRLMYEKEFYGREIVNVVACEGTERVERPETYKQWQARLIRAGFRQLPLEKELMQNLKLKIENGYDKNFDVDQNGNWLLQGWKGRIVYASSLWVPSSS

SEQ ID NO: 1939 - DNA, 632 bp, Brassica napus
cacccgatataccggggagttcgtctgagaaagtcaggtaagtgggtgtgtgaagtgagggaaccaaacaagaaatctagaatttggcttggaactttcaaaacagctgagatggcagctcgtgctcacgacgtcgctgccctagccctccgtggaagaggcgcctgcctcaattatgcggactcggcttggcggctccgcatcccggagacaacctgccacaaggatatccagaaggctgctgctgaagccgcattggcttttgaggctgagaaaagtgatgtgacgatgcaaaatggccagaacatggaggagacgacggcggtggcttctcaggctgaagtgaatgacacgacgacagaacatggcatgaacatggaggaggcaacggcagtggcttctcaggctgaggtgaatgacacgacgacggatcatggcgtagacatggaggagacaatggtggaggctgtttttactggggaacaaagtgaagggtttaacatggcgaaggagtcgacggtggaggctgctgttgttacggaggaaccgagcaaaggatcttacatggacgaggagtggatgctcgagatgccgaccttgttggctgatatggcagaagggatgctcctgcc

SEQ ID NO: 1940 - protein, 208 aa, Brassica napus
HPIYRGVRLRKSGKWVCEVREPNKKSRIWLGTFKTAEMAARAHDVAALALRGRGACLNYADSAWRLRIPETTCHKDIQKAAAEAALAFEAEKSDVTMQNGQNMEETTAVASQAEVNDTTTEHGMNMEEATAVASQAEVNDTTTDHGVDMEETMVEAVFTGEQSEGFNMAKESTVEAAVVTEEPSKGSYMDEEWMLEMPTLLADMAEGM

SEQ ID NO: 1941 - DNA, 20 bp, artificial sequence
  Mol 368 reverse primer
  misc_feature (6)..(6): n is a, c, g, or t
  misc_feature (15)..(15): n is a, c, g, or t
  misc_feature (18)..(18): n is a, c, g, or t
cayccnathtaymgnggngt

SEQ ID NO: 1942 - DNA, 21 bp, artificial sequence
  Mol 378 forward primer
  misc_feature (3)..(3): n is a, c, g, or t
  misc_feature (6)..(6): n is a, c, g, or t
  misc_feature (12)..(12): n is a, c, g, or t
  misc_feature (18)..(18): n is a, c, g, or t
ggnarnarcatnccytcngcc

SEQ ID NO: 1943 - DNA, 21 bp, artificial sequence
  Mol 378 forward primer
  misc_feature (3)..(3): n is a, c, g, or t
  misc_feature (6)..(6): n is a, c, g, or t
  misc_feature (12)..(12): n is a, c, g, or t
  misc_feature (18)..(18): n is a, c, g, or t
ggnarnarcatnccytcngcc

SEQ ID NO: 1944 - DNA, 1196 bp, Arabidopsis thaliana
aaaaaggagagagagagagagagagagagagagagagagagaaacgaagaaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaaggttagcacaaagacacttttatctccctcttcttctgatgaaaaatacttttttttttcttttcttttggcgaattatgaatacagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacgcatgtcaaagatcattgatcgttatgaaatacatcatgctgatgaacttaaagccttagatcttgcagaaaaaattcggaattatcttccacacaaggagttactagaaatagtccaaagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggtaaaccaaaaaaaaaaaaaaaaaaaaaa

SEQ ID NO: 1945 - protein, 145 aa, Arabidopsis thaliana
MGRKKVEIKRIENKSSRQVTFSKRRNGLIEKARQLSILCESSIAVLVVSGSGKLYKSASGDNMSKIIDRYEIHHADELEALDLAEKTRNYLPLKELLEIVQRLAQRHFYLPLLLMKNTFFFLFFWRIMNTASLKNQMSIMQVWIL

SEQ ID NO: 1946 - DNA, 972 bp, Arabidopsis thaliana
aaaaaggagagagagagagagagagagagagagagagagagaaacgaagaaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaaggttagcacaaagacacttttatctccctcttcttctgatgaaaaatacttttttttttcttttcttttggcgaattatgaatacagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacggagaacttgctgagagaagagaaccagactttggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggtaaaccaaaaaaaaaaaaaaaaaaaaaa

SEQ ID NO: 1947 - protein, 145 aa, Arabidopsis thaliana; identical to SEQ ID NO: 1945

SEQ ID NO: 1948 - DNA, 401 bp, Arabidopsis thaliana
gatttgtcattttttgtctagccaaaaaaaaaaaaaaaaaaggagagagagagagagagagagagagagagaaacgaagaaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacaaaaaaaaaaaaaaaaaaaaaaaaaaaaaa

SEQ ID NO: 1949 - protein, 80 aa, Arabidopsis thaliana
MGRKKVEIKRIENKSSRQVTFSKRRNGLIEKARQLSILCESSIAVLVVSGSGKLYKSASGDNMSKIIDRYKKKKKKKKKK

SEQ ID NO: 1950 - DNA, 610 bp, Arabidopsis thaliana
  misc_feature (76)..(76): n is a, c, g, or t
aggaagaagccatgggtagaaaaaaagtcgagatcaagcgaatcgagaacaaaagtagtcgacaagttactttctncaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacggagaacttgctgagagaagagaaccagactttggctagccaggtggggagaagacgtttctggttatagaagatgacagaggaatgtcatgggaaaatggctccggcaacaaagtacgggagactcttccgctgctcaagtaatcaccatca

SEQ ID NO: 1951 - protein, 171 aa, Arabidopsis thaliana
  misc_feature (22)..(22): Xaa can be any naturally occurring amino acid
MGRKKVEIKRIENKSSRQVTFXKRRNGLIEKARQLSILCESSIAVLVVSGSGKLYKSASGDNMSKIIDRYEIHHADELEALDLAEKTRNYLPLKELLEIVQSKLEESNVDNASVDTLISLEEQLETALSVTRARKTELMMGEVKSLQKTENLLREENQTLASQVGRRRFWL

SEQ ID NO: 1952 - DNA, 880 bp, Arabidopsis thaliana
agaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgt

SEQ ID NO: 1953 - protein, 185 aa, Arabidopsis thaliana
MGRRKVEIKRIENKSSRQVTFSKRRKGLIEKARQLSILCESSIAVVAVSGSGKLYDSASGDNMSKIIDRYEIHHADELKALDLAEKIRNYLPHKELLEIVQSVDSLISMEEQLETALSVIRAKKTELMMEDMKSLQEREKLLIEENQILASQVGKKTFLVIEGDRGMSRENGSGNKVPETLSLLK

SEQ ID NO: 1954 - DNA, 876 bp, Arabidopsis thaliana
cagaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgt

SEQ ID NO: 1955 - protein, 118 aa, Arabidopsis thaliana
MGRRKVEIKRIENKSSRQVTFSKRRKGLIEKARQLSILCESSIAVVAVSGSGKLYDSASGDNMSKIIDRYEIHHADELKALDLAEKIRNYLPHKELLEIVQRFSNIYGGTARDCSVSN

SEQ ID NO: 1956 - DNA, 961 bp, Arabidopsis thaliana
atgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaagatcttgcagaaaaaattcggaattatcttccacacaaggagttactagaaatagtccaaaggttagcactaagacaccttttatctccctcttcttctgataaaacatacttctttttcttttggcgacttatgaatacagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgggcggccgctctagacaggcctcgtaccggatcctctagctagagctttcgttcgtatcatcggtttcgacaacgttcgtcaagttcaatgaatcagtttcgttg

SEQ ID NO: 1957 - protein, 77 aa, Arabidopsis thaliana
MGRRKVEIKRIENKSSRQVTFSKRRKGLIEKARQLSILCESSIAVVAVSGSGKLYDSASGDKILQKKFGIIFHTRSY

SEQ ID NO: 1958 - DNA, 978 bp, Arabidopsis thaliana
actattacatgcctcttcctcgcttcaaaacggcaccgtttccacttgttattatttttctctctatcgtctaacaaaaaaaaaaactgacttgggattttttttcatttgtctagcccaaaagaagaagatagaaacgaagaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaagatcttgcagaaaaaattcggaattatcttccacacaaggagttactagaaatagtccaaagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgcttgaaaaaaaaaaaaaaaa

SEQ ID NO: 1959 - protein, 77 aa, Arabidopsis thaliana; identical to SEQ ID NO: 1957

SEQ ID NO: 1960 - DNA, 835 bp, Arabidopsis thaliana
atgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagagcggccgctctagacaggcctcgtaccggatcctctagctaaagctttcgttcgtatcatcggtttcgacaacgttcgtcaagttcaatgcatcagtttcgttg

SEQ ID NO: 1961 - protein, 136 aa, Arabidopsis thaliana
MGRRKVEIKRIENKSSRQVTFCKRRNGLMEKARQLSILCESSVALIIISATGRLYSFSSGDSMAKILSRYELEQADDLKTLDLEEKTLNYLSHKELLETIQCKIEEAKSDNVSIDCLKSLEEQLKTALSVTRARKN

SEQ ID NO: 1962 - DNA, 854 bp, Arabidopsis thaliana
atgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgataggatctagaagaaaaaactcttaattatctttcgcacaaggagttgctagaaacaatccaatggttagcactaagactcctttttcccccttttcctctgattatagaagttgttttccttttctgttgtttatctatgaatatatatgcagcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagagcggccgctctagacaggcctcgtaccggatcctctagctagagctttcgttcgtatcatcggtttcgacaacgttcgtcaagttcaa

SEQ ID NO: 1963 - protein, 63 aa, Arabidopsis thaliana
MGRRKVEIKRIENKSSRQVTFCKRRNGLMEKARQLSILCESSVALIIISATGRLYSFSSGDRI

SEQ ID NO: 1964 - DNA, 761 bp, Arabidopsis thaliana
atgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagagcggccgctctagccaggcctcgtaccggatcctctagctagagctttcgttcgtatcatcggtttcgacaacgttcgtcaagttcaatgc

SEQ ID NO: 1965 - protein, 66 aa, Arabidopsis thaliana
MGRRKVEIKRIENKSSRQVTFCKRRNGLMEKARQLSILCESSVALIIISATGRLYSFSSGSRRKNS

SEQ ID NO: 1966 - DNA, 824 bp, Arabidopsis thaliana
atgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagagcggccgctctagacaggcctcgtaccggatcctctagctagagctttcgttcgtatcatcggtttcgacaacgttcgtcaagttcaatgcatcagtttc

SEQ ID NO: 1967 - protein, 69 aa, Arabidopsis thaliana
MGRRKVEIKRIENKSSRQVTFCKRRNGLMEKARQLSILCESSVALIIISATGRLYSFSSAWPRSSVVMN

SEQ ID NO: 1968 - DNA, 753 bp, Arabidopsis thaliana
atgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatc

SEQ ID NO: 1969 - protein, 184 aa, Arabidopsis thaliana
MGRRRVEIKRIENKSSRQVTFCKRRNGLMEKARQLSILCGSSVALFIVSSTGKLYNSSSGDSMAKIISRFKIQQADDPETLDLEDKTQDYLSHKELLEIVQRKIEEAKGDNVSIESLISMEEQLKSALSVIRARKTELLMELVKNLQDKVGKLKKILETGDERAVMSPENSSGHSPPETLPLLK

SEQ ID NO: 1970 - DNA, 985 bp, Glycine max
cctccacatgattgtttccattactttcaccgtgaaccgttcccaaattttagcattatgagacttataataccatatggcatctaatgtcacttattataaattaattaggcacaaagtagtagctgaagcaaagttccccaggctacattatcttcaagatgctccatgtttcaaccaaaatagaaataataaaaggcaagtagctagaccatggcatggttccctatgcatgtattaaacacacacttggaaattcaagggttgagtgtgcaagttagacccagagtagtggctttcagctccattagagacctgggaacagattatgcgtcaccccatctgtttgatcacagtcaatagaccgtgtcaccacgttattgacgtcattagttttttctagtgcctcaatctttttcttaagattcactacagattccatcatcaatcgcatctttgctgatctgattcgcgaaagagcagcatgagtcagtttctctagttccataaggtcagacacactcagatgctcaagttcagaaacaccgaagtgccttttgatcatttgagaaaacgctgaaccagaccagatatctgcaatttcaaagcatagttcctgcgactttgtgtcagtaccgctcgctcctaaatgatcccaatattgctgcacgacctcggccaaactgtcaccgttgcagagctcgtagagctttccggtgctggagaagatgagcagcgccaccttcgcatcgcagagaatggatagctcgcgagctttcttcatcaatccattgcgcctcttggagaatgttatctgccgagtgcttttgttctcgattcgctttatctccaccttcttcttccccattcttcttcgcgccgaaaccctagctagcttctttttctattcggatttctctctttactatctccgaccttctactattatctctctctctctctctctctgttcctcgtgccgaat

SEQ ID NO: 1971 - protein, 186 aa, Glycine max
MGKKKVEIKRIENKSTRQITFSKRRNGLMKKARELSILCDAKVALLIFSSTGKLYELCNGDSLAEVVQQYWDHLGASGTDTKSQELCFEIADIWSGSAFSQMIKRHFGVSELEHLSVSDLMELEKLTHAALSRIRSAKMRLMMESVVNLKKKIEALEKTNDVNNVVTRSIDCDQTDGVTHNLFPGL

SEQ ID NO: 1972 - DNA, 889 bp, Glycine max; identical to SEQ ID NO: 1013

SEQ ID NO: 1973 - protein, 198 aa, Glycine max
MGKKKLEIKRIENKSNRQITFSKRRKGLMKKARELSILCDAKLALLIFSSTGKLYELCNGDSLAEVVQRYWDNLGASGTDTKGLRFEIADIWSDEAFSQLVQSHFGVSELEHLSVTDLMELEKLVHSALSRIRSAKMRLMMESGENLKKKEHILRNEGEVWGKRMEGQKRGGGGNNVVTRFIDYDQTDRVTHNLLPGL

SEQ ID NO: 1974 - DNA, 28 bp, Artificial sequence
  Artificial sequence
aagaagcaaaaaacattgtgggtctccg

SEQ ID NO: 1975 - DNA, 28 bp, Artificial sequence
  Artificial sequence
cgtctccggctccggaaaactctacaag

SEQ ID NO: 1976 - DNA, 28 bp, Artificial sequence
  Artificial sequence
ctgttgtcgccgtctccggttccggaaa

SEQ ID NO: 1977 - DNA, 27 bp, Artificial sequence
  Artificial sequence
actctacgactctgcctccggtgacaa

SEQ ID NO: 1978 - DNA, 28 bp, Artificial sequence
  Artificial sequence
atcaaacgaattgagaacaaaagctctc

SEQ ID NO: 1979 - DNA, 28 bp, Artificial sequence
  Artificial sequence
cttatcatcatctctgccaccggaagac

SEQ ID NO: 1980 - DNA, 28 bp, Artificial sequence
  Artificial sequence
ggggattagatgtgtcggaagagtgaag

SEQ ID NO: 1981 - DNA, 28 bp, Artificial sequence
  Artificial sequence
aactctacaactcctcctccggcgacag

SEQ ID NO: 1982 - DNA, 38 bp, Artificial sequence
  Artificial sequence
gaggggtaccacattgtgggtctccggtgattaggatc

SEQ ID NO: 1983 - DNA, 42 bp, Artificial sequence
  Artificial sequence
gggaaagcggccgcaatcaggctgtaagtttaaggtgaaagc

SEQ ID NO: 1984 - DNA, 38 bp, Artificial sequence
  Artificial sequence
gaggggtaccagaaaaaaagcaaacacattttgggtcc

SEQ ID NO: 1985 - DNA, 42 bp, Artificial sequence
  Artificial sequence
gggaaagcggccgcacaagaactctgatatttgtctactaag

SEQ ID NO: 1986 - DNA, 40 bp, Artificial sequence
  Artificial sequence
gcacgcgtcgaccaaattaggtcagaagaattagtcggag

SEQ ID NO: 1987 - DNA, 42 bp, Artificial sequence
  Artificial sequence
gggaaagcggccgctctccttggatgacttttccgtagcagg

SEQ ID NO: 1988 - DNA, 40 bp, Artificial sequence
  Artificial sequence
gcacgcgtcgacggggattagatgtgtcggaagagtgaag

SEQ ID NO: 1989 - DNA, 42 bp, Artificial sequence
  Artificial sequence
gggaaagcggccgcgatcctgtcttccaaggtaacacaaagg

SEQ ID NO: 1990 - DNA, 30 bp, Artificial sequence
  Artificial sequence
ttagtatctccggcgacttgaacccaaacc

SEQ ID NO: 1991 - DNA, 30 bp, Artificial sequence
  Artificial sequence
agattctcaacaagcttcaacatgagttcg

SEQ ID NO: 1992 - DNA, 28 bp, Artificial sequence
  Artificial sequence
acattgtgggtctccggtgattaggatc

SEQ ID NO: 1993 - DNA, 28 bp, Artificial sequence
  Artificial sequence
aatcaggctgtaagtttaaggtgaaagc

SEQ ID NO: 1994 - DNA, 30 bp, Artificial sequence
  Artificial sequence
gaagaaaaaaagcaaacacattttgggtcc

SEQ ID NO: 1995 - DNA, 30 bp, Artificial sequence
  Artificial sequence
aagaactctgatatttgtctactaaggtac

SEQ ID NO: 1996 - DNA, 30 bp, Artificial sequence
  Artificial sequence
attaggtcagaagaattagtcggagaaaac

SEQ ID NO: 1997 - DNA, 30 bp, Artificial sequence
  Artificial sequence
cttggatgacttttccgtagcagggggaag

SEQ ID NO: 1998 - DNA, 28 bp, Artificial sequence
  Artificial sequence
ggggattagatgtgtcggaagagtgaag

SEQ ID NO: 1999 - DNA, 28 bp, Artificial sequence
  Artificial sequence
gatcctgtcttccaaggtaacacaaagg

SEQ ID NO: 2000 - DNA, 30 bp, Artificial sequence
  Artificial sequence
agagattcagatgcccagaagtcttgttcc

SEQ ID NO: 2001 - DNA, 30 bp, Artificial sequence
  Artificial sequence
aacgattcctggacctgcctcatcatactc

SEQ ID NO: 2002 - DNA, 30 bp, Artificial sequence
  Artificial sequence
ggcatactaaggatcgagtcagcaccaaac

SEQ ID NO: 2003 - DNA, 30 bp, Artificial sequence
  Artificial sequence
acccaatgaacaattgcgtctctacttcag

SEQ ID NO: 2004 - DNA, 30 bp, Artificial sequence
  Artificial sequence
ctcatctaagcccccatttggacgtgaatg

SEQ ID NO: 2005 - DNA, 28 bp, Artificial sequence
  Artificial sequence
caggctgtaagtttaaggtgaaagctca

SEQ ID NO: 2006 - DNA, 29 bp, Artificial sequence
  Artificial sequence
ttgctttcgcctataaatacgacggatcg

SEQ ID NO: 2007 - DNA, 28 bp, Artificial sequence
  Artificial sequence
tgatgatggtgattacttgagcagcgga

SEQ ID NO: 2008 - DNA, 33 bp, Artificial sequence
  Artificial sequence
aagacagaactaatgatgggggaagtgaagtcc

SEQ ID NO: 2009 - DNA, 30 bp, Artificial sequence
  Artificial sequence
tacgaaggtacaataaagatctactatagc

SEQ ID NO: 2010 - protein, 56 aa, Artificial sequence
  Artificial sequence
  misc_feature (2)..(5): Xaa can be any naturally occurring amino acid
  misc_feature (15)..(15): Xaa can be any naturally occurring amino acid
  misc_feature (18)..(18): Xaa can be any naturally occurring amino acid
  misc_feature (21)..(21): Xaa can be any naturally occurring amino acid
  misc_feature (25)..(25): Xaa can be any naturally occurring amino acid
  misc_feature (28)..(29): Xaa can be any naturally occurring amino acid
  misc_feature (33)..(33): Xaa can be any naturally occurring amino acid
  misc_feature (36)..(36): Xaa can be any naturally occurring amino acid
  misc_feature (39)..(42): Xaa can be any naturally occurring amino acid
  misc_feature (44)..(47): Xaa can be any naturally occurring amino acid
  misc_feature (49)..(50): Xaa can be any naturally occurring amino acid
  misc_feature (52)..(52): Xaa can be any naturally occurring amino acid
  misc_feature (55)..(56): Xaa can be any naturally occurring amino acid
GXXXXEIKRIENKSXRQXTFXKRRXGLXXKARXLSXLCXXXXAXXXXSXXGXLYXX

SEQ ID NO: 2011 - protein, 73 aa, Artificial sequence
  Artificial sequence
  misc_feature (2)..(5): Xaa can be any naturally occurring amino acid
  misc_feature (15)..(15): Xaa can be any naturally occurring amino acid
  misc_feature (18)..(18): Xaa can be any naturally occurring amino acid
  misc_feature (21)..(21): Xaa can be any naturally occurring amino acid
  misc_feature (25)..(25): Xaa can be any naturally occurring amino acid
  misc_feature (28)..(29): Xaa can be any naturally occurring amino acid
  misc_feature (33)..(33): Xaa can be any naturally occurring amino acid
  misc_feature (36)..(36): Xaa can be any naturally occurring amino acid
  misc_feature (39)..(42): Xaa can be any naturally occurring amino acid
  misc_feature (44)..(47): Xaa can be any naturally occurring amino acid
  misc_feature (49)..(50): Xaa can be any naturally occurring amino acid
  misc_feature (52)..(52): Xaa can be any naturally occurring amino acid
  misc_feature (55)..(58): Xaa can be any naturally occurring amino acid
  misc_feature (61)..(73): Xaa can be any naturally occurring amino acid
GXXXXEIKRIENKSXRQXTFXKRRXGLXXKARXLSXLCXXXXAXXXXSXXGXLYXXXXGDXXXXXXXXXXXXX

What is claimed is:

1. A transgenic plant that has greater tolerance to cold than a control plant as the result of expressing a polypeptide that regulates transcription in the transgenic plant; wherein the transgenic plant comprises a recombinant polynucleotide encoding a polypeptide, and wherein the polypeptide comprises a conserved Myb DNA-binding domain with at least 95% sequence identity to the conserved Myb DNA-binding domain of amino acid coordinates 13-116 of SEQ ID NO: 438, and wherein the conserved Myb DNA-binding domain binds DNA.

2. The transgenic plant of claim 1, wherein the transgenic plant is more tolerant to 8° C. during its germination than the control plant.

3. The transgenic plant of claim 1, wherein the transgenic plant is more tolerant to 8° C. during its development than the control plant.

4. The transgenic plant of claim 1, wherein the conserved domain has at least 98% sequence identity with the conserved domain of amino acid coordinates 13-116 of SEQ ID NO: 438.

5. The transgenic plant of claim 1, wherein the polypeptide is encoded by a nucleic acid that is derived from a monocotyledonous plant.

6. The transgenic plant of claim 5, wherein the transgenic plant is a eudicot.

7. The transgenic plant of claim 1, wherein the polypeptide is encoded by a nucleic acid that is derived from a eudicot plant.

8. The transgenic plant of claim 7, wherein the transgenic plant is monocotyledonous.

9. The transgenic plant of claim 1, wherein the recombinant polynucleotide further comprises a constitutive, inducible, or tissue-specific promoter that regulates expression of the polypeptide.

10. An expression vector for expression of a polypeptide that confers greater cold tolerance in a transgenic plant than the cold tolerance of a control plant wherein the expression vector comprises:

(1) a constitutive, inducible, or tissue-specific promoter; and (2) a recombinant polynucleotide encoding the polypeptide that regulates transcription, wherein the polypeptide comprises a conserved Myb DNA-binding domain having at least 95% sequence identity with the conserved Myb DNA-binding domain of amino acid coordinates 13-116 of SEQ ID NO: 438 and wherein the conserved Myb DNA-binding domain binds DNA; wherein the constitutive, inducible, or tissue-specific promoter regulates expression of the polypeptide.

11. The expression vector of claim 10, wherein the conserved domain of the polypeptide has at least 98% sequence identity with the conserved domain of amino acid coordinates 13-116 of SEQ ID NO: 438.

12. The expression vector of claim 10, wherein the recombinant polynucleotide comprises SEQ ID NO: 437.

13. A host plant cell comprising the expression vector of claim 10.

14. A method for producing a transgenic plant having greater tolerance to cold as compared to a control plant as the result of expressing a polypeptide that regulates transcription in the transgenic plant, wherein the control plant is without the recombinant polynucleotide, the method comprising:

(a) providing an expression vector encoding the polypeptide, wherein the polypeptide comprises a conserved Myb DNA-binding domain having at least 95% sequence identity with the conserved Myb DNA-binding domain of amino acid coordinates 13-116 of SEQ ID NO: 438 and wherein the conserved Myb DNA-binding domain binds DNA; and (b) introducing the expression vector into a first target plant to produce the transgenic plant, or introducing the expression vector into a cell of a second target plant, and growing the cell into the transgenic plant.

15. The method of claim 14, wherein the conserved domain of the polypeptide has at least 98% sequence identity with the conserved domain of amino acid coordinates 13-116 of SEQ ID NO: 438.

16. The method of claim 14, wherein the expression vector comprises SEQ ID NO: 437.

17. The method of claim 14, wherein:
the transgenic plant is selected by comparing cold tolerance of the transgenic plant with cold tolerance of the control plant.

18. The method of claim 14, wherein the transgenic plant is more tolerant to 8° C. during its germination than the control plant.

19. The method of claim 14, wherein the transgenic plant is more tolerant to 8° C. during its development than the control plant.

20. The method of claim 14, wherein the expression vector further comprises a constitutive, inducible, or tissue-specific promoter that regulates expression of the polypeptide.

21. A transgenic seed comprising an expression vector for expression of a polypeptide that confers greater cold tolerance in a transgenic plant relative to a control plant, wherein the expression vector comprises:
  (1) a constitutive, inducible, or tissue-specific promoter; and
  (2) a recombinant polynucleotide encoding the polypeptide that regulates transcription, wherein the polypeptide comprises a conserved Myb DNA-binding domain having at least 95% sequence identity with the conserved Myb DNA-binding domain of amino acid coordinates 13-116 of SEQ ID NO: 438 and wherein the conserved Myb DNA-binding domain binds DNA; and wherein the constitutive, inducible, or tissue-specific promoter regulates expression of the polypeptide.

22. The transgenic seed of claim 21, wherein the conserved domain of the polypeptide has at least 98% sequence identity with a conserved domain of amino acid coordinates 13-116 of SEQ ID NO: 438.

23. A transgenic plant that has greater tolerance to cold as compared to a control plant as the result of expressing a polypeptide that regulates transcription in the transgenic plant, wherein the transgenic plant comprises:
  a recombinant polynucleotide encoding a polypeptide that regulates transcription; and the polypeptide comprises the conserved Myb DNA-binding domain of amino acid coordinates 13-116 of SEQ ID NO:438 and wherein the conserved Myb DNA-binding domain binds DNA.

24. The transgenic plant of claim 23, wherein the transgenic plant is more tolerant to 8° C. during its germination than the control plant.

25. The transgenic plant of claim 23, wherein the transgenic plant is more tolerant to 8° C. during its development than the control plant.

26. A method for producing a transgenic plant having greater tolerance to cold as compared to a control plant as the result of expressing a polypeptide that regulates transcription in the transgenic plant, wherein the control plant is without the recombinant polynucleotide, the method comprising:
  (a) providing an expression vector encoding a polypeptide comprising the Myb DNA-binding domain of amino acid coordinates 13-116 of SEQ ID NO: 438 and wherein the conserved Myb DNA-binding domain binds DNA; and
  (b) introducing the expression vector into a plant or a cell of a plant, thereby producing the transgenic plant.

27. The method of claim 26, wherein the expression vector further comprises a constitutive, inducible, or tissue-specific promoter that regulates expression of the polypeptide.

28. The method of claim 26, wherein the transgenic plant is more tolerant to 8° C. during its germination than the control plant.

29. The method of claim 26, wherein the transgenic plant is more tolerant to 8° C. during its development than the control plant.

* * * * *